United States Patent 10,233,495 (METHODS AND COMPOSITIONS FOR SCREENING AND TREATING DEVELOPMENTAL DISORDERS) - sequence listing, part 205

SEQ ID NO: 1639 - DNA, 1776225 bp, Homo sapiens
caagataaggatgataagtgtacatgaagtattacagataaacaggactctctggcctctcctgtgtttatttggtaacgaatagtagataatctctatgatgggaaacgctgaatgacacgtgataatttcattcattcaacaagcaaatattccttaactattaggtgctgaccatacagaaatgacagtgatatgatcccaaatatatattgcttttgttgatttagcgcccaatattttatgttatttgtgagttaaacaccaaaacttagtgaaattacagaacttcttaagtgtaaaataaagcagtgtggttaggcaggattttgtcatataggcactatatgtagaatagtggtttcagtagatttgtcttcctctaaattcactcatgacttgcaatggatggatttttttctttgctgagcctcgtctgacagctgcacacgtttcctctggcttctctcttttaatcaagggtttttttgcaggagccttcattctccacatcacaactgggtgccggggcccagcaggactctggattcggatgatcttggttgaggcaatgtaagacattttcactgtttgcactacagcattcattaaatttttggctgcttggatcagggatgtgacactgtccaactgtagggaaaaaagagaaaaaagagctattattccaggaggttttgttaattattgccaagcgtgggcatggtggcatgtgcccgttgccccagctactcaggaggctgaggagggaggatcacttgagcccaggaggcaaaggttgcagtgagccaagatggcgtcactgcaccgcagcctgggtgacagtgaaaccccatataaaaaaataaataaataataaaaataaaaataactgagcctgatagtctattaatgtcacaataagctgctcaatattgtctatgcccaaacataaatcaataagttctgcctcatttttttgtatctagatggataagtgattatgttcaattaactcttatgctaattatgtaatgtgttttgcaaataaccctaatacgccaatttaaatagaatcctgttaaatattatcctgtataaatcttacttttattatagtgtctcttctgtgctttgtggtattatatggtttcagtttaacaacggtacaaattggaccaattctacaaatgtttacggataaaggacttgctcttaaaaacatatcaatagccatttactacaaaaaggtggagtttagcaacaataaaatacattttctgtttcctcataaaatgttaacatttcgtccatgtaagtagtttgtatagaatacctggatcttttctcaaaaacactaaatacctataaatccttgacaactatgtcaatttggaatgtctgctagcaaacccttgccaaaaccctattgtaattagtgatagctaagaggaatattcaaaaagacatggtacatattccttctcttgcttttggaagtttctcacagagattgtgtcaaaacactagaatgctttctactcgtaggacactagtctaactccctatagtttggattcaagactgttaccagacatacgccttacatgaggattctaagcctacgtgaacctcacttccactggtgtggatctcactttcttgcacctggtctgtcacctgggaaagcagcttcccaatcacagggcagtgtgaactgccatgccaactgcttcttctgagactcctgctgagagaaaaacctgatgctgcttggaaagatatatggtctgtccagtaacctttttggtaaattggtaccaaatgtagcctatgatcttgagtctcaaggtgtacctgaattcaaagacccctgttggatgttggtcctgcacaaaagcaatttttgaaagacaaatgtcaagagtttggttccaagtgtcagaagagcttaaaataattgctaatatctattatatgctgtagtatgcagttgacataaagtaactcatagcaaccctatgaggtaagtactcttattatcttcattttatggatgaagaaacaaaggaactggaaggtctggtgacttgctcaaagtaacacagatattagatagtagggctggaactggaaccaagtaagtctggttctaccttgcgttttttctcattacataaacctgcctccaagaatatcctacttccaatatgtgattatttttcgatatcaaatagttaaataaattatactaaccttaacagagtgtctaaaattttaaagttgactagccagcaactctgcttttaagaagcttgctcttatttttgtaatgcatgttgctaccaggagcaatagagtatcttatttgccaatgcattttgttaggattgtggtttgaaaatttatatactaatttccaagttgtgtttctttggaagagcaaatagaagtactcagtcacccttataggccccaaaccatttaaagacatttagattaagactatttcataacaaaacatttttaaattttaaaacctgggtctcaatacacatatcaataaggcaaagaagaaccataaacaaatcacattataggttctaggacatggaagtacataacatttatctttaaatcttttaaatgtgtcagtataaatacaatcctgattaaccaaacttttttttcttattctccaataaaattaagtcaatttgtttgcttggttttgcaaaaataacaggatttgatcctaggactccagagtttcttctcaatgtagttatttttaaagttgtattcgttcatttacacactactacaaagatactacccgagactgggttatttataaaggaaagaggtttaattgactcacagttctgcatgtctggcagggaggcctcaggaaacttacaatcatggcagaaggggaagcagacacatcttacatggcaacaggagagagacagcaaacaaaagcagggaaaactgccttataaaaccatcgatctcatgagaactcactatcacgagaacagcatgggggaaactgcctccatgatccagtcacctccctccctcaatatgtggggaattacaggtcgctccctcacacttggggattacaattgaagatgagatttgggtggggacacaaagcctaaccatatcaaaagtaatcagttaaactatttggaaatgaagttagcataggcaatgtcaaagggcatatgtatatgtaatggcagattacaactgacagcataaactatttctaaaaagacttaaggatatttgtagtctttttaacttataggtgccatttgcacctcaagattgacctaatggtagtagttttatgccacagtaaatgcttaaatatattttctgtaaccaaaatgcattaacttattcaatgtttttatgatctactctgaatgtctcttttaagagctaattttatcccaatactggcttaatacattcttttgtttctgaacagatttttaaaagaacggttggcattgagagcattctcccttttcagatgcattcaaaaatgctaaacagccagggtggcttcacaggcaaatcagataaggagctttgttaaatccaggcaaagtggtgttgcatctccaaattgaaattgtcaagcttctaattaaattgagaaggtagttcattctttggatatgaagaatcattccaatgggccactgatataattggcacagtagatttgtcctttgtcaatgttccgttagaatgtgacaacaaaagacaacaacttaagttgaaaggggagaaatcaatgcatgaaataactaaaagaaaagtaaatgtaacactacagaaagggccatacataaaaggaaatatgacatttattcagttataatcttgtcctgtcaaaaagcatctataagatgctttttttcctaaagctaatttttttctgaaggagatactctaggccagaaacattttatatcccgtaaaaagaaataatcacaaacaatgccaattcaggtggctactcagaattccttttacttttatttaaaatgacctattataaaaatatacatattggtaataatcctaatatttagctatccttcaaccatgttgacttaaggcaaatgcttagctgaagaaccaattttccaaaatattacagccctaattaaacagattcagaaaaattagtatattctttcccatgtagagccagcaagagtgggttaggtatggcatggttctctcaacaccagtgtttcaaccttagcttcctcttctcagcaccatcaatcaggacactgagatctgccctctccatagcgggctgtataataatattaaaccctgcatcttgattatgcttcaggatctatgagctaagagtaacaaagcaccagcctccatccttgatcctacacttatgtctttcttgaccataagcaaggaacaactaggctgcgtgaaactaaaagaccaaatgacattagttttacaacccatgcagagcttccagaccacagatatttccacgtacctataattttcaactctttcaatctcgatcattctaccattttgataatatttggcaatatttaatatttcttagctcacttctctctctactacagatgtcttgcagaacaaaattatccatttccctaacactgagccaacaggtgactgtctaccatttttagagaatccccttgtattagtttgttctcacgctgctaataaagacatacctgagactgggtaatttataaaggaaagaggtttaattgactcacagtttcacagggctagggaggcctcacaatcatgtcttacatggcaatcaaggcaagaaggaacaaagtcatgtcttacatggtggcaggcaagagagtgtgtgcagaggaactgccctgttataaaaccatcagatcctgtgagacttattcaccatcatgagaacatcatgggaaaaacctgccccatgattcaattacctcccactgggtccctcccatgacacatggggattactacaattcaagatgagttttgggtagggacacaaagccaaaccacaacaccctcactgaacaaattagtttctagataaattaatggtccccaacctgaaactaacagaaaatgcatctgtgtgtttttagctaattcttgtatccattctacccaaacactagtctaaacttccactttcatcaaacctctagcccctcatattcccacttgttctgcagattacttcacttacaacaaatatgaaataagcaaacagacaacaacaataaaatcgaaacagtaaaaatgaaactgtccccaacttctatctttcattcttatccatttctattaaaatgaaaattatctggttctcttcctctctaccttcttgcagactttgcacatttaataacttctttcttctaatatatcttttcttttttttgagaaggggtctcgctctgttgtccagactggagtgcattggtgtgatctcagcttactgcaacttccacctcctgagttcaagcaattctcatgcctcagctccccaagtagctggcattacaggtgcatgccaccatgcctggctaatttttctgtttttagtagagacgggttttcaccatattggctaggtcagtccccaactcctgacctcaggtcatccgccttccttggcctcccaaagtgctgggattacaggcataagtcactgcacttggctcttcttgtaatatatctttattctattcctttctactgactttttcactgtagtatataagtgtttataaaaccatatcttaaaacatagccagacttattaaaaggttatctattatccctaaaactattttcctcacttatcacttcttaagccatctgattcctttcatataaatgcttcccctttatatatatgtatgtatacacataatatataaaatgacacatatatatcaaatatgtgataggatatataatcagacatcttatatattaatatgtaatgtatgctagatgtattatataatatataatagatactaaatatataatagattacatacatgttaaatatataacatatatgtgaaatttttcaattggtaacctgcataactgttttctttcaatcaaatcacatttataagatcaattatttctcattcttgaatgcttaattacatataaatatcacagtttatccattctactattaataggcttttaggtagtttggagctacttaaaatatataaatataaaataaataggaacttatgaatattctagtatgtgtcttttggtgaacaaatgtatacaattttatcaagtatgtacctgagagtgccactgtggaattatgaaaatgcatatattcagttttattggataattccagggatttccaaagtgcttctgcaaatttatatttctagcaacaatatatgagtgttccaatttttttttttttttttgagatggagtttcactcttgttgcccaggctggagtgcaatggttcaattttggctcactgcaacctctgcctcccgggttcaagcgattctcctgcctcagcctaccaagtagctgggattacaggcatgtgccaccacacctggctaattttgtatttttagtagagacagggtttctccatgttggtcaggctcgtcttgaactcccaaccttaggtgatccgcctgccttggcctcccaaagtgctgggattacaggcttgagtcttccaattgtcacacatcttcatctacattttttttcccatatttttcacattaggcatttttgcaagtatgtagagatattatattgaggtttaattggcatctcattaattactaatgaagctcagcatattctcctatggttacagctttgacttgcacatacagacattgttcaattcaatttttaataatccttatatatttttctatagtcttttagattttctatgtatgaaagcatatcatctatgaataaagacagttgtatctttactttttcattttttttaatttttgttctgtattattccactagacagaaatgccagtatacaagtgagcatacaaggtatttttgaatcatactctaactcagggagaatgatttcaatatgttttcactgattttttagttaactcacgtattaaacgagtctttaaaaatttttctagtaaatgaggacttactagtcttccttttactattgatttctaacctaaaatactattgtgattaaagaataagctctgaatgatttaaaacattttatatttgtggatgctttgtttatgacgtataatcaaatatcatatgctttaggtacactagaaaggaatgtgaattctagtattgttacatcagtgttctatttatgacaactggtttccttaagcctattatcagtcaagatccttcccaccccaggtatcaggcatccacagatctgctatagagcaccacagattagatgtatattttctatagttgtatataaatggaattctatggtatgtaattttttgtgtgatgtttcacatggcattacatgtgtaagcttcacgtatgttgctgcatgtaccagtagtttattttatttattgctgagaagtattacattttatacatatactgcaatttgttaattcattatctttgtgactggcatttggtttgtttatttcatttgctataataaataaagttgttatggcattattgtacaactattttgtattgtatgtttttatttctcttgggtaaataactagaagaaaaactatgttctgttgttaagtatgtttctaacttcataagaaattaacaaactgttgaccaaagttattttaccattttgaattccaccagcaatgtatgagcattatagttattctgcatcctcagtcacacttggtattttgatattttgattctttttacattttaggaattttgatgagcataaagagaaatgtcactgttttgttttattcatcttctatggttaataatttttgtcctagcaaaaaatggctactacaatgttaaacagattttcctttatgctttcttccagatatttgaagttagagatttatgtttatgattatgcttactttgtattaatttttgtatatggagtaatgtgcagtacatttttttcatatacagatattgttcaagcatcatttagtcaaaatgattttcttttctttttaaataatcttggaattgctgtcaaaaataaattgatcatttatgtttggctctatttctgcttcatttctatgtctatctttataccagcatcatactatgacgctaacatcactttctcagggaagagttccacaatactaagactagattggatcctcttttttatgttcttatagaaatctatacttcatttaacattagattcatcagaaggcaatatgatccatgtaggtggagacaatgttcttttttacccttttattacttgacacagtctacaggagatatctggcatatgaataagttactggaaatatttcttatataaattgtagaattattaagtgcagaaaccacatgcaaaatactgtcaaaggcagacatgaattcaattattctcttgtattctgcacaaactgttaatattttccagacatttcataccctcactccatctaccaggaggtttctggcctctaaacatggcacaaaaacccttgatcaaataatgtttctcattatttatgtttaaaactcagaatgcaaatctgttggaagtcatgcttgtcagaaagttccaaagtcccaaattcccacttttagattattatttctcttttttttattatactttaaagttttagggtacatgtgcacaacgtgcaggttagttacatatgtatacatgtgctatgttggtgtgctgaacccagcaactcgtcatttaacattaggtatatctccaaatgctatccctcccccctcccctcacccacaacaggccccagtgtgtgatgttccccttcctgtgtccatgtgttctcattgttcaattctctcctatgagtgagaacatgtggtgtttggttttttgtccttgcgatagtttactgagaatgatggtttctagcttcatccatgtccctgcaaaggacatgaactcatcattttttgtgtctgcatagttttccatggtgtatatgtgccacattttcttaatccagtctatcattgttggacatttattaaaaactaacttcttgagaaatatgtcttattggcccaagaataaaacatcagttttatagtcgacaacctgtgtttgagtcccaactctgccacattctaaatacaaagcctggggagaaatcaattagcatatcttgggctcagtttcctttcagcataattacaatacaaatacatttcagtattgtttattaagatttaatgtgataacagctaatcttagatttgtgtatacacatacccatgcacataaatgaagctatagcttttctttctttcttttttttttttttggagacagagtctccctctgtcacctaggctggagtacagtggcgcaatctcggctcactgcaacctccaccttccgggttcacgccattctcctgtctcagcctccctagtagctgggactacaggcacccgccaccacgccctgctaatttttgtatttttagtacagacagggtttcaccatattggtcaggctggtctcaaattcctgaccttgtgatctgcctgccttggcctcccaaagtgttaggatacaggtgtgagccaccgtgcctggccaaagctatagcttttataagtttataaggtgaactggaaaataatattacaccaaatttgaggattttggtggaataaagcttaggacaaattctacccacggttgaaaatccagaaacagcacaagaacatttcttgacaattagaggtgaaggggcaggtactgtgactctttcccattatccacaacacatttgtgtgcacatgcatgtgcacacacctgtacttacacacacataagtatgtacacacacttcacacacttttcaaaatagtgtgaggtcagctcggttaatcacaatccttttggtgagtgtatcagtcagagctcagtaaaaaaaaaaaaaaaaaaaaaaaaaaacagaaactactgtaggtgcttcaaacatggaatttaacacaagaaattaattatataggcaacggaaaaactaagaagccaaatgtaaagcaaccctcacttcaccatcagcccaagttgttaccatcctggtgctgaaggaaatggagaagatgaacccatgccaagtagataaactaacacaaataaatgattgcttgtcagcagtctgtcaattttctcccattggttaactctagctgaaaatcagtaagtagtcaaaacatcttgactaggaaaatgttctgagagtaaaagtaaccatgactagcaaaatggatttttagcctgagcatgcatatcccctcatttttagtatgtcgtgatttcattcttaaaatctcatagtagttaatttttttatttctgtgattataatattgagtatgcttaaaaaataaagttcacacattcatactctcattcaaagaaatgtttgtacaaaatcaacattttgtataaatgtcatcttctctacctccatcactagaaaaaaaatatgatagagggatgggctttagctctcagcccttttacatattcttgatccttaagatgctgtcaaatatgcctattcatctctatacaaattccagtattttgttgggaaaatagaggctgcaagagcaatgggatgcatagattaattgtaaattaatacttatacacataagtatatatactgtacatgtttatataaagaatatggttttctgatttttaaataaaacatcagcttctctatttttttgaaatacagctgaagttttgccacatgttgaaaatttccttcatgacccagatttttcagggtctttgaagattcaaccatggtttaacttgaccctataaactatgtcattggctctattactaaattaatagctgactttcacaattatctataaagtgagagctatactgaaaagatgactagctttagacaattgcaacaacaaaatcaatgataaaggtaccagttttcagggctcttgtgtgcttttgaaatacatatctttctcgtagtctcatttaactggtagatgtgggcactgccatagcgccttgcctgctaggaactacaaacattacaatatgtactatgtcagttgtttaaacataggttaagcagcagcagcattaactcataccattattgcttcatcaacacactggaagtaaagggaagcagataacaagacagtacggtgctttggaaattattccagagatgcctggagcaacaaggttgttatctcagatgtgaggcatagaatatgtcaggtgtaaaaatgcaccctgaggaaaacaattaaagtgactgtcttctatttatttgagactcacacactctgtacctaagtgaatatcagaggttggagaagtgtctgtgatcgggaaatattaaagagttctgttcctgaatttagtctctcttcaaatcagaagtctctctcttcctgcctagagtgtcttataaaacacaaacaatcttccagagtctttctatagatcagcacagctgtctcctagctgagaggacgaggttcaaacacatttcagagcagctggttgttggcttcccagctgcttaggaaacaggaaattttattggcagcaatccccaacctgaaagcagtaggcatctaaactaatccccaggcattggaattcagcaaccaggagaagcaagaagccatgtgtggtttttaatcactgtgatgttggtctttgtgtaaattcaaagaataaagttctcaaggttacgtggatgaccatgtaggtgagagggtgtgtgtaagctgaagggaggagggaagtagagctgaggggttaagaatagggactctggaggtaaactacacaaattcaaacaaattctttctctctctgagtctgttttctcctctgttaaatggaaaaccaacgacatctaccttatagggttgtcagaaggacagaacgtgaggatccagattaatgatatagcagaatgggatgtatatatcctgtttcattgtcattactatgattgtcaaggttttgaaaacaacaataacactcctttatcaattgttattgcaaaaactgaaagaatgcacaaagctgaatttgtaataatggctcccattttgtaaacttgtgtcaagaccatatgctttaaaatattatctataatcctagtaacagccttgtgatgtaggtattatttttcccacttattagataaggtatctaagaactatgactcagataatttcagtgccttgcccaaggtaacacagatagtaagaggtaaacttgggattaattccaaatcgccgtaactccaaagccctcattctctcaaccatcttgtgctgctacttttttgagaaaaggaaatattttgtagctcattgaaaagatctcttaattgggactgttttgtcctggctaaggtctcccaacacagtcttcttattctacctctgaatactttgtactaagatattcttcctctctagtttgggagtctttttaaaattttttaaaaatccttcatcattgaactttgtccccacttggtttttctgaatggtgctccccagcttctcttgtcctccagaaacatgtgccaaatgtgattgctcgctcattctactgcaccttaattgcaccatttcaaggggaagattgacttttgtgattaaaaactgcttgaatttctgggcaatcctcatatgaactgaccccaatttttgaatgctatatgcctaataatagactgaatggtgcgtgtatgtatgcgctttccactttagattccctgggttttgtcttctcttttaaatctaactgttcaatttgaatatccatagataaaaaaaatacaacaatataatgataatagcacaatggtcacaaagaaagaagagggttgtcctctagaagaaagcttttaacctaggggtccagacacattggtgcatttcaattatttgtgacatgtctcacaagagccataatttgatagtaataataatagttcaaatattgaaattagaaaatgatttactgttttctcacaaattggagtggcttcaaggttatccctctaattatgcccttttactcacttgcattctgatatacttcctggagcaggaaagaaaggggaagggctaaagctagtttcctaggaatcaagcttagaagcccaccttattaagacagtgttcagtgaaatgggcctactcataagaaatgtgttctgcatgtgaatgtgcatcatagcaaaaaaacgaaaagtaaacatttgagattgtcttctccaggaactagagattaggactaaacagattaattgcctttaagatcttcctcataacaccagtgtaaaaaaaaatggccatgttctaagatcccagattcaaggtctaaagtatttttaataacctgtcttacccatttaataagttttcaattcattttcattcatcttccacaatgtcttctgtggcagacactatttgcccatttttccttgataatgataacctgattttattcaggcaattaaaccagacctgaccttttacaactgattggtctagaggtgtttcatgtgacccagtcccgaccagctgggtaggaggaaatctgctggagtggttctggcacagattcttttttgcatgtcatataaagagaatgctcagtctcttacttcttaagtgatggtgtaaaaacatgaaatttagagctgctgtatccatattgaaattatgaggaaacacataacagtaagaaacaaatgatgatagaaggaaatgttaaataatctaggtttaatgacattattaaactttgtaataaccataatctggacttcttgttatgatttaagtcattgataataagatttgttacttgcaattaaaagtactccttttccaaatcccattttcatttctctatttccagcctaaaatagttcagatgaagacaacgtaatcagtctcttagatgaggttccacattctaaccatcttggtaacttcagctgcagctgtttctctccagcactagttgcttcacatcacacccatgttcaaaaatatgcagactctccttgctctggatattcatgctgtgggcactcggtgtagcactggcttatctaactcccaggtcataactttacttaagcatgactagtccatttgctgttgctcatctacaactagttgatcctgccttcataatttgaattctaaattattattttatcgatggaatcacactcaccccactcacatctattttgatctttaaaatccagagttttgaagcaaagtttttgttacttcaataaaaacagtgtttgtaggtatggatcaaatcaacatggtattgagatattgtttaacaattccctcagaaagaaatacaaaaatatgggcagagaggtcaatcaaaaaaggaggatgacacactgagagaatggctgcatggaggaaccaaaggaaagcccctttaataagtaaaagatcttgggcaccaggaggtcagagttttcatcctaggtaatcattgattgaggaccgatataagatggccattgattttagggagctctgtagccttttagagaaaatactggggcttagtagtgcagaactcaaaatctcatagcctaagagaaacacagtaacactgagtgaggagtcagccaagcaaagaagtagcagtgcccagtgtgtccatatgactgtcccctattcactcccatgagcagctgaaatgataagacatgtacaagccagtgcaatttgagttattcctgttcatataacatgatatgtataacacttggattgctaagctctagaaaatttttggctacaacagtagtccgttgtcctaagaaactatatttcaacgtatcttcaatcttttgaaaaatctaccattcaaaggaagaataaagaatttgttttgcaagaagatgctaaaatgtgttttcgtaggctcctattatttcaagattttcagagatggatctgccaatgtcatggagataatttgcactaacttggttttttttaatcttatcgttctgcttataatcatgccatgcttctgttttgttctcttttaaaatatctggttattatgccttgatttatttgaattaagcagaaacggtgacagaggcaacttgtcctgtgctagagttttggtgatttgaaaagactggtttttatttttacagaaatcttattgaaaatgttccagttaaggaaaacctgctctagaagtgatgcagacaatgcagtttaaatgatgagaaaatgtggtgaatgctaatgttttatagcttttaattattttgtcctttgggttcagcgaaatggttgtgtatcttagggtcacggagaacattcattttctaagtgtgtgtgtgtaatttttcttctttatttctttgttaattttttaaattgacagataatattttatgtttttatcaagcacaacatgcattctagcttatggaaaggcttttgcactgagtatagaaggctaggggtattttcagtgggtgaacttttatggataatgatatgaccaagctatagggcagcgtttatgaatgcatattttattggaactgataaagaagtgagatggtctgtggaatagacagtcaagagtttagatagtgaggtttttgcaacagcatggaaagaaaagtatcaatcttgcttctttgttcagatacctgatgtatcttggtttcaggcttttcaatttattgttcaaaatgctaccagggaagacaaatgactaactccagttgtcttgtaacaacagtaaagctttggttagggagtttacaattggacttagaagacagactgcgcaagttcttcaaatccaaatttaataatagataaatgttgattaggattctttattttcttaagttaacttttagtatctggtattaatgtagttaggtgcaaaagagttctatgaatttgcaagtaccacagtcaaataattgttttgaatatataaacaaccatgaaaccaaatatatttatgaaataatacagtagttgttgctttgtattaacgctataaaaggggtctagaagtagactcttgatggcatcaagctgtcttgaagtccctattactctcatttgggccaataaaattatacattatttgttggacagtgtctacaactccaatgaacattcatacgctgaagaattccacatcttcagctctgacatttgggttccattattatcatatttccaattgccttttggaaatttacacttagatgtgctataaggatctcaaatgcaagccaaactttctccccagcagtgtagcataatgattaaaagtgattaaaaacacagacttcagaagcaaatagtctatgttgaaaacttttctctgtcacttattaaacaagtgaccatggatgatttatttaacttttctgggcctcagttttcccatctgaaaaacaggcataataatcatatctacctaatgaagtagacatgacaattacataaattatacggttatatatttatttaaacatttgtaatagtgtctggcacatacatatattaaaaacaggcacaataatcatatctacctaataaacttgttgacatgacaattacataagttatataactatatatattatataaatataaacatttgttatagtctgccacatagtatgcactatatataaacttttaagtactattacagtagcctccaaatctgtgcctattccactcatagtcaccacaatgtatttattgtatctcctaaagctcttaaatgtaaacccccttctttgactttacatctgcctaattaatgcaaatcaatgtcctttttacatgaaccattgaaatagcctcccattggtctcatagagttgtttccctttctttaatttatccaggattatctttctaaaatatgatttggataattactttcctgttttacaaacttcaagcagcaatagtaaccatagaataagttcagagtattgagcatgttatagtctcaaactatgattttgccaatcttattttccaccaatacaacttactcaccgtttctttctcacagtatgaaatgaaagtcatgcttccatgagtagatgtttgcctttcttccaagagtttctttcttgaattcacactgttctttaagactcagcttgattatctaagtcattttccagggagatggtgatgatatccccaacaccattctcctctttcaagtagtgatcatgaccagtttctttgtgcaccctgttgtattttgcccatacactgtactcctattatagcacttaccaaagtgaactgctattgtcttgccctgatcttcactaggaaaatgaatataaaacaaaagatgtaggataagaaaaactctaattgtacttgattgttggctcacatttaagtagtgattacattttttaaaagattctggagaaatgactatttttttctttgattctgtgaatctaatagatcatgacactttgcaagcaggtttggcatgccagagtaagcaaaggaaggagtgagagaagaatgctaccttaatcaaaacaggttcagatggactgccctgtcctatatccaaaaaaactcaaaaaacaaacaaaaaccatgtattagttattctgatgttgtctttgataagaactaagaacattaaaaagagggaggctgctgattcaaatatcctgcaaagattttgaaggaaagcaatgatcaggggccatctcaatgagtatgttgaagctgaggggaaacagttatttctggagcaagtttagaaaatgaattgccctcagaattaggtagatattgtatcctggagtatttgattccgttgatactagaatcttaatgctttgtttcactttcctgattttgatacttaaacgtgcttcgtaaaccatctgaaaccaaagctacaggattgtctgaatttaacctaatgataccagggaaataacgcataattatttctgctctccttagcagaatttaaattctctctcttctgtcagaaagatgacaaaaaaaaatgactcatgtcaagaatcaatttgtcacatctataaccttgacactattgaaaataagtatatagtgagatgactggggactttaaggggttggaagaggcttgacagaaggaagtctgatttataacctttctcatctatgaactttccaaagactttcatctaatgttcttcctggatcccagccctgaatttagttaacctttgtggctgtgccaatttatccacacctttgagttctatctcactccagaatatgaaaccaatcttggccaaagacagaagcctataaggcatctttggcaggtggcataacagtttagcattgagttattctccttaccaacggtgtgtgttagtgagcctattcgatcccttataattgtgctctgaatgataagggatcaaataggcccactaacacagctgtcaagtaactggaagacagcatagactagtagaaagagttttcctttttttttttctcttttttcttttctttttagacggagtctcgctctgtcgcccaggctggaatgcagtggcgcgatctcggctcactgcaagctccgcctcccgggttcacgccattctcctgcctcagcctcccaagtagctgggactacaggtgcccgctaccatgcctggctaattttttttgtattttgtagtagagacggggtttcatcgtgttagccaggatggtctccatctcctgacctcgtgatccgctcgcctcggcctctcaaagtgctgggattacaggcgtaagccaccgcgccctgcctagaaagagcttttcagctgtaaattgagactaaatattcaatgtacattttggctaccgaataattttttcctagttacttaatgtttctgagctcaaatttctttgtgcagtatgcaggttggactgaatgacttataaagtcccaaccagttctacaattttaagattaataactgctactttttcctctaggtcctccacagaccctttaaaatcatgacagattatatcagtgactagatttctgtctttaaattcttatgtttagttccttgatacatgcaaactgttttcctacccatacataatgaatattctcttgatttaatgcagatttgggggacacattcctatattaatattttctcctatccttgacactttctataaactaagtacatcctagcttagtgtaattttttgagtctgtcctataacctatcactagcctctctttggtaactcttctaaactctcaatgagcaagaaaaacattaccaacttacgtacattatgcgctcaaactactattattgtactgcagtttttataatataaataatttgtatgattatttgatgaattatataatgataggttacttttggcattagcaagattatttataataaaatgcagtgtggtggtattttgggaaaaagtaacctgaacaccaaaacttttattcttgattaataaagaggataatatgaaatatcctggaagggaactgtatattatttatgacaaaataagtcaaatggaattgagcaatggatttctcttaatcaaatcaatgtatttgagcaccttccaactgaaaaagcaaggaattagttgaatatcccaacccaaaccaatctaataataatttatttcaattttctagaacccaatatttaccttaacacataaagagcatttctgaatctgtaagaaaggaaggccctaaacagtcattgtgttgcaaaaatccacatgatctgtactcttcaatgtggaatgtacttacctcttgtacttctaagccacaagaaattttaaagtactagtcaatattgtttcataacagttgggaatttggcagatagttattgagggacatttgatgacctctagccccagattagtttaaaacattgttaatctataaactacaggcatgttctgctctcacacttactccaacataacagaaaacaggaaaaacatatcactttattatgtgttttttatattaatggccactattcactctgatgttattatagattatgttgttcaacatatactgactctttcatatcactgagcagagactagatgatatttggtacaaatggaaaagtagtaaaatatttattcagaaagtatgtgagttcattttacttagagacctgtgattacacacatgtggttttagcaaaaacagaattgagatgcataggcctttatcccggcagtgaaacaatttttttttctgatttaaaaaattatactctaagcagttgagggattttcagattcccagttaaattttgggattatatcctgttcaaaaatcagtttgtgaaacttgcaatgccattcacaaaagaaaatgatatttcagatggtgatatgctttctcagcctgttcattgaacccttcttgtttaactcatgtttcatgtgaagtatttaagtcacagtaatccagaatgccacaataataattagtatttactgattcttgaccatgccaaaagtattatatccattatcacatttaatcctgaaaataaaccaaacaaatcttatggatatagataagaaaaagaagattacttatcctttccaagaccacaaatcttgtcaaaccttgcaagccaatatttacatagttcaaatgcacagtaagcagtgcttattatgtgctaggcattgttaaatagctttagatatatttaaatcatttgccatcagaagtctgtactgtaggtcttactattatcctcattttacagatgaagcacaaagatccatagtcacatattttgtaacaagagcaggatctgcagccaggcagtctgggtccatggtccatgttcttacccatggtgcaatactgactcttgaagtccagggtctactaagaatccaggtctacctgactccaaagccagtgcttattttactactcactgctgtcactctaacgacatgtagaacagcttatggaataagaaaatgcgttcaatatgccaagtcaagatgcctggaatatttaagctacccacgtgattcccatgcagaaaataaagccagagtctgcattttccccccaggctaaggaagaaaaattcagtttgctagaaacaatctcaaagacctgtactaggggtttgtatggggaaggaggccaggatttgtgcaagtataaactctggattcagttccaagttcagaatgttactctggttagttccactgactgctccctcccccatttcatatttagtatcttgattaaattgattctgatctttccttcccaaatatgactatggtcagtcttggaagatatcttccacctgttggaaacttaaccaaacacaaagagtcctgaaatcttttaaagatgtttacaatttgcaacaatggggagaaaaaaaaatggggtaaaagcagcattttgaaaagaattaacccttgtgtatgtcttatttctagaactggtgtttctggctcactccattttaacagagaatgttcaccttatataattgcctgccccaagccctcgtcacctgttttggttttttgtttgcttactgaaatggtatatttaaaatatatgtttcacaagggtgtttactcaaaggagtacattttactagatttcagagaagaactctatacttatctgttcatgtttcattaaagcaggtttatttaaaaatcattaaaataacatttagggttggatgcaaggtaggctctcttgtgatgtggggagcagttggagatgcattagaacttgggaatgattgcaagtagattgccaatggcagaggaattaaaacagaaggaagcatccaggaggctgagatgggcagatcaagaagtcaagagatcgagaccatcctggccaacatggtgaaaccctgtctctactaaaaatacaaaaattagccaggtgtggtggcaggtgcctatagtgtcccaactactcgggaggctgaggcaggagaatcgcttgaacccaggaggcagaggttgcagtgagtcaagatcgtgccactgcactccagtctggtgacagacagaaactccctctcaaaaacaacaacaacaacaacaaaagaagcatccattagcacatacaaatttattttcattgcctcttttctttctctttatcaatatatcttctgacctgaacttcttgcaaggagaagtgagaaatgggctttgggtaagagaataagaactgaaaaaatatttagcatagacaaattttgtattgctaagctaaaatcagtcatttatttatacttaaagaatctttacgtttgtgagacagtaaaatgctctggttaggagtacaggctctggaataaaaaaacctagatttaaatctggattccacaacatactcatggtagtacctcacggaccagttactcaagttttgcctcaggttttaatttgcaaagttgtggtaaaacaacagagattgctacaattattataaagattaaataaagtaaaatatataaagaacttaaaacattttccgatatataacaagcgctagtaaggattaatttttgttattgttgcttctgttgataatagttatgtctttttttctttttctttttttttttttgagacggagtctcgctctgtggcccaggctggagagcagtggcgtgatctcggctcactgcaagctccgcctcctgggctcacgccatccttctgcctcagcttcccaagtagctgggactacaggcgcccaccaccgtgcctggctaatttttttgtatttttagtagagacggagtttcaccatgttagccaggatggtctcgatctcctgacctcgtgatccacccacctcagcctcccaaagtgtagttatgtcgtttttaatatgcattgtgatccagatgctgggatgatagttttacacagaggatctatacaaagcacaactgtacatataacctcaaatattactgctaggattctctaaaagaagtaatattattttatgaagtgacataggacaaacaaaatcctcaatgacattacatcaaacctattcgctgcatgcaactagcagggtgaatggtagggcgtggacacaaatctttctgtcaatatttccatttactctggcttgtggacccatggacacagacaagatgggaaccctgaagggttcagccaccacaggtcactactttatgattcaatttcatctttagggcaggaacctctttacaaagtgtatgggtgagctttggagtcagtaagcagtgcaatcttcccccagttttatcttagaataggtatgtgaacatgagcaaattattaacctttcatgagacatagccccatcatttgtaaaatggagataaaagtatctacacattaggtaagtaacaactaaaggagatgttgtatataaaacatagcaccttacagatattgatttagcaagccagctattcttatattattatatttaatcttcaagttggaaaaccaggaacaaatttaccttttttagaacaactaatttatgtatgtatgcatttttatatgtaggcaaatacctcttctataaatgtccctaggaattgttgctaaagcaaaatcctttcttcttgagaaagcctttaaagtctgaaaggttggcaaaggaagattcttaagtcctcttgtatgaattagcagacaatttttctcggctttcaaatcacccttcccaaaacaaaccacaaatagtcccaatatttgcacagatccctcaaagagaaacaaactacagtttccctggagctcgtttgtcacttttccctttcttttagcatactccgaggcacttaatgccattaggcaaaattatgccatccatggcattgcacctggcatggctagtgttcccaggtggagaagcagatgtataatggggctattcgaaaatgctacattggaaaaacagctatacaaacaaaattagtgagacaacactgaagattgctcttccttctattccagcataatttatcttccagaaaaaagaattactgcatgaaccatggatgagcataattaagggggaaggcaaagtggaggagttttgtagccgcatcccgtgtacattgtgcagggagagagaagggaaaccaaagcattcactcatatgtccatgcatattaagccatttagctggcatatggaatgtttcaggttgttccagggatatagacaaggaactaaatattgactcagcaagagctcaaatgagaggtctaattaaattaaatggtacaaaggggaggcttgtttcatagactccagtaattgcttaaaacacaaaagagaccaaataatgctcaaagaagtatagtaacaaacaagaaaatatctgtctatctatctatctatctatctatctatctatctatctatctatcatctatctatcatctatttatcatctatctataaatatctacacactaggtaagtaacagctaaaggagatgatgtatataaaacatagcaccttacagagattgatttagcaagttagctattctaatattattatatttaatcttcaggttgaaaaaccaggcacaaatttaccttgtttagaacaactaatttatatatgtatgcatttttatatgtaggcaaatacctcttctataaatgtgtgtgtgtgtgtgtgtatatatatatatatagtgagagggagagaagacatgagcataaaagttaccaagagttcaaaggctatggttggctcaattgtgaaaaatggttggaatttgttatgacaatatataatcagtggtgcctttaagcagtctggcgatgacacatgcatcagcatgttagttttaattttacgttaatgactgcctatctgcagaaatgccttaggataatgtcctttctttggacaaacttgattgatacttcacgaattataggagcaatggttctgaactctaaaaatgctgtgctttaagtcctgcccaaggaaagagtgagggtgagggaccatgaagatgattctggtgtactagggttgtctatttcagaataatacattgagaatgttggacagcatttatagaaatagacagatttcatctctgacccaaaagcactattgctgagtgttgggcatgccagagcccatcttggataaaagggagatgcaggatggaactggggaatgaggagaaaagaggctctttttcttccttgtaccttagctctctgagccttagtctgtcatctataaaatcagaataataatgggaccttcttcattggtttgaagatttaaataacatatttaagggatgtaaaaccacttctggtcattatttagagctcaataaatgttagttgtcattgtggttaccattactcttaccgtaatactcacagaaatgaagaataagaaccctgtcctaaaagagtgtttcatctgctcaaagggaaagataggaaccctggatctgctcaattttacattttcactaaagcttccatgcccctctgctgggcaacttaacattaaatgtacatactttagaatgagggaactgggtttaagatatggctctgcctcttaatagctttgtgaccttggatagttgttagacctctttaagttgcaattttcatatctataagattgtaataataatagctattccatggaggattttttggtaagtataaaaaatgtcaatgcattttaaatatttagaacagtgcctagcattaataagcactcattttcatgtactatacaggcatatgcatatattacatatatagtttacaaatgtaaaccaaactgacatgcacacacacatattccacccttcattcttttagctttaaataaaattacaaacttttttagcatgatgaaacctagttatatcactgaatctctctgtctctgtctctgtttctctctctctcactcaatcacactctcaaatatacaagcatatgctagcaaagcgttagttattatctggatctctacttacactacttcctaatttaaacaaatcttttaaaatttattattaaaaacatcaccttgcattcttagaacatttatattttcaggtcagttacatagacattttctctctccatctaaccaaattctaattctttattatttagtgcaaattttctgtgaaattctttaggctattcaaatgaaagtactttatttcctgcaaatctttggcatctattgtccaaaacatttattaattctgtactgctcctaaacatttctgtaaatataatgggctgttgtaccctgccctacatcttaaaagtccttgctactagaagtgttaatcttgccaaaaaaatgacttctttgaatttctaggtagttaaagttctattctgtacagtaattgaatatttctgacatgtaaccttatataaacactctaatagcaaataaaaatgtctctatgtccattgttgaaatctcagggctaaatgtctccatttgtattaggaacaagtagattaaagtccaaccatccttctgaagagcttttcccttgtgctgaatacagttaatgacagcctaagtcttttgtttgttttttttttttttgtagaattcatccattactcatcagctatatctgaaacaaactctaatcttggtacagaagcagagaacattattcttcctcaaagcctatgccacgtgttgctgctaaaacaggaatggacaaaaaaacagtttcataataaatagagaaatgagcttactaaaggcacggcattttcttaccttttttctttacacataatttgaaataactcttacaacaattagatgaaatatatcagtgaataatatcactttagggtaaatttaacatttatccaatattagctaattccatgactactgccatgactactacgactattattaataataataatcacaaatatttaatgagcacctgctacatgctggacactaggctaagcaacttacgtgtagtagaatttccctcctggaaggtatttattgtccagtgagcaacctttctattcttccctttccttgtacataaatgatggaggcctcattagtgagattccagaaagtacataatccctggtccatgtgtaaaaatgtagagaaaagctccctaccaacctgtattaaacttaaacgcaagtgaaatttaaacttttgttgtgttgagtcactgagaattggtagctgtttgttaccacagcataacctagcctaaattgcctaattcagtgttattgactgaaacaaacctttcttacacgtttttcaatcatattcattccatgttatgtgaatgagagcctgaggctagcatatacataatttatctctgtgttgaagaggaatagacttgaactctacagctggttggaagtataagtgagggtcctaaaacttgcatgagacaaagtcaattttgtagtcagtgataagaaataccatgtgcgcggccaggcgcggtggcttacgcctgtaatcccagcactttgggaggccaaggtgggcggatcacgaggtcaggagatcgagatcatcctggctaacacggtgaaaccccgtctctactaaaaatatttttaaaaaattagctgggcgtggtggtgggcgcctgtagtcccagctactcgggagactgaggcaggagaatggcatgaccccgggaggcggagcttgcagtgagccgagatcatgccactgcactccagcctgggcaacagagcgagactccatctcaaaaaaaaaaaaaaaaaaagaaagaaagaaataccacgtaagcgcatgcatgcacaccccccccaacatagtaggtgctcaatgtctacacaatgtatgaatatatacatagaaagagtatagatcactttttaaaaaacactgaatgttgctagaaaactcaaccacgaattgcctgtgacccagggcttgaccaaagcttccttaagacatcaaatattgcaaagagacaacttaatgcacttattcccctatggttgtcagtgtttttttttgtgattagctagatcatcagaaagtaacatttccaggtcatattattaccacaaatccgtgctaaagagccttcactaagttgaaatttaatgtaacttcaggttttattgagggtcaatgaagaaatgtctatttgaacatttctgtcttttacagacccctaggttaggacattgttaccatttgttaccatttgttattcatgttaccatttgttattcaaataattaccatacacaataagtttctctttaaatttgaagcctgaaaaaatgttctgtcttaagaaatgtctatgctgtctatcaacaagtaatgacaactctaaactataattacttattaatttctagttaagtttactcatctagagtaactaattaatcccaaaagtctttatacttttgaaaattctttagagcttgtttctattttgagtttcaaatttttatatttttcttgatttctgaaactgttgtaatttttcagaagcaggtggaaacaaactctatttatgaaataaaacttcctgtaatttattattattttttgcttgtcttttctttctggctgcatttctagagaacaaagaccttgcttattcatctctgcggtgttgtttcagagcaggcaaaatgagaataaatatatgttagcatggaatgacacaaagagctctgaaaataaagcccaaattcacattttcgctccatcagttactaaccatgtgacatttggcaagttatgttcatttattagcctttcttttcttgtcaacaaaatatcataagtttacttgtagcactgttgggaggatagagaatatatataaatgtgtcaataagagtattcaccaaatcagcaaatactcctgtcaccttttctccacctataaagtgacagtaaaggacacaatgatgctactatttgtctcttgagtaggtacccacaaagagagcctgagagaaatttactcatgtgctttactgaaggtctgttctcagaaggggagggaagaaaaaagcatggggaggtagggcctggaactaataagaaaattattaatctaagtctgagactagctttacctgacctcagagcgggttgtgaaattgtacagcagagttggttccatcttgaagcaaggagcctgagctttatatccttctctcagtcagttattagcgattggttgtcagagcatgcaggggtggtggtgcataaccactcatacatagtgactcctgcttggctgacaacattatccagaagaaggagcagctgtgagatgttagcagccaacactcacagtagcaggaaaatgggcaaccaggtaaagggatggccactggcatcagagtgggtggagactggaaatgttgttaaacactctacaatgttcaaggaagccccccacaacaaagaattatccagcccccaaagtcaatagtgctgcagatgagaaactgtggaacagatgaaagcatgaaaaaaatcaatgtttaataattattactaggagttattgatttgctattaataacattcagacattagtaatcaaaagggaaaatatggaatttcattgattttgctagggaacacacacacacacacacacaaacaacctcacagtttttatcctgtgactttagtattctttcatattatgcaacaacaagcataaattcagcatgagtcagactgaaatgactacttttgcaaatatcatccatacagtcttgtgcctttttccacatctgctttcagttctgccttatacatgcctttatagattttgacgccagcactttactatcctagaatctacagctacttgatttttttttttgtcttctctccccttttcttctgtgtttttccctggctttcagctcaactcgtgaacatcaggatgtctgcatccagctctgtttttttccttcagctgcactttgcctaatggggaatttggcacattcctatagttgtcaaatacatcttgttcactttcatggcctctcatttcatctctggctttgaagttctatagttcaggttgtttagcacacaagagaaataattaatctcctccctcttttctaaggattgataacaaccaagctaattatttactccagaacagaaataattgtttatgctaagttttaaattcaggcaaaattccttttgaataatatggaactatttgacatatgaataagaatatagtaattattgtaaggagtacatttaacagtagagactctcacatcacatctatacttttttttatctccccccttcatttctttccttcccatatccaggtttgtgtgtgtgtgcttcatccagatttttttttctatctctgtaattgcacaaaagggatctaatttcacaaaacagatcactgccatttgtgagagagataccacagcagtctcagtaaaccatgtcaaatcaattctcaaatcataaacaatatattgtaccattttggtacacatgtacttttttctaggtttgcaattagcaggtaactcctgaaggagctgatctcattctcactgatgcagattgcttaagcaaaattggagaagcaccctcttaaaatcaatcaaaatgaaacaaaactgccttctgtagcataatataatttgtcagttggtactgagaagagtaatttggatagcaactgtgaagggaaaggtaaaacaaagaagaataagatcagagattctgatttggaaggaaccacgaggctcatttcatcccaaacttgatagatgaagaaatggacccaaagagattaatgtctagactataacaggtcttataatttggggtccagcagcttttctatagcctcatgttagcttctcattttgaggctgaagtgtctgttctgattagttcttcttaagaatccagaatcattaaatcatcactattattaatactgtgctctagtctgtgtttccccacatctttcaattaaaatcattccttagctcttgatgtatgtagcaaccatcctagcagggtatgctaataccacccactcctctcctacctcccacccctgtcatctcagcactaaagtcaccgagaggtcatagggcttcatttcagtagcaatgaagtaaagaacatgagacctagaatgaaataaagaacatgagattctaggtcaggcgcggtggcttacgcctgtaatcccagcactttgggaggccgaggtgagcggaccacgaggtcaggagatcgagaccatcctggctaacacggtgaaaccccgtctctactaaaaatacaaaaaaattagccgggcgtgatggcgggcacctgtagtcccagctacttaggaggctgagacaggagaatggcatgaacccgggaggcggagcttgcagtgagccgagatggcaccattgcactccagaccgggcgacagagcgaggctccgcctcaaaaaaaaaaaaaaaaaaaatccctcacctatttcattgtttataaaatgaatatgagatagatagctataacataaagagattatttctaaggtttcttcaagtaccattataactgaatgcattgcacaatcaaaaagaaaatccaattcattgtaatattagtttacctagatatcaaggaaatgccttagtccactttattacaatgcaatacaaaagaaaaaaaggaagaacagcacccccacatgcattttttgaagtatatcctttaaattactaaggtctgattacttccatgtacctcctgcttaagattaaaagaaacaaaaagcaacactcaatagggttgaatttactgaagcatcttctttcttctctttcctttttctttcttttattcctcctcttcttgcttctcctcctttccctttcttcatttcttttgcttctctcccttccacttcatacttcttcccgtctttctttctctataaatattccagttaattttccaatttttttttaattttccctgttttctttctgtctacaaatgattgcagtaggttcagaaagctcattaactattttccttaatgctttaacaaagcaaacacattaacctactgtcattctgtaagtacttgattgcctacattctgtaagccctcatggctcttttggtcaatagctgaattattgctgtttcctatctttcctaattgaatgaacatggccccttgatttctgttgaagctgagttgcagttgcttggcgaattttcagtctttctgatctttcccctttgactgattagttttatttatcatccagttttttaaattgtggctttggcacacctgcctcaggctaagagaacgtgattaaacacattaaaagaaatccacagaacagagtggttacataattaatcagtcttgagcagtaccaaaaaaatgctgacccaaaagcatgacatttggggaaagggtaattttaagagtttaaaaacattctaatgaattgatttttgttcctgaatttcctttttcatatatacaggctagaatataacaatagttatttctttatagcaagtctccttttacaaaatacaacagtttcccactaggcgtggtgtataggaatactaggtgaacagttgatgaagaatctgctccctgatgagaatgccttgaggtaagtcagatacattttaatcttcttagagttatattttttattctatttctaatttaggacattcatacatcaagatgactaggggaactgaactgcaacagtatgtattttccatagaaatttttatatactcacctcttttttttttagtgttttttcttttattatactttaagttctaggatacatgtgcacaatgtgcaggtttgttacatatgtatacatgtgccaagttggtgtgctgcacccattaactcatcatttacattaggtatatctcctaatgctatccctcccccctccacccaccccatgacaggccccggtgtgtgatgttccccaccctgtgtccaagtattctcattgttcaattcccacctatgagtaagaacatgcagtgtttggttttctgtccttgtgttagtttgctcagaatgatagttgcaagcttcatccatgtccctacaaaggtcacgaactcatccttttttatggctgcatagtattccatggtgtatatgtgccacattttcttaatccagtctatcattgatggacatttgggttggttccaagtctttgctattgtgaatagtgccacaataaacatatgtgtgcatgtgtctttatagcagcatgatttatactcctttgggtatatacccagtaatgggatggctgggtcaaatggtatttctagttctagatccttgaggaatcaccacactgtcttccacaatggttgaactagtttacagtcccaccaccagtgtaaaagtgttcctatttctccacatcctctccagcacctgttgtttcctgactttttaatgatcgccattctaactggtgtgagatggtatctcactgtggttttgatttgcatttctctgatcgtcagtgatgatgaatattttttcatgtgtctgttggctgcataaatgtcttcttttgagaaatgtctgttcatatccttcgcccactttttgatggggctgtttgattttttcttgtaaatttgtttaagttctttgtagattctggatattagacctttgtcagatgggtagattgcaaaaattttctcccattctgtaggttgcctgctcactctgatggtagtttcttttgctgtgcagaagctctttagtttaattagatcccattcatctattttggcttttgttgccactgcttttgttgttttagtcatgaagtccttgcccgtgcctatgtcctgaatggtattgcctaggttttcttctagagtttttacggttttaggtctaacatttaagtctttaatccatcttgacttaatttttgtataaggtgtaaggaagggatccagtttcagctttctacatataactagccagttttcccagcaccatttattaaatagggaatcatttccccatttcttgtttttgtcagaattgtcaaagatcagatggttgtagatgtgtggtagtatttctgagggctctgttctgttccattggtctatatctctgttttggtaccagtaccatgctgtttggttactgtagccttgtagcatagtttgaagtcaggtagcatgatgcctccagctttgttcttttggcttaggattttcatggcaatgtgggctcttttttgattccatatgagctttaaagtattttttttccaattctgtgaaggaagtcattggtatcttgatgcagatggcattgaatctataaattatcttgggcagtatgaccattttcacaatattgattcttcctatccatgagcatggaatgttcttccatttgtttgtgtcctcttttatttcattgagcagtggtttgtagatctccttgaagaggtccttcacatcccttgtaagttggacttctaggtattttattctctttgaagcaattgtgaatgggagttcactcatgatttggctctctgtttgtctgttattggcgtataggaatgcttgtgatttttgcacattgaatttgtatcctgagacattgctgaagttgcctatcagcttaaggagattttgggttgagacgatggggttttctaactatacaatcatgtcatctgcaaacagggacaatttgacttcctcttttcctaattgaataccctttattttcttctcctgcctgattgccctggccagaacttccaacactatgttgaataggagtggtgagagaaggcatccctgtcttgcgccagttttcaaagggaatgcttccagttgttgcccattcagtatgatattggctgagggtttgtcataaatagctcttattattttgagatatggcccatcaatacctagtttattgagagtttttagcatgaagtgctgttgaattttgtcaaaggccttttctgcatctattgagacaatcatgtagtttttgccattggttctgtttgtgtgatggattacgtttattgatttgcatatgttgaaccagcgtttcatcccagggatgaagcctacttgatcatggtggataagctttttgatgtgccgctggattcagtttgccagtattttactgaggattttggcatcaatgttcatcagggatattggtctaaaattctctttttttgttgtgtctctgccaggctttggtatcaggatgatgctggcctcataaaatgagttagggaggatttcgtctttttccattgattggaatagtttcagaaggaatggaactggctcctctttgtgcctctgggagaatttggctgtgaatccttctggtcctggactttttttggttggtatgctattaattattgcctcaatttcagagactgttattggtctattcagggattcaacttcttcctggtttagtcttgggagggtgtatgtgtccagcaatttattcatttcttctagattgtctagtttatttgtgtagaggtgtttatagtattctctgatggtagtttgtacttctgtgggataagtggtgagatcccctttatcattttttattgcatctatttgattattctctcttttcttctttattagtctttctagcggtctatcaattttgttgatcttttcaaaaaaccagctcctggattcattgaatttttgaagggttttttgtgtctctgtttccttcagttctgctctgatcttagttattcttgccttctgctagattttgaatgtgtttgctcttgcttctctagttcttttaattgtgatgttagggtgtcaattttagatctttcctgctttctcttgtgggcatttagtgctataaatttccctctacacactgctttaaatgtgtcccagagattctggtatgttgtgtctttgttctcattggtttcaaagaacatctttatttctgccttcattttgttatatacccagtagtcatccaggagcaggttgctcagtatccatgtggttgagtggttttgagtgagtttcttaatcctgagtcctagtttgattgcactgtggtctgagagacagtttgctataatttctgttcttttacatttgctgaggagtgctttacttccaactatgttgtcaattttggaataagtgcgacgttgtgctgagaagaatgtatattctattgatttggggtggagagttctgtagatgtctattaggtctgcttggtgcagagctgagttcaagtcctggatatccttgttaactttctgtcccgttgatgtgtctaatgttgacagtggggtgttaaaatctcccattattattgtgtgggagtctaagtctctttgtaggtctctaaggacttgctttatgagtctgggtgcttctgtattgggtgcatatatatttaggacagttatctcttcttgttgaattgatccctttaccattatgtaatggccttctttgtgtctttttatctttgtttggtttcaagtctgttttatcagagactaggattgcaacccctgcctttttttgttttccatttgcttggcagatcttcctccatccctttattttgagcctatgtgtgtctctgcacgtgagatgggtctcctgaatacagcatgctgatgagtcttgactctttatccaatttgccagtctgtgtcttttaattggagcatttagcccatttgcatttaaggttaatattgttatgtgtgaatttgatcctgtcattatgatgttagctggttattttgcttgttagttgatgcagtttctttctagcctcgatggtctttacaatttagcatgtttttgcagtggctggtaccggttgttcctttccatgtttagtgcttccttcaggagctcttgtaaggcaggcctggtggtgacaaaatatctcagcatttgcttgtctgtaaaggattttatacctccttcacttatgaagcttagtttggctggatatcaaattctgggttgaatattcttttctttaagaatgttgaatattggccctctcttctggcttgtagagtttctgccgagagatctgctgttagtctgatgggcttccctctgtgggtaacccgacctttctctctggttgcccttaattttttccttcatttcaactttggtgaatctgacaattatgtgtcttggaactgttcttcttgaggagtatctttgtggtgttctctgtatttcctgaatttgaatgttggcctgccttgctaggttggggaagttcacctggataataccctgaagagtgttttccagcttggttctattctccccgtcactttcaggtacaccaatcagatgtagatttggtcttttcacatagtcccatatttcttggaggctttatttgtttctttttactcttttttctctaaacttctcttctcacttcatttcattcatttgatcttcaatcactgataccctttcttccacttgattgaaccagctgctgaagcttgtgcatgtgccatgtagttctcgtgccatggttttcagctccatcaggtcatttaaggtcttctctatgctgtttattctagttagccattcgtcaaattttttttcaaggtttttagcttctttgcaatgggttcaaacatcctcctttagcttggagaagtttgttattaccgatcatctgaagccttcttctctcaactcgtcaaagtcattccccgtccagctttgttccattgctggtgaggcgctgcgttcctttgtaggagaagagatgctctgatttttagaattttcagcttttctgctgtggtttctccccatctttgtggttttatctacctttggtctttgatgatggtgacgtacagatggggttttggtgtggatgtcctttctgtttgttagttttccttctaccagtcaggatgctaagctgcaggtgtgttggagtttgctggaggtccactccagacccagtttgcctggatatcaccagaggaggctgcagaacagcaaatattgcagaacggcaagtgctgctgcctgatccctcctctggaagctttgtctcagaggggcaaccaggcgtatgaggtgtcagtcagcccctactgggaggtgtctcccagttaggctactcagggttcagagacccacttgaggaggcagtctgtccgttctcagatctcaaactccatgctgggaaaaccattgctctcttgaaagctatcagacagggacgtttaagtctgcagaagtttctgctgccttttgttcagctatgccctgcccccagaggtgaagtctacagaggcaggcaggcttccttgagctgcggtgggctccacccagtttgagcttcctggctgctttgtttacctactcaagcctcagcaatggcagacgcccctcccacagccttgctgccaccttgcagttcaatctcagactgctgtgccagcagtgagtgaggctctgtgggagtgggaccctccgagccaggtgtgggatataatctcctggtgcgccatttgctaagaccattggaaaagcacagtattagggtgggagtgtcccaattttccagttaccatctgtcacatcttcccttggctaggaaagggaattccccgaccccttgtgcttcctgggtgaggcaatgcccctccctgcttcagctaacactccatgggctgtacccactgtccaacaagccccagtgagatgaacccagtacctcagttggaaatgcagaaatcacccatcttctgtatcgctcatgctgggagctgtggactggagctgtttctatttggccatcttggaacctcctcccttttttagtgttttgagacaaggtctggctctatcacccagggtggaatgcagtggcatgatctcagctcactgcaacctccacctcctgggttcaggtcatcctctcacctcagcttcccgagtagctgggactacaggcatacaccaccacacctggctaatatttgtagaaatgggatttgccatgttgcccatggttggtcttgaactcataagctcaagcaatccacctgcctcagcctccccaagtgctgggattacagccctgagccaccgtacctggcaactcccctctttatttgataaaggatagcaggtggaaggccaaactggcttcatttccatgtgaactgaagctgcatcaggttccaagatccagacaatgtcctggagcttggctctggtaaaaaatgtctatcatatgctatctctgttcatgatctcaaaaacttgctgtgaacttagcttattttctcttctaagcagtgttgagaaaagtgattgagatgtggacatccttattttgttctattgctaaaatgaaacttgaatagagtgctcatatcttaattttaacagaaaactactctttccattttaccaaacatgggatttatcagcaagaaattcttcaacctttcattcatttctataaatgtgattctatctttttttaagttagactaaatcaattttttatttatttttaagattcagggggtacggctgggtgcagcggctcacacctgtaatcccagcactttgggaggccgaggtgggtggatcacaaggtcaggaggtcgagaccacggtgaaaccccgtctctactaaaaaatacaaaaaattagccaggcgccgtggggggcacctgtagtcccacctactcggtaggctgaggcaggagaatggcatgaacccaggaggcggagcttgcagtgagccgagatcacgccactgcactccagcctgggtgacagagcgagactccgtctcaacaacaaaaaaaaagattcagggggtacatgtgcagttttgttacaagggtatatagcatgatgctgaggtctgggcttctattaatttcatctctcaaatagtgaacatagtacccaacaggaattttttcagctcttacccctctccctcttaccttttagagactccagtatctactgttcccatctttatgtccctgtgtaattaatgttcacctcccacttgtaagtgaggacatgtggtatttgattttctgttttagcattaatttgcttaggataatggtctccagctgcattcatgtggatgtgaaggacataattaaattcttttatatgactgcatagtatgccatggtgtatatgtaccacattttctttatttaataaatgtgattatatcttaattcaacttcatcctggctgagaagaagagctcttttttctttttttccaaacctaatctttctacccgttctaacatcacattctctcatttgcttgactttattccatcagttgtagtcttaatttttcacaggttcattctcttctggtcgcttttttttctttacctaaacatttctcaattactgccactttaggcagtatataaataaaaatgttaacaaacaaaaatgcttttggtgactctgtctgctctgaccctcaagtatctctttctttctttctctctcttttattcctttcaacttcaaacttttggaaaattgagtctgtgccaccatattttatctgtcattgcatactcagtactcaactgatcatgatacaatttttgccttcaccataatactgatactgcttttaaaaagatataaaaacaccttctaaatgcaaaacccaatgtgtacttttaaggctaagccaacctgcataattttgccggttgcatcctttatagtcgttggccactgcaccataaatcatgtaaaaatattcaaggactttatagtctagaggggaatatgtgcaaaaatatgactatgatatgtgtactgctgtgattttggtaatcatagagggaatatgatagaaactgttagctgccacccaatatccattctctttttcatagaaacagaactctgattacactggggaaagcaatgtgcaggattaacacacaaacaaacatacaaaatttatattttgtagcataccttgcagtgaaatataacagtatgactaagctctagcgaatagtttgtaaaaaaaaaaaattagtatttgaaagggaccttctggaaggtccctttcaaagtgtaaggaatgtttgcttcagtttctctttattcttactgcctggaatatacaagtcattgttagagccgtataagccatatttttgaccttgataataacgagagccggaagccaagaaaagtgaagctgaaagacaaaagtgcctgattccctggtgactttgtgaagctgtcgtaacagttctagaccgcccattcgcagactcactttatggagatggtaaactcccagtttgttttaactgccacagtcaagtctcagaatctataaaggtacattggaatcactttgtgaaaaaagttgtttctggatcactgtctcagctatttttaaaaaaatggcatccaacatattttcactggatggtcccatatacttctctttcatacctctttcctaagttccagaaccaaagacccaacttctcctaaacctttctccttggatgccccttggtcacttaaattcaacaagcaaaacctgaatgagtttccatactcaccgtaacatggtcttccttctatatacactgtttagttaacgatgccattgttgactaagtaaactatttaacctcaaaacctttaggaaattcttaattctttcttctttttcacccttaacacccaatggataattgcttctaaacatattttcctcagaattgttccttgtatagatacactcctttccattctcatcaatattgccctaagtaagttctcactgtttctctcttagactaattttttttttattatactttaagttctgggttacatgtgcagaacatgcagttttgttacatagatatacacgtgccctggtggtttgctgcacccatcaacccatcacctacattaggtattcctcctaatgtgatccctcccctagccccccaccccccgacaggccccagtgagtgatgttcccctccctgtgtccatgtgttctcattgttcaactcccacttacgagtgagaacatgtggtgttcggttttctgttcttgtgttagtttgctgagaatgatggtttccagcttcatccatgtcccagcaaaggacattaactcatccttttatgtggctgcatagtattccatggtgtatatgtgccacattttcttaatccagtctatcattgatggacatttgggttggttccaagtctttgctattgtgactagtgctgcaataaacatcttagactaatttttaaaagtcattcctaaataggtctcaatcctttagtcccttatctttctaatctatcactgctgtgtctaaaaaatgttaactttgaaatacatagatttactattgccatctcaaactaagaaattgttcattactctcaattgcctacagggtaaaattaaattataaatgatcctttcaaaacattcccagtttcctttacaagcttttgctctacttgcccacccacccttattccacaaaacacacaccaaaagtaccaaggaaagttgatttcagtcaaatcagactgcccaccatgtccataacattccatgtcttccctatctctgttttatttcagttgtcccctctatctcaaatcctttccctctcctcctcctacaagtacacatttgttttctacttattaaccaaggcccaaaacaggtttgcgccacttatgaagctttctcttgcctgctctgcacatcaaataaattatttcctcacttgctatacatgtacatttttacatgccaatgttgtatggtttattacagtgttctggaatcttttttgtatattcaggtacattttatgtttcttaattttttatgcatttcaatatcttaaggaaattatcatataatcatctttacatccctcagatgtactactatgccttgcacagtgaggggctcaattcatagtaatggatttgaatgaactacatatattttgtctctatacaggtaaaacatgcaacttcaagatgagtgcttgcaatatagatgtaagaatgattgtggaataattttaattaaatggtgtattataagaatatctctcaggttattttattttattaattcatcttctttatcctaaaccttcacacctcagacccagaacagaacatactgcccattcactttagaaatgcattccgttcacacctacttatttttaacccactatatttggtaaggcaatgtttcatgaacctaatcttgggatgccagctttatttagtaaactttgaatagtctgtagttttgaataccaaatttctgtaatttttagtgtctctctgctttggaatcatgcttgccatttttcaagagatcttatagaaaaatgatagattagatcttctgaatttaaagaataggaacaagacaagaactcagggtcactgagagattaaagtaagtgtgctttggcacacgtaaatgtaatgtatttagaaagctttctaggatctacctgcaaacagatggcagtaagatatgcaaaagggggcatgctctcctttttcagatttattttttttctaatggggaatagtgagtgagatgatgacagatagttttggatttgcaatgctcttcctcattttatataatgactcagcttttaaattgtaaatcatggattctaaatagctcctgcctaatttatctgtaatatatgtaaagttcatgaatttgaatcattataccaaacaggaatgaatttctatatatagaaaggaaattgtattttggaaggataattaacaccaatatattttaacagctatgcagaggctgaacttctaccacagattttttgaaagcttagcgtcatacaacatgaaactgtatatttgaaaaataaaatttatatgaaatttagaccttacaaagcacgattagtgtgtgaaaatgacaaaagtaaatggaagagtttatcctccaaataaacatacttttttacatatttaaggcagtataatgttaaatgagaaaatgaagactggatgtttaataagccaaaaggaatatacagtagttaaaaatatgtatacatattaatacatatgcatctatacacacatacatgctgtgtgtatctatataaatgtatatatacatacatgtatgcatatgtgtctatacacacgcatgttcctatttgcatggcttgtgactaaacaaaatgcatttttctctgaaaagtgacagggcactagtaatgcactcactgtgtttatgtgggatttttgataaaatttgaatatcaaagacactatttttccccctctaacaaccactggaataaaaagctagaatgcaataccatcttataatttccaaattattcactttcgacttgtgtttttcactttcatcacaaattcagtgttgtctctctgaacagaggaatcatagacctttgaaggtaaactcaactctgacatttactagtatgacattgggaaagctatataagaaaacagaacaaataaataagtgatccatctggcatgttattgtgaagattaacataaaatataggcaagacatagacagtcactatttgtttcctcccctctactttttttttttttttttttttttttttttgagatggagtcttgcattgtcgcccaggctggagtgcagtggcacgatctcggctaactgaaacttccacctcctgggttcaagtaattcttgtgcctcagactactgagtagctgagattacaggcatgcgccaccacacccagctaatttttgtatttttagtagagacagggtttcaccatgttggccaggttggtcttgaactcctgacctcaagtgatctggacaccaaagcgctgggattataggtctgaaacaccgcaactggctcctgcccactacttttgatggtgatcctttgtttgtgtttttgtaattacatcctctttcagaacattaactcattgagggactgtcgaatgccaggatagagaggccctatatgttacagacatataaatatactagtgtaattaaaaaaaattttctcagaaatataaattcccagaatatttatattgtttcatttaaacttaaatttataatcttagtccatgtccttctcaaagtcactgataactgaatccaatatagatatcaaatattattttattaccatttcttctccagagaaatgatctactgctattaaaagatgagtagaaaaggtatacattagttctaccatggtaatttatagcagcttaaaactcagggccaccaaagaatttatgaaaattcctctaaatctattaagttttatcatactccatttctgaaaatatatatggaaatgaaaaatctcaagacatgaacatctatgttataaaaagaaatagggggaaaatgaatatcaattaatagcagcgaagcaatcattttattaatttgcaattccacatgcatttattttagaaaaattataggattcattccggagttccatctgtacacattctgaagtcatgctctaaattaacatgcatttcttatccaattggcttataaaacttgatttactctttaatctctgaagtaaataaaaacaacatttttaacctttctttaagaaatctgctagtttaagatttcttgctagtttaaatacatgtacttttaataaaaactccaatttagtttttctaaactaattttacctaaaagatttggtcatgtaaacaagggtgtagttactctgtttcaagcatcttccacctgtgatcatgtaagtgctaggcagtactcacagctgacatgatgagctctcctcccaggttctggatctcagctttaacttgactgcagattttcagttggtgggagtagaacttaatctgttccaggtaggccaacaagtcctgtttacaagatggatctgggcactaaatatgaatcaaagataaaaatagatacagcagaataaataatagttagatcaaggtgagtaaatacagtattcacatggcaggtaccttataaagcagcaattttattttcatacaggaccaagtagcttctgatatgcttctaccatttacaatagttcattcattttgcaaccttagttacttcagcttagccaaaaggaacgttaaaataattatttttttgagatggagtctcgctctgttgcccaggctggagtgcagtggcaagatcttggctcactgcaacctctgcctcccgggttcaagtgattctcctgtctcagcctcccgggtagctgtgactacaggcatgcgccaccacacctggctaattttttgtatttttagtagagacagggtttcaccgtgttatctaggatggtcttgatctcctgacctcatgatctgcctgccttggcatcccacagtgctgggattacaggcgtgagccaccacacctggccaagaaacgttaaaataatttttagacataaaaaggtatataaaatagctgcctttaatttatgacaaaggttagaagccttcagattatatttttggtaaatctatagaaatatttaaaatgtaattatttctttcacctagaattactattagaaggctcctagaattactattagaatgctgcttgagactcatggtctctacactgtctgtcctgtgctactcaaatgggcataaacaacatggagcaacataatatgttctactactttcagcattcaatgtacttagctgttacagacaaaggaaattatttctaccttagataacagctgtgaatacaactgaagccaagaaacagacaggacacatgttttagaatattaaatttccttatgaaaaccagcctcctacatcattttatcttttcgaaggaacttcctggaggacagctttgagctttatcataccatggtaaatagctttggttaagatttaatctttgtgttctttctcctatgcaattataataaatttataaaaattccttctaatttaattccacttttagtaaatttttataagaacaaggaaatgtggacagtgatttatatgcaaagatcttcattgtagcattatgtataataacaaaatttggaaataacctaaatgtcccaaaataatggaaagactaaataagaatgaatatcaatataatgtagcattactcagtatcaagaaaatagagtttcaaaggatgtggaaaaatgtttttggaagttaaaaaaatcaatatgtaaatattgcaatcaaattctattaaaaattgtgtgtatttaaaacatgctgaatgccagacgcagtggctcatgcctataatcccagcaatttgggaagctgaaacaggaaaatcctttgagcctaggaatttgagaccagcctggggaacatagggagacactatctctacaaaaaataaaaataaattagccaggtgtggtcccagctattcaggaggctgaggtgggaggattgcctgagcccgagaagttaatgctgcagtgagccatgattgcaacactgcactccagcctggtcaacagagtgggaccttgtgtcaaaaaataaataaataaaaataaaaaataaaataataaaacctgctgagacagcctgagctgtccatccttcctaggcatagatcatggtgcatcaggactctctttgctccatacccaggcagatctccaggcactcagagtaccagcttgcctaaatcatcaggctgagcttccctaccctttctgtgcatagattgtggtgtagcaggccctctccactccacgcttgggcagatttccaggtattcaaagtacatgtttgctcagattgacagcctgagccaccccacactttctctgcagggatccaggtatgtagaggagcctctctgcttcatgcctaggcagatcacccagcatctggagtacccagtcccctggattaggagtttaggccaccccaaatctgtgtgtagagaatttgaggacaagaaagcttcccagctccatatctaggcacacctcttggtgtttggtacccactcactggattatgcttcagcaccggtgctcatgcctgcccttagggaattataggcaaacctgccagtctggacctgcccatcttgctcccaacacctctagggctgaggagggagctcagagcattttgcactacaagaataagcccattgcctgaggcaagaaagagcttctgctagtaaacaaggatgaagtatacacccatcggtattggtcatacacaccatctacaggcttgtaggtggaactgaaccgcccaatatgaaacctgctgacagaaaggtgtaggagtacacaagttaagccaaaagaccttacccagcattctctaaagtcacactccctagggaaaaatagatgggaaagggaaagggaaagaaaaaaaaatcaatagtattatagggaaagaaaagaaaaattatatctgcacaaatataattacaaaaatttgaagtatcaatgcttcaagatgagaaagaaccagtgtaagaattctagcaccatgaaaattcaaaatgtagtgataccatcaacataccatactagttctccagctatggtccccagcaaagtggaaacttggaaatgacagataaagaatttgaagtgtggattgcaaggaagctcaataagatccaagatgaggttgaaaattaacacaaagaaactttttaaagcaatccagagaatgaaggaagagataaacatctttaaaatatcaatcagagattctggaattaaaaaactaatttaatttcaaaacacaactggaagcttcaccaataaactggactaagtagaggaaagaatttcagatcttgaagaccagtcttttgaattgacccagtcggaaaaaaataaagaaaaagtaatttttataaaataaacaaagtctttgagagatatgggattatgtaaagtggccaaacctaaaaattagtgacattcctgagactgagaaaaagataacaacctagaaaaaatacttgaagtgataaatcaagaaaatgtttcaaattttgctagagaggtagacatctagatataagaaatccagagaacacttgagagatactatacaaaaaggaacgtcaccaaggcatataatcaccagactatccaaggtcaatactaaagaaaaaatctcaaaggcagctagagaaaaaggtcagaagacacacaaaggaaatcccaaaaggttaaaagcagacttctctacataaaccttatttataagccgagacagattggaggcctattttcagaattcttgaagcaaagaaatttcaacaaaaagttcatatcccaccaggctaagctttatcactgaaagagaaataaaaatattttccagacaaacaagcactaaaaaaattaattaccattaggccagttgtgtcagagacctttaagagaattctaaacatggggaaaatatagagctgatacctgctaccacaaaaacacaagtacagagcccacagatctatagcgcaatcaaaccatagaaaatataaagcaaccagcttacaacttcatgataggatcaaaatcttgcatattaatattatccttgaatgtgaatagcctaaaccccccacttaaaaggcacagagtggcaagttggatagaataacaacatccattcatctgctgttttcaagatacccatctcacacataatggcatcaataagctcaaagtaaagggttgaagaaatatctatcttgcagattaaactacaacaaaaaagaggagcggctattatattagataaaatatatgtactttaaaatatatttaaaatataatatatataacatattaggtaaaatatatgtattttaaaatatattaaaatataatatataatagataaaaaagactttaaaccaacaacagtaataaaggacaaagaagggtattacatgatgataaagggttgaattcaacaaaaagtcttaactatcctaaatatgtatgtacccaacactgaagcatctgaattcataaaacaagtacttctagatctacaaaaaggcttagatagccacacgataatgttgaggaacttcaacaactcactaaaagtgttagacatgtgaaatgttagtcaattaaacctctctttttttttttttaataaattagctagtctcagtatcttcatagcaatgtgaaaatggactaataaatttacttttgggtaaacaatgaaattaaggcagtaaccaaaaaattctttgaaataaataaaaataatagacacaacatataaaaatctctaggatgtagcaaaagtgctgttaagaggaaagtttatagcagtaaactcctacctcaaaaagttagaaagatctcaaattaatgatttcacatcatgcctagaggagcaagaaaaacaagaataaaccaacccaaaagttagcagaggaaaagaaaaaattaaaattagatggaactgaaagaatttgagacctaaaaattcataggaagaatcaatgaagaccaaagttgtgttttttttttttttgaaaaaataaacaggatcggtagactgctagctagattaacaaagaaaaaaagagagaggattcaaataagcacagtcagaagttataaaagtgacattgcaaccaatatcatagaaatacaaaagagcctcagaaactattgggaacacatctgtgcatacaaactagaaaatctagaggaaaagataaatttctgaaacacacaatcctccaagaatgaattagaaagaaactgaaaccctgaacagaccaaaatcgagttcctaaattgaatcagtaataaaacacccaccaccaacaacaacaaaaagagccccagccaaattctaccaaacatacatagaagagctgataccaatcctactgaaactattccaaaaaatggagaaggagagactcctctttagctcattcaacaaaaccagcatcatcctgataggaaaacctggtaaagatacaatgaaaaaaatctctgataccaatatctctgataaacatagatgcaaaaatcctcaacaaaatattggcaaactgaatttagtggcacatcaaaaagttaattcactatgatcaagtagacttaattcttggaatgtaaggttggtttaatatagacaaatcaataaatatgactcaccatataaacagaattaataacaaaaatcatatgattatttcaacagatgtgggaaaagcttttgataaaatacaacatcccttcatgataaaaaccttcaagaaactatgcatcaaaggaacatatctgaaaataataagagccatctaagagaaaccacagccaacattatacttgaatggacaaaagctgaaaccaatctctacttgaatgggctaaagctgaaaccaatctccttgaaaactgttacaaggatgcccactctcacctctcttattcaacatagtactgaaagtcccagccacagcaatcaggcaaaataaataagtaaaaggtatccatctagacaaataaaaagtcaacctatatttctttgctgttgatatgattttatacccagaaaacataaaatactttactaaaaggctcctggaactgagacacgacttcagtaattttttaggatacaaaatcattgtataaaaatcaatagcatttctatacaccaataacattcaagttgagaaccaaatcaagaactcaactccatttacaatagctgcaaataaataaataaataaaacacctaggcatgcatctaaccaaggaagtgaaagatctctacaaggagaactatacaacactgctgaaagaaatcatagatgacacaaacaaatggaaaaatcatttcaatttcatcaactggaagaatgaatatcgttaaaatggccatgctgctcaaagcaatctacagattcaatgctattcctatcaagcaaccaacgtcatttttcacagaactagaaaaagaactattctaaaattcatatgaaaccaagaaatatcttgaatagacaagcaatcctaagggggaaaaaaaaaaaaaaaaaagaagccagaggcatcatattacttgacttcaaactacactataaggctacagtaacacacacagcatgatactggcacaaaaacagatacacaggctgatgggacagaatagagaacacagaaataaagctgcacaactaaaaccatctgatctttgacaaagttgacaaaaataagcagtgactccctattcagtatctggtgctgtgacagctggctagccaaaggcagaagaattaaactggacccctatttttcatcatctagaaaaattaactcaacatgaattaaagatttaaatataagacctccacaataagaatccttgaagaaaaacctaggcaacatcattctggacatcagtcttgggaaagacattataactaaattctcaaaagcaattgcaacagaaacaaaaattgacaagtggaatctctaattaaagagcttctgcatagcaacaaactatcaacagagtacatagacaacccacacaatggaagaaaatatttgcaaactatgaatctaacatagttttactatccaggatctataaggaacttaaacaactgagcaagcaaaaagcaatcccattaaaaatgggtaaatggtacgagttaggtcattcttgaattgctacaaaaaaatacttcagactgggtaatttataaagaaaagaagtttaattggctcgtggttctgcaggatatacaagcattgcgttggcatccacttggctttggggtgggggctcagggaatatttactcacagtaggagatgaagtgggaacaggtgcacgacgtggggagaacaggagcaagagggaagtgggaggtgccacacacttttaaatgaccagatcttctgataatgcactatcctgaggacagctcatcatgaggaatctgcccctattacccaaacacctcccaccaggccccacctccaacattggggattgcatttcaacatgagatttgggaaggacaaatgccaaaaccacatcaaaacatgaatggacacttctcaaaagaagacatacaagtggccaaccaatgtgaaaaaatgctcaacatcatgaataatcatagaaatgcaaatcaaaccaaaataagatactatctcacaccagtcagaatggctattattaaaaagtcaaatacaacagatgctggtgaggctgtggagaaaagggaacactttataaactattggtggggatgtaaattagttcagccactgtagaaggcagtttggagatttctcaaagaacttaaaacataactaacatttgactcactcatcccgttactatgtacatattcaaaagaaaataaattgttctacccaaaaagacacttgcattcatatgttcattgcagcactattcacaaagcaaggacacggaatcaacctaggtatccaccaatggtggattgaataaataaaatggggtacatatacaccatggaataacagccataaaaaggaatgaatgaaattatgtctcttgcagcaatgtggatgcagctggaggccattatcccaagtgaattaatgcaggaacaaaaactcaaataccatatgttcttacatacaagtaggaggtaaagaatgggtaatgatggacataaagatggccacaatagaaactgaggattactagacaggggagggaggaagggagtaaaggcttgagaaactaattattgggtactatgctcactacctgggtgattgcatcaattgtacttcaaacctcagtatcatgcaatatacccactgaatctaaataaaagttgaaattattttttagatgcattaaagataaatacattctggactctgggttaaaaaaaattaaaagatgctgggaaagaaatatatgacaatcatcaataaatgtgatataatcaatacttttattttattcaaattttgtatatcttaaatatatatttcttctataactataaaatgttattttttaaagcttttattctaatgacctaaactgcaaattaaaaagtaggatgaacaaccagaaaacctttcatgcatttctgcttttattcagtaattaataacttaagctggagtgtttttggaaaatttgtgaggtacttatcgtcttatattttttaaataggctgtgtagctccagagtgtgtgcacaagatgagaacacattaccctgagtcaaagtcgataataatcaacaaaggtagcaaagaattcaactcttctgcagaaatactatcaatctgcaagataggcatggacatatgcatgaatagatacaggatagccagacagagacacaatcagacaagaatatagaaattaagggtgtttctcaagttttcagtaagcaaatgagggttatccctcaaatctcctcaaaaggattatattgtagctaattaagaagaagattggaaaggagaaagatatggagaaagaaaagaaaaagaaagagggaaaggaagaagaggagaaggcagagacagaggaggaagaacaatagttaattttcatttagctcttactatgtgccacatgctatggaaactaatttaggcatatcttctcactcaatcattaaaactgtaagacgcaaatattttccccaatttacagatgtgaaattacctaaaacgatgaaaaacaagtcatctctttgttttctcttgacaggcagctgatctttattaggtacttcgtctgtgccaggtactatgccaaggcctttacatgcataactttagtactcaaagcaccattttaattagatctattattttcattttgtagatttgcaaagtaagtttcagagagagtaaatgatttgaatttagttttctctgtttcattcacatgcatacacaataatctcttctatagggcattctttcaaatcattttttgttattattgctttcactgagtaactttcttatctattcttcattcttaagtatggacacaatgataatacctgacatgtaaagtgttttatctgtcatctataattctagatgttttgtctctactaattgttttaataatcacacaacacccacagtttcatgaggtaagtggaatcattatcctcatttagtgaaggagaatattgacaaacagagaggttaactcacttgccaataaatggtattagtggtagagctcgtgttcaaacataatctggctacacctccttacctccatgttctaggaacagtatcagtcttcttgccaattttatcttttttgtaaatattaaattgtcattctgatttgtaagttggtttcttattgataatcttatttgtcaattataaactcgattaatgtggatttgttccttgaagaccagcaccactatacaactctgataaaatcaaactgtcaaactagtaatcagattcttgaccaataaccaattgcaatcactcaagtttaagcaaaacatgctgtctctatcaagagactcttccaaggccacagtagaaaagcctataattccattaaggaaagaatgagtcaaatgagtagaaagtgtgaaaatgatcttttgaaattcaaagttgcttgacctaaatttacctttcattttcagaactgatgggaatatcttggttataacagaagcagtcagttttataaccaaagtaaaacaaaatactatgtggtaaattcttatacttataaaagttattaaagccttctttcccattgacatgcagaaagcctttctgagtcagttttgctcacttagaagcagaatcaggagaatgcctcattcctactttaagaatattctactatttttcaaatctcctttgggccacttttatgtattcaggtcttttcccattttttaatcaggttacttggattttttttctattgagttctgcatgtttcttatacactctagatattaattccttatcagatctatggtttgcaaatattttctttcaaaccataggttgtcttttaattttgttgattattacattgtatatcttaagtccttaaatatgtacaatttttacaaaaaaaattaaatttaaaaacatcgaacaatgcttttcccaccttttaaatttttacgtgaaagtgacagaaaaacttcggtctctaggttggtagaacattcttgccctttactgttgtttctcaagtaacatttgctttaaaataacttttaaaagaatactattagggacttttccagaacatctacttagttccttaatgcatgatttttttttaaatctaagttttataatcacagggactcacaacatgtaagcagatggcatttcagcctatgtggttttctcactttaagccagttttcacgtttctaccaagacgcttggagccaatatggaatacatcatttagtaatgaggaaaaatgtaaaaaaaattcattacgttttagtttaaatttcaggggtgaattagcaaaacgaacacttttcaagacttttattccataatcttagtatttttttgctcatattggagcctaaactttaagaaatttaaaatgacttttgcagccaggtgcggtggctcacgcctataatcccagcattttgggaggctgaggcaggcagatgacctgaggtcaggagttcgagaccagcctggtcaacatggtgaaacctcatctctactcaaaatatgaaatattagccgggcatggtgactcgtacctatagtcccagctacttgggtggctgagacacgagaatcgcttgaacctgggaggcggaggtgcagtgagctgacatcgtgccactacactccagcctgggtgacagagagactccgtctcaaaaattaaaaaaataataaataaataaataaataaataaaacgaattttgcaattacagacaatagcctacattttgctaagctggaaaagtttgttaatgaaaagtactaggtgtcactgtgaatttcaaaaataggaatttaaagcgatcagtggtagcaaaagcacttggtgttcatgacttttcccatcccacagggctcatttcttcacctgtaatgccttgtttcatcttgctcaggatcacagatcatcaatgatctcatcttttcctctacttttaatgcctttttttttctgattcctgactctatcaagtccctcaaagcaaaaccctgacttctataatcccatgtctccttttttgtttatgaatatgcctactaaaatgtttcaatgcagattcctcctttccttatcattctaagaactgttttcaactcctccagtccgcagaattttatcttactgagatcactaatggacttataattgccgcattcattatatatgttgcagttcctcccttatatcacctctctggagcttttagatctttattgattttcataaatattaattctcatgaatgtttcctcttagattttctcctagttttacaccagccttcccagactgtattgtaagcatttttttttttccttgcacgtgttgttgttctcagcttttgttcctgagcaatttttttttttttaactttcattctcttcttggacaacagtagacagtgctctggcttcatctgtcacttacacaacacaaactacaaaattctaacatccagctctgtcatcaggcgatccatgtaactactgtgttagtccatgccatttcagcatctcatcaacatttcacacttaacacatttatctctcagctatttcactatcttgcctactcacctattcaactattttttctctttgtattaactatctcaatgaagaatgccttgttcctcttttccatctcttaaatctggtcagccattagtttgtgcttattctacacctagaaacctcaatatattttaagtatttttttctttgctatgcctatgacagctgctgtttagcaaattcaggtttctgaaacacagaacagagaaggtacctatagaagtatgattaaaaatacactggaactctgttataatgtcagtggtagaggataacattgtctcatatggtatgttcaagactggacatgttgatttatgagagttataattgggaaagtatggtgcatggcatatctcaatgaataaaggttgtttttaccagaagttatatatgctgttaaaatcctgtcatattttgtccatatttaggctgaaattgtcttgagtttaagaattgtttcaaattcctttttattttcaacttggtttgcacatacagctattgagaaagtgacatgtactttgaacacaatacaaattaaagacaagatgttttccttattcaacaaagctcctttactttagtagatgtaaagttatgactcaagctacttttcagctttatgttacttccatgagagattctcagaagaaatgagtgtcctatgtaatagaccataactcaaaagtgtcaccctctccctcatgcctgaaatttgtcattcaaagaattacttcgactgaaacaaactcatacaagtgcattatcctgtacataaaataaggatgtggaaaagatggtggaaaggtaactcagacaaattctggttatttggaatttttgattaaagatagccagccaactacaagaagaaactttgctcatccttcctcttctccacttatacaagatagctccttccacctagaccctaaaacactttattttttggttacatagttttgtaactatacatgaagtgaacctgaatagataatcaccctaggagcatttaaaacactgtttcagtgaaaaaatgtcagacattacataaaggggaaaagagtaaagcagcatctcttagaacaggagattcactattacttgaaagacgcaaatagatcaaatatttcagtatacatttagtcctatttaaatcttgagaactttctgtgcatttatttttataaagtaggagttcattaatctggagaactaatctaggcatcaacatttctgccagagaagaaaataaataacaaagatctgagcagaataaaatgaaattgaaaccaaccaacacacaaaatacaaaaaataaatgaaatataaagctggttctttgaaaaaataaataaaatcgatagatcattagtgagattaacgaagaaaagaagacagaaggtccagataaattaaattagaacgaaatgggagatattactactgataccacagaaatacaaaagattattcaaggctactatgaacacctttacatacataaactagaaaacctagaggagatgaataaattcctggaaatatataaccctcttagattaaaccaggaagacatagaaactctgaacaggtcaataatatgcagcgagattgaaacggtaatttaaaaattgccaacaacaacaacaaaaaagtccaggaccagacaaattcacagctgaattctatcagatattcaaagaggaattgataccaatccgattgacattattccacaggatagagaaagaggaaatcctccttaaatcattttatgaagccagtataactctagtaacaaaaccagggaaggacataacaaaaaaaaaaaagaaaagaaaactatagacaaatatccctaatgaaaatagatgcaaaaatccccaacaaaattctagctaactaaattcaacagcatatgtaaaaaaaaataaactgccataatcacgtggggttcataccagggatgaagggattattcaacatctgcaagtcaataaatgtgacacaccacataaaaaaattttaaaaatattacatgatcatctcaatagacacagaaaaagcatttgacaaaatccagcatccctttatgattaaagccctcagcaaaatcagcatagaaatgacataccttaaggtaataaaagccatctatgacaaacccacagccaatattatactgaacggggaaaagttgaaagcatttcacctgataactgggacaagacaaggatgaccactttcaccgtttgtattcaacaggactctggaagtcctagccattgcaatcagacaagagaaagaaatcaagggcatccaaatcggtaaagaggaagtcaaactgttgctgtttgctgatgatatgatcatatatccagaaaaccctaaagactcatccaagaatctcctagaactggtaaattaattcagcaaagtttcaggataaaacattaatgcattcaaatcagtggctctgctatataccaacagtgaccaagctgagaattaaatcaagaactcaaccgtttttttacaaaatctgcaaaaagaaaaataaaatacttaggaatatacctaaccaaggaggtgaaagacttctacaaggaaaaccacaaaacactgctgaaagaaataacaggcgacagaaacaaatggaaacactcccatgttcatggatgagtagaatcaatattgtaaaaatgaccagacttccaaaagcattccacgaattcaatgcaattcccatcaaaatgccaccatcattgtttacagagttagaaaaaacaatcctaagattcatatagaaccaaaaaagagcccgtatagccaaatcaatactaagcaaaaagaagaaatctggaggcatcacattacttgacttcaaactatattataaggccatagtcaccaaaacagcatagtactggtataaaaataggcacacagaccaatggaacagaatagagaacccagaaataaagccaaatgcttacagtgaaatgatctttgcaaagtaaacaaaaacattaagtgaagaaaggacaccctatatgacaaatggtgctgggataattggctagccagatgtagaagaatgaaactgggttctcatctctcaccctataaaaaaatcaactcaaggtgaatgaaagaattaaatctaagacctaaaaccataaaaattctagaagataatatctgaaaaacccttctagacactggtttcggcaaagactctgtgaccaagaacccaacagcaaatgcaacaaaaacaaggataaatagatggtacttaattaaaatggaaagcttctgcacagaaaaagaaataatcagcagagttaatagaaaacccaccgaatgggagaaagatcatcacaatctacacatctgacaaaagactcatattcagaatctccaaataactcaaacaaatcagcaagaaaaaaaatcccatcaaaaagtgggctaaggacatgaatagacgattctcaaaaaaaaaaagatatacaaatggccaacaagcatatgaaaaaaatgttcaactcactaattatcggggaaatgcaaatcaaaaccacaacgagataccaccttactcttgtaagaatggccatgatcagaaaaaacaaaacaacaaaaaaaggtgttggcatggatacagtgaaaagggaacacctttacactgttattgggaatgtaaactagtacaaccagtatggaaaatagtgtggagattccttaaagaactgaaagtagaactatcatctgatctagtaaccccactactagatatctacccagaggaaaaaaaggcattatacgaaaaagatacttgcacacacgtttatagcagcacaatttgcaattgcataaatatggaatcagcccaaatgcccatcaatcaatgaatgataaagaaaatgttatatatacatatatatatataaatgtggtatatatgtgtgtgtgtatgtatatatatatgtgtgtgtgtgtgtgtatatatatatattcatgtaaccaaacaccatctgctccccaaaaacctcttgaaaaaaaaaattaaaaaatttctgctggaaataaatttcagataggtaatacctttaaaatacgcatattgtcacaaggtgtatctaggaattatatccttaggagttgtgtaatcatgatataatgaaggctccagaagcttctcagtagtatagtttcattgaaataatttttttgcctcttataatatcaacatgaaacaattcaaatgaggccagcctccaagaatattttgtaaaatattaatacaaattatacttgtaggttgttttgttcataatggagtgcattttgtgtgatttggtttatatttctttactttggtttttaaacatcatcttttcttgaattagaattagctgccaatgtatttaacactaaaagttcgttttaattttgttcagttacaattaggtgggaatgtccagttattagccttaatatctttgctttggcaaaattacaaggaggaagtaattaggctgcttaaagatcaccgagggatcagaaagtctaacactgttctctcctggtgcaaaacacttttagcagatgctaattttattttggctcctattgtctccttcctatctaggttatactgcttctataactatttgaaatctttttgtgcattatccttaccttatgagatgttactttatctaatttagaatatctgctaatatgattaattacaatgtagagtacagaaatagaaaaaaatatgtactgaaagcctgaaatcttggattcatattttacttctccaacttattctgtttaattcacaagcaaaatttttaagaattgttataggtaagaatagctataacaatcttgttttatacaaggatactgtctaaaggagacaaaatttgtgctaaaattctacaagacttaaatatatctttgatggcatacttaagccttttttgagaccgccattttgagacaattctgaagtctaaaaaatgttgaatgactgggaaaattaaacagaaggttttagttcttctctttctaactagctaatgccaatgccagagtagtgaattgtgtgtggcatacacacaataaatattctctcaaggaagcaatgaaggaaggaaaagtgaaaaataaaaatgaaaaggccaagcaagcagaatgagaagcatcaactaatctaattgtttcattctttctacatgtgaactttaactctgaaactttacagaatgtaactaaattggtctaataatatatgtaatagatgatatatatataaacatgcatttaaataatttaaatatatatataatttcaaatctaatgttagttggaatggatattactgtttgaccttctgacacaccagcaaaaactaaagctagaatgtattatttttgaaatattaaattgatcaaaagagaaagcaaccaatgttccagcagatttttttcataatatacatagacactgaaaatcacattgcttacattactcaatttattccataatcaatttcagatattattttctgcctaaaatgtcttaatctatccaataataatgtcagaagcacattcaaagacaacctccctagatggtcactgtaataactgagtcagtttcttcattctcagttttgattacttagaactatatttcttcagaacaaaagtaattcatctgaaactattttatgtatgaaatggaaaaggccaaaaagagtcatctataattctttattagtcagtgactacttctctaagcttctcttaaaatgtcaaagctatacagaagtaagatgatacttttgctttctcccataccatttgaataatgctaaaaacaatgacataatttgataaagccatgttatagaagtacctacttcaaggcaacctgatccaattaaagaagattatcaatataagaaaaaaaaccttcaatgtgacacaattatgtcaactttgaaaactgggtgtttcaaaataaacagaaaaaaatgggaggaagcattcagtatttaaaaagttattaatacatgtaaatatgtgtcatgtactatgtttcacttatttcactaagatttagtgtctctcataaaagtgaatgcaataagattctaaaataaagaaaactgtgggcatatataggcttcagtcacataatcaaactcagaaattttgacttatttaggatatagtttgttttagctgtaaatactaaatactaaaaaaaaggattaataaaattttataataattaaagtaacacggaaaagacatatgttctttattattaggaatgttattaaacagtttattataattagtctttatttgtttcttattccttatatccacaaatacaatatttaataggagagagttcttcattttccaagagagtataaacatagtgaacaatagtaatcattataaaaagaagcccaaaaacctttccctaatactatttaagcaagaaataatatgaaacagttgcaaaaatcctcatttttttccaaaaggaaataaatatgtactatgaagttgaacataatataaaagccatgaaataatattatacctcagtctgaaatattaattgaatatctcaacacattaatgaaagcaacagatttttcagttaaagtgtaaagtatttctaaggatgcagcagctgcttagaaatactgaaataaacatgagaaatctaaaaaaaggaaactaaaatgtttatgaacaccagtctctatattaattatgtattttatgcattttatatctttagtattatctttagtattctactaaatactacttttctttgaattttaaatattatattagaatatattgttgacacagaaaacctaacattataacattttaaaatgtattaatttttgaagagcaaaaataaggaaacaattgacagactttcctgtaagatctgaaacaagacaaggctgcctactgtcaccatttttattcaacatagaactgaatggcctagccagaaccattagctaagagaaagaaatatagagtatccaaattggaaaggaggaagtctaattgtcctagtttatagataacatggtcttatattaagaaaaacctttctttgtgttacaaacaatccagttataacttttagttatttttaaacatataataaattacttttggctatagttgccctgttttgctatcaaatactagatcttatttattctatctaactatatttctgtactcattaaatatattcttatcccatttgtctttactgattgattcatgaaaatgtcaaaagtgtaataaaacattgctattactaattaaactactaagtgaaaattaaaatttctttttgtttattttgtctctggatagttgactctgagtgtgaatcctgtaccttatttaccctgttgtgattattacacattgtatgcctgtatcaaaatatttcctgtaccccatacatatatagactaccatgtgctcacaaaaatgaaaaataaaaatatatatacaaaaaaaagaaaaacctaaaggctctaccaaaaaaaaaaaactcttagatttgataaaaaaattcaataaagttgaaggatatcaaatcaacctgcaaaaatcaacagcatttttacacacaaatagtgaacaatctaaaaaagaaatcaggcaagcaatcctatttctcatagctacaaaaaacaaaacacctagaaatcaatataactaaagaggtgaaaaatccctactattaaactataaaatattgataaaagaaattgaagaggagacaaaaaaagatatcctctgttcatgtatggaaagaattaatattgttaaaatgtccatactgcccagagcaatatacagattcagtgtaacccatagaaaaataccaatgacattttttacatagatagaaaaaaaaaatcctaaaatttacatagaaccacaaaagaccctgaatagccaaagcaatcctgagaaaaacagcaaagctggaaacatcacacgacctggcttcaaaatatgttacaaagatatagtaactaaaactgcatggtactggcattaaaaaaaaaaaccacatagaccactggaacagaatggagaacccaaaaataaattcacatatttatagccaactgattttgaacaagtgtcaagaacacacattgagaaaaggatagtcaataaacagtagtgggaaaattggatatctattgcagaaaaatgaaactaggcccctacctttcaccatatggaaaaatccaatcaaaataaaggcctagcataaaatccaaaactataaaactagtagaagaaaacacggggcttcaggacattgattttggcaaagatttgatggctaacacctcaaaagcacaggcaacaaaagcaaaaataaacacatgggattatatcaaactaaaaaggttttgcacagcaaagaaaacaattaacagagtgacaagacaacctacagaatgatagaagatattttcatactatttgacaagggattaaaatacagaatacataagacatatcaacagaagaataaaacaaatttaaaaatgggcaaatgatctgaatagtcatctctcaaaagaagacatacaaatggccaacaggtatatgaaaaaatgttccacatcattaattgacaggaaaatgcaaatcaaaagcacaataagatatcatcttaccccaattaaaattgctataattgaaagaacaaaaaataaattctgtcaagaatgtagagaaaaggggactcataccctgttggtaggaatgtaaattagtacagccattatggaaaataggagttttctttaaaaactactactaataaactaataatagaactaccatatgatccagcaatccattactgggtatttatttaaagaaaaggaagtcagtatgtcaaagagatagctgcactcctatgcttactgcagcactgttcacaacctgtcaatcagttagttagaatcaatctaactgtccaccaatgaatggatggataaacaaaatgtggtatacaagcacaatggaatattcaggcacaaagaaaaatgaaatcctgtcatttgtggcaacatgaccaagactggaggacattatgttaagtgaaataagtcaggtacagaaagacaagtaccacatattctcatatgtgagagttttaaaagttgatgacacagaattaatgaatagaataatggttatcaggggcagggaagagtagcggagaggggaagataaaaataagttggttaaaggtacaaaaatacagttatataggaggaataaattgtagtcttctgtaacataggctgactatagttaataatttattgtgtatttaaaaatagctatatgagaagattttgaatgtgttcaaaacaaagaaatgatagatgtttgaggaatagtatatgctcattacctaatttgatcaatacacagtgtatacatgtatagaaatatatgtactctacaaaggcaattattatatgtcaattaaaaataaaacataatgaaaataaatgttaaaaatacacaaccaaaaaagaaagaaagaaatataatgtatcaacaacaacaaaactcggttttgtaattacaattgattaaaattaattgagtatatttgatgctgaagagctgatactagaaataatttgagtatgttttaagctaaaaatatctgccctaagaaataattaagcttccttataatcgtccattacctagtgtattaatagagctattagaaattcaattataatttagaaaaaatggttgaagagagtaaaaatttaactttgcctaaatcaatgttctaatggcaaagagcaattagcatgaacttttatgatgtccacttgtaagtaactcacctgattagcaatctgccgagcaaggacatccatccttgatcctgattctgatatcattttcgctgcatagatcacatcagttgtatgctttagtggtcctttgcccctggaaaaaaatttatatatgttagctgtggtgttcatgagaaaatatatgttagctacgatggttcatgaaaaaatgtattaatctatgcgtccatccatccgcatatgtaaaatattcgcatcccaaagaacggctattgtttttgtgattgtttgttttgagactgagtctcactctgtcgccaagcttgagtgcagtggtgcagtctcggctcactgcaacctccgcttctcgggttcaagcgattctccagtcttagccccccgaagagctgggactgcaggcgcgcgccaccatgcccggctaatttttgtatttttagtagagatggggtttcaccatgttggccaggatggtcacgatttattgacctcgtgatccacccgcctcggcctcccaaagtgctgggattacaggcgtgagccgccgtgccctgccagctgttggttttaatattttgattttgaaaagagcacaatcagactccagtattattattattattttttaatgccagcctattgtgttaagtcaagaaatactgcagagaagatgaagacctttttgatcttcattcccaggtgtttattatagtaaaactcagcctagagatacccttcatagacctagatacctcaaggcaaaggtattttcctgattttagagagaatcataatattttggatattatatgtatctaacgatttattttttatcagcaggcctacttttagtatttcacattttttctgttgctatattttagttactttaaaaaaatttattgatggtaaaattcattttttatggggtacatgtattattttgctatttgtacatacatagaatgtgtaatgattaagtaatgttatttagggtatctgtcacgtcagtcaagtattatttctatttgttgaaaatatttgaagtcttctcttctagctattttgaaatattcaatacattgtttttaactatagtcatcctactcaactattgaatatttgaattgttctttctaactgtatgtttgctcccattaaccaacctctcttatccccccaatccccaacaaacaccatgccaagcctcagataactatgattctactttccacctccatgagagcaaagtttttagctctcacatatggaggagaaagtgatatttgtctaacttatttcacttagcataacatcctccaggctcatccaagttgctgtaaatgttaggatttaattcttttttaatggctgtgtttcattttgtgtgtagtgtgtgtgtgtgtgtgtgtatacacacacacacaccacattttatttatccatttatccaacacttaggttgatttcacatctttgctattgtgaataatactacaataaaaataggggtgcaggtatccttttgatatgctgatttccttttctttggataaatacttaggagtgagattgctagatcatacgttagtactacttttaattttttgagaaatatccatattgttttccataatggctgtactagtttacattctcatcaacagtgtataagagttcccttttcaacatacctttgccagcatctgtttttttttttttccttttaataatagtcattctaactggggtaaaatgatatattattgtagttttggtttgagttttcaagctaattagtgatgttgagcatgttttcatatacctattggtcatttgtcttcttttgagaaatgtctgttcatgtcctttgcccgctttttgatgggattattattattttctcctgttgagttgttttagttccatgtattctctgaactttaggcccttattagagaaacagtttgcaaatatttttaaatattaaatatttaaataatttaaatattaaatattttctactatttaacaggctctttactctgttgattatttcttttgatgtgcagaagctttttagtttaatatagtcccatttgcctatttttatcttgcctgtgcttttgaagtcttagccataaaatcttcgtctagaccaatgacctgaagcatttccccaatgttttcttcaagcagttttataattttggatcttacatttaggttttagctgatcttgatttgatttttgtatatggtgagagataggtggctagtttcattcttctgagtatgattatcctgttttcccagcaccatttattgaagagccatcctttccccagtgcctgttcttcccacctttgtcgaaaaccagttggttataaatgtgtggatttatttctgggttctttattggttcatgtgtctatttttacgctcatacaatgcttttttggttactacagccttataatatgtcttgaagccaggtagtatgatgtgttgtgtcctttttcctgttcttttcctcagtattgctttggctatttggggacttttgtggttctattaatatgtaacatttaggattgtttcttctgtttctgtgaagaatgtcactgatattttgatataattccactgaaaatgtagatttcttttggtagtatggatattttgacaatattaattcttctgatctatgggcatgaaatatattttttattttttgtgtcttgttcaatttcttccaccagtgttttatagttttgtttgtagaggttggttcttgtttggttaaaattattcctaggctttttttttgtagctattttaaatgggattgcctcttgatttcttttgcacatttttcagactggtgtataaaatgctattgatttttgtatgttgatttagtactctgcaactttccttaatttttcaaatctaagagtgttttggtggagtctttaggtttttcttaatataagataatttcattgcaaagaaggacaatttggcctcccattttccaatttggatgacttttctttctttttcctgattgctctggctgataaccttcagtactagaatcctgaaggggagttataaaagtgggcatcctcatcttgttccggatcttgatagaaaggctttcagctttgttccaatcagtatgatgttagctgtgagtttgtaatatgtggcctttattatgttggggtatattccttctaaatctactttcttgagagttttcatcatgaaaagatcttgaattttatcagatgcttttactgagcctattgagatgatcacattttttaatctttcattcttttgatatgatgtatcacgtttattgatttgtgtatgttgaatcatccttgcatcccaaggataaatcccacttgattaacatgtgttatctttttggtgtgctgtttgattaattttgctagtattttgttgagggtttttgtgtctcattcatcatggatattgacctgtagttttctttctttcttgtgttcttgtctggttttggtatgagggtaatactgcctcataaaataaaatagggagaattccctcctcttcagttttgtggaatgccttgaggaaaatcaatgttagttattctttgtaagtttggtagaattcagcaataaaggaaccaattctgggcttctctttttcgggagtctttttgttactgattcaatctactgtgcattattgttctgttcagattttctattttttccacacttgatcttcgtaggttttgtgattccaggaatttattcatttcccctatgtcttccagtttgtaaatgttaactgttaataatagtgtctgatgaccttttgtatttctgtgatgtcaattgtaatgcctccttttacatttataattttgtttatttgggtattctctcttttcttggttagtcttgctagcaggttatttaattttttatcttttcacaaaaccaatttgttgctttgttgatctttcgtatttttttagtctctgtatcatttagttctgttcttatctttattacttattttcttctactaattctggatttagcttgttcttgcttttctaattccttgatgtgcatcattagattgtttatttgaaaactttctagttttttatagtaggaatttattgctatgaacttccctcttagcactgcttttgctctatcctataggttttggtatattgtgtttttattttctttctttttcagaaacttgtttgatttcctacttaatttcttcattgacttgatgcttgtctaggagattgttgtttaatttctacgtatttgtacagcttccaaaattcctctttttactcatttctagttttatttgattgtggcataggaggacacttggtatgctattaacttttaaaaaatttgttaagatttgttttgttgcctgacatatggtcaatcctacaggatgtctatgtggttatgggaaaaatgtatattctacaactgttcaataaaatgttctgtagattggcctcttaggccaatgtggtctaaagtgcagtttaaatacaatgtttctttttaaattttctgtctagatgatctttctaatgctaagagttgagtgttgaagtctccaactattattgcattggagtacatctctcccttttgatgtaataatatttgcttcatatatctggatgatttcatattgggtacatatgtatttataatttttatattctcttgctggatttgtccttttatctttaatataatgaccttcattgtctcttttttactgtttttgacttaaaaatgtttttatcagatataagtagagatacttatgctcacttttggtttctgtttgcaccaaatatctttttcaatcctttactttcattctatatgtctttacaagtgaagtgagtttcttagaggcagcagatagttgggtcatgtggtccttgcttttggttttggtttttgttttcaaatccattcagccagtctttctctctatatatattttttagatggagtcttgctctgttgcctgggctgcagtacagtggcacaatctcagctcactgcaacctccacctcctgggttcagcctattctcctgcctcagcctcctgagtagctgggattacaggcatgtgccaccatgcctggttcattttcgtatttttagcagagacagggtttcaccatgttggccagactggtcttgaactcctgacctcgcgatctgcccacctcagcctcccaaagtgctgagattaaaggtctgagtcaccaagctatatcttttaagagcaaaatttaatccatttaccttcaaagttattatttatgtgtgaggatttatttctgtcattttgtaaattgttttctggatgttttgtgtatacttcgttcctttctttcttattgtttatcattatggtttggtgtttttctgtagttgtaccatttgagtagtttctacatttgtatgtttaccagtaagttttatactttcctgtgttttcatgataatagatatcatctttgcactttcagatataagaaccctttaaaggagtcacgaaaacaaaggaaagtaataaatttcctcagtttttgcttatctgggaaagagtttatttcttttttatagctgaaggatcaattttgctgggtatagtgttctggattgacattttttttttttggtttttctcctcccagctctctgaatgtatcatctcattctctcctgatctgtaatttttctgctgaaaaatctgctgttagttttaataaggtttcctttatatttgacttaacatcattctcttcctgtctttagaaatcctttctttgtatttgactttcaacaatttgactataacttgcctttaacaagaactttttgagttgaatctatttggggctctttaagctttctgaatctggatgttcatatctctcctaagacttttaagtttccaggcatcattttactaaatagattttctatggctttggaattctcttcaacttctggactatccagaatttgaaactttggttactttatggagccccatttgttacacaggatttgtacaatctttttttattatttattctattttgcctgaccaagttatttaaaaaatcctttattcctgctataaaattatttcttgtgcataataaaatctgttgttgaagctctcacatgaattttgtatttcattcattgaattcttagttccagaatttttgtttcttttttatgatgcttatcacattggtaaatttctcattatgttcttaattgtcttttctgatttttttttgtattctttatctgtgttctattgtatctcactgagcttctttaatattattactctgaactcttttttcatcatttcattaatttcttttttattgtaatatcttgctggacaattattatgtttctttagatgtggcatatttccttgacatttaatgtttcttttttcctttcattgatatctttgcatatggtgtaagtcacttctttatttttttggattgtcttttgtaggggaaggtcctaaagatctatctgtagtgttggtttcacaggacactttagtttgattctgggtgcatgcagtaatgtagcctccatgtgatttatttgtctataaatagcctcagtggtatctgtgatttcctctgtcaattaggctgtggctgttagtgcaggctgtggtaaggctttgtaggggatgagaactgcaggtgggttggtcctcaggcctcggtggtgggccaagcatgcctgtctttgggcccacaggcagcgtgcatgggcacgaatgtaattaggtctaagaaggctaattcttggacctccaggtggctttcttgggttctggcagtggcagtattgggccatgtggttcattaagttcctgggtagcatgcatggcatgagcaatggccatatctgtgacaggacaaccccatgggctcacagataaaacatgtttctgttagtggtggctgtgatgagctgggtgggcctgcgcttaagcacctgaaatacttgcactgataccagtggtagtgggtggggcaagatgatccccaggtccctagacaatgtgcccaggcatgggtgatgttgccaggccagacaagcctgtcattaggcctcctccattgtgcacacaggtacaggctgtgatcggcaggccagggtgaaacctaggctcccctggtaaagtgctgggtggtggcagcaatgacagcaatgagcagggagaatccatcctcaaggcacgtgcaagtacactgtgggcctgtttctgggaattggggttattttcagtgacagcagccacagccagttggctctcaggctcttggaagtatacgcttcagtgtccagaattggtggaagcagcagccatggggagagccagtcttcagagcatgtgcaagttgaggattgctgaggaggcagagttgctatcagtgggagcagccccaggcaggcaagtttcaagttctggggagcacatgctttggctccctttgtcccaggggcaccttgctttgcctgctacaccacccataacctggggtgcaagttgctgtgtgttctatagtgctgaggaccctgctgttctgctgagtctaatcactctcatgccactgcagtcctgtaagggatgtagggagatgtcagtggggttctagggatgtaggaatgcaggggctgctgagccccagggagaaatgcagtctggtttgggccacattctcataatgacactgtgctacaactgcttaggactcagggtgtttgtgggacccagcataagctacctatctggagcgacgccattacacactatccaggctgcttcctgtggtagccttatggtctgcaggggtcaaggaactctccagtgactaggattgcaggagcccatcatgggaatgtggactgctggggcatataccattttcccacactggggtgactctccaagctcccaggtgatcctgaccaagctggcagctttacttccctgttttttttcttgcttcaggtgtttcatgacactcctctgttgaattccagtgttctgtcttagatgctgtattcaaagaatgattatgtacttgctattttagtttttctttgtggaggaggcaattgctgaatgcctctagtcagccatcttggagtcctgttccaatctttattttttaaatctgtttttacagtctttccattaattgtgttttttttaatcccattatctattctccacagttgattcaaacatggaaagtccaagcctaagaaatgtgtaatctaaggccttcaacatgaaaacatgaattaaatttatcttctcgtttgtctcatagtggttctcccactttcaaagaggagttaccccaagacttacctaagtaaatccattaattctagcattcacttaaaaggaaaatgttgagagtattgctgagatgagtgaaaaagaaatccagaaaaaaatgaattaggcctgaggacaattaataagaagtactgaaatgacgtgatatctgttgatctaaaataatccagccaaattttggtgaaatataaaatctggtgctgcacactggtcaatcggtataccatcttgggttagccaacagaatactacagttggaggtggagagcggtggcctgggtccctttacatgatcttacccctcccaccctttgatctgatcttgtttgcccattactaagttatgtcacttaaacatcatgatttaagcatgagagaaagaaagaaattgtcctataggaaaaggatggaaagtctaaactcagagagtaccggaaagtcaatgaggcctataagaacaccattcatgtattcttccttacatggtttatttttgtccctctcagttctccctcaatctgtttacttgctgttaagtaaaagaaaaacgtccgggagcagtggcttctgcctgtaatcccagcactttgggaggccgagatgggtggatcacctgaggtcgggagttcaagactagcctgagcaacatggagaaaccccatctgtactaaaaataccaaattagctgggcatgtggtacatgctggtaatcccagctacctgggaggctgaggcaggagaatcgctcgaactcaggaggcagaggttgcggcgagccaagatcatgccattgcactcctgcctgggcaacaaggtgaaactctgtctcaaaaaaaacaaaaaagaactatatcataatagttgagtataatataaagctggagtcatgttatcttggttcctaatgccacagaataaaagttgcattgatttcaggattctacaaggtaggaaaaaagcaagaagtgtgcttttaatttttggagaagttttccatttgtttccggagtgagtgaccattttgatacaagaacagcatttctgtgagaaaaatgcatactgtttttgacacattactgtgaaagggagccaaacacctatataattggatcctttcaccaagagctcctttctttaaagatgtacaactggactgaaatatgataaggggacatttttctatcttcccttttttgaaaaaaaataaacgaatgattatctgaatgaatgtagctgttccatccatttacaaccacttctgtccatatttcctaactctctactgagtcttaccacactgaatttctcggttttaattattagatttctgttccttgtccctagcagagaatagcgccctgaagaaacagctcactaaagcaattgttttgatgcttcaagggaaagagggatagtgaggaggggaaaaaggaataaactagttagagtgagaaaagaaaaattctgagaggccaaaatacagttgcttaagaaaagacagggagtgaaaacaatcttggtgcatgtcttatttatgccttgaactgaccttgagaatagacaccctaatattaaatccaataagatgtgttattagaagaaagtctttgttcactaagaagaatagcactatgtagtgataaaagacagaggggattcatgcaaagctaaatgatcaaagaactctatacctgaaaacctgaacctaaaatacttgtgccctgtaagccaagaaaggccctttcattgccctttttcccatggtgcttctcaaaatcattattagcaagtttccctgtaaaaatgaaacagcatgtctaacaacaatgaaaacctggtctcatagatggttatcatcacacattttctctgaatctgctgacaaagattgctttgtaataaaaaaatcaacattaatcattataatatttgagttgctcttatcaaatttacacatcaggcaggactagatgttacgtacatggttatgttcaagtaaggcattgcatttcattatttcaatgcatctctagagaaagttcaacttaaataaagctgtctaagctcctgaaaggcaatgcatcaatttttcaagtcttaaacaatggacaaagattgtttctaaggagagcagctaaggctctcatcttttaaatgatagacagtgttatatctaaggagcagctaaagtacccttcccctcaaaatactatgtttcccagtttaaaaaccctgggctgatgaaagggaaattacctctagttttaaatgcataccttgttaggagaccactatcttaagcacatgtagaacctaaaagtaatgataatacactatgccaaaccacaattattctcttcctcatgtttttaattaaatgtattgcctggcaagcttcctactgaatgccaaacaaaatacacattttacaaatgagtctatatcatgccaaacttcaagaggattctacaattactgaaactatgataaatttttaaaattctcagcctgaaatgtactatgtaatgaaggctttttaaattgggaaatatattcaaacgttgtttgctgccttcatttccataatgggttcttgggatctcctgtcagcaaatagcatcttaaattattgcattggatcctacagaaaaagacctagagaagaaagggttagagattgaaaatattttaaagaaaccagaggccagaagtctttaataaacagtggttacaataataatcaaaaaaaaaaaaaagcagatcagactctgaagtagagggcctgccactagctgaggtagtgcataagttaattagccattccatttttatacatacttcaaaacattatctcgtacacaataaatatatacattttgtcaattaaagaaagtaaaatgtaataaagataattttaaaacattatgggttagaaagtataatgaaaaaggctataataacccagtgatggtaataccatggacattttattcagataagtgaaaggaatatctttgaaaatttattggcttggcacaaacctgccagtcatttctgacactgcctcatccttgactctctttcctatccctgacctcatctcatttctggcattcattctccttcctcctttctcttttgattaaaacgagaaagaagaagatggtacaggtgatcagaaacaggtcaattaactagggctatggcttaaaaacaaaaaataccaaatgttttcatagagtcattttgtctttttaaggacagtgaatatctatgaaatgatttggtagtttctgctattgtgtgaaaacaaaacagaaagtttaattatattatttatatttttattccctaaatcgttgaaaacataatagtattaaagatcaaaaacttcctccttaatcctttttttctttgatgtttatatagaataagtcccataacatagcggttgattttatagatgaaaacaataatagcatatattttcttctgtaattaagagttagcacattcagcattttctgtttgccagacactatactatacacacactaattttatcagtataataatcattaagtttatagcactcttgtgcttgttttgcagatgagcaaactgacgaacagacaagttaaacgtagcttgaccaagtttcacaggtagtaaatattggagatgggatttgaactcagggaatgtggctacagagtccacttttaacaactatgctatgttgcctcccataaaacatatcgagttaaaaattaaaatattagaagatcaccttagccattgatgggcattaccatgaatgcaacagattgaagaccagggttaaatataggtgatgggtagttgggaggcccaccaacagtgacttcatcacacatagcagcctcaaggaatacagcctaaatctctgtcccagtaaaataaaaaatatatatatatactacattgcatagatttcgggggtcatgacaagtgattgaaatggccccagtagcctacagtcctggggtttctttcttgagatattattacttctttctgtctcttattcccattacccttcctccctctctccttctccctggcttctgaacgctacactgaaactcagccattccatgtgccatgctacatgggagattgcactttgatgttttcttttttataatatagcaaatggaacttttatctgagagtcttagctttagatataatcattttatttctaacattcaaatttagtgctgtgataaagtagattgaaatgaatacagacttgaaaaataagttttgtctgcatcccaggactgccactgattagccatgtagtcttcactagttgactttgctgatctgagcttattttctcttaattaaaataaaactgtggcatttgtcacatggtaaggaatagaaaatcaaatgttttacacaacatttgacacatagcagatgttcatcaaatgtcattttttctttccttctccttttacaaataattatattttataaaaatctaccttttcattttatttacttattttttactgttcttaaggtgcatcagcaccttttcacttttttaaattccaaaattacaatacttgccagataacatcaactgaatggattatattgagttccttcttacacctgctgacagtagtactttgcaagtcttgtccatatattcttttagtgagaaaaaaggaatataaaatatatacacacataaactctctctgtgtgtagttgttatcgtttaaagttgttatttaactcctaatacagaatttatttactcttagtgacagatatttgtggtagtataacttcctaggattatataaattagctctacaagaatagagctgaattacaagagtaggggaattctactaccagaattcccttacttataattctgtattagataaaaaagaaaaaaagtagttatcatggaagcaaccaaaaatgataagttgaaaagagatatagactcaagcaaggacacactgttcttctactattcaaacatgaaactttaatttggcaaatttctccctctgggtgttactttctcttgtaaagtgtcattccaaagttttgaggaccctataaaagtccttggaaaatcagctaatgaatactcagctagcaatcatcttgagtaattagtatcctgaagaacttttgggattcaagtctgaaaaaggaattgctccatgaaagagggaaaatgtttgtctggcattgtatatattagtctcctttctatttctcttgttccatattattcagagtagcctaactgctattataatatcaaaatgtcttagtagcttaacacaataaatttcattccactctcacatgatagtccaggcgaattgtgggtggtgggctatgtaccacatagttgttcaaggacctaggtaccctcgatctacaagatatcctgtcccctaaggctccagaaccctctgcacaagtcattgcatccagatatccaacaacagaaaggaatgagaatagatctcataggagacttctggggtcaggacagaaattgacacacttcactcccacccatattccagaaatgagatacaaaggctcatgtaactgcaaagaaagctgggaaatgtattctattccgttcgggaaagaaaagaaaacaaggttttgtgaactcacagcattgcctttgcacatgatcccaggggtgctaaaatcctatattttattttattttcatttcagcaacaaaaggctgtgttccttgtgaaaggaaattttgtatgtcatcaagtagatgggaaaaattgagaaagaactgaggcacttcactaatacagctgtaattacatgacatatactctgcctgggcacaagaccaattttatttcctattttgaaattgtcaccatctagaggatctattattaaaaacaaaaattacatgaattctactttgtgcacaataatagtgtttcatattcaatgttgcatttgcttatgaaacaaggatagagtgtattttcaagatattttaggagatcaacctgggagaatactttattactattgccattgctgctggtggcggtggtggtggtggtggtggtgtgtgtgtgtgtgtgtggagagagagagaagaaattcccttcctcaaattcactactacttttctaaagaaatcctaggcacaattttattttctgttcttcggtcctcaaatacctcaatttaccctttacctgttagtgttgtaacaaatcctagacagattatagaattcatagaagaatttcatggagggggaaaaatcccaagaaaaaacacaaaacccataggtgaaatcaaaggtagaattagaatgaagaatttctttggcaaagtttgttttttgttatattgtgggcaaaatagagatcagtaaaccaaataattttgatttttgtctttagtaaaacagactattttctccaggactttataagtctgaagatttaatatttttttgtgtgattttgtactgaaaacataacataataacaaacattattgtgttattatgtgcttacaacgttccaggcactgctgcaattgcttacttttcttactcacttctcatacccagcactgctgcatagaactgcacaccttttgcactacacacatttaagggcagccattcacagcatggacatgcccataattgcgcacatcacatcatatgctgcttcgcatgcccactctgttcctaaaatctattatctttgtcctataaacaagaaaacagaattttagacgctcaacactccttaacttttctccaacatataagaatacaggtcagtttcaaatgaatagcaaggagtttaaatccatgttttcagagctaattaaaaataaatcttgcagtgaaagcatcatcataggttttatgtcagtatgcatcttaaagcactgaaattcgacgggtacctcagaatcagtggaatgttttatatattgcaaagaaatatacagaaacaagatattcccagccgttgttctaagtgggtctgattaaaacattattctctgtctacctgaaccaatcccaaggattataaaataaatagccccttctttggttgaatttctttcatcagaaatctggcatgtatctttttcttttcctttttttcccatctacttgggtctgaaaagagatagatctaagggggggaattactatggttttctcccccagttggacttttggttcatagagacatgtaacctagttgtgggggtccatgatcgaccatccgatgttccctagaaccaacaaaagtagccattaatgttagctgagaaactttaccctagtgaaaattgtggtttctaggtagaagttcttctaaggacttcagcctattttgtgactaagtttgttttctataacatctaaagagcacagctgtctaagaaacactgccactcttctctgctctttcttccaatggcaatgaaattcttgcatcaccctaaggagaaaactagagttggtagttgaatgcattttaattcttacagttccctctgtaactcatgactggcatcactcctgtattacttgttccactaatttttcttcatgcaattcttgcattagtttcttatcgctgctgtaacaaatattaaccaatttgttgacaatacacatttattattttatatttctggaactgggaagtccaaagtaagtttcactaggctaaagggaaggtgtcagcagggctggttccttctggaggctctgagaggagaatccattctctcaccattttcagcttctagaagctgcctgtattccttggcttgtggatttttctttcatctccaaaggatatcactaaaaggtatgcttctgttatcacacttatgtccttctcctttctgttctcctgtgctcttgaaaagactcctataatatcattggaccaacacagatgatttacaataatctctcctcacaggttttgggaatttgaaggtggacatcgtggagagccattatttagcctacacagccctcaggagtcactaccaagtagtcagaatcagctcctatgatgaagctattgattttcctgcatttaaatcaaagcagtcagttgggataaattgacggtgttatggtgattatttctctagattgccagttattttttaacatgacctatattattccaacttccagtgaaagggtcaggttcttggttcttaattatttgctagctgtatgctcctttacttacaattcatatcgaaggtgggtggcctggaaaaatttggagacctgagagaaccagaattacctgggaagacactttatgtgtctggtgctactctccttccccgatacactacatattaagtttaacctgccttttccctctcctggtgttacacattatataaatactccttgaaagcacataaggctctggcgtggggcaaaaggaagaaggaaacctcttctagggtagatgagaacatttttttttcaggtgattattatatatactaatttcctctttgacacccatggaccttgaaaaccctagtacatgttttcataagacattcaaatactatataaatactgcatacttaaaggcatcacttagggatgacattatagttaaaactacttagtaatcccctttattgaaactgtgagatgtggtataaacttctcagtggtgcctttccagactcatatgagtagtaagaatgcacaaggaaagcctttttttttttttttttttccgagagggagtcttgctctgttgcccaggctggagagcagtggcacgatctcggctcagtgcaagctctgcctcctgggttcacaccattctcctgcctcagcctcccaagtagctgggactacaggcacccaccaccgtgcccggctaatttttttgtatttttagtagagacggggcttcacagtgttagccaggatagtctcgatctcctgacctcgtgatccgcccgcctcggcctcccaaagtgctgggattacaggtgtgagccactgcaccatgctgcaaagccatttttatcttcccttgtacatgggaaagttacccctgcaatgtcctcctcaccaacacccccccacacccaacaaaccaaaagactaaaagtcattattcgttgacaccctctctggacacaatgggaaatctgtactcagcaccaacatttgaaaacaggtcttttcttgccttccacacattacttctctgagtgtgcacattaatcaaagccaatgtactgtaaataccatcacactctctgactgtgagagtccctctttttcctgttggcagtggcctcagcattaatcatgcacatgattcttacagagcctgggcattttttccagcttcgctttaaaccaccgtgatatactggctgcccctgctcctttcatatcagaccaacttttataagctcagaaaataatcgcattcaatttaggaaaataatataatttagccattattagttagcatctgaccttcttaaagcctactgactcacttcttattctggtcatggcataatattattctaaggtccagatgaagaaacacacaaaggtgaaagagccactaacttagtcaagaccaatcacagctaatagattcagtacagagttagttcaagggtctgccttgccaccagtctcaggccttgttgttgtttctgagatgacaagacctttggcagctgatctttggcatgccccccgcacccccaccattctagtctagtacagctataggtcattaaattttaggacaccgtaaagcttactattttcaatcagcttattcagactgagtatgacttgagacatactgagttatgcagctagttttcatgttaatgtgtcatttttgctgctctcaattgatttacatgctttattgaattacgatattgtgcagtgacccaaagtcaatttttaaagggtacaatttaaaaatttgaaataatcagccttagttcagacgtatacattatttaaaattttttttctctccatcagattatttgatcacacaggtattaagcctagtacccattagttatttttcctgatcctcttcctcctcccaccatccacccttcatgaggcctaacatcccattatttatctattgcaaaatgatacaacataatgcctcttcaattaacaaatgttaaagcaaaatcaccataatacggtagttattcggcatcatgtgcagctgtgagtgatcctccttctcatgtggatgtgtccttgccttaaaaaaatttgtgcctcaggaaaaaatagactaacaccatacttaaatatttggacctggctttatattaggtagctccatctggagggtctcatattggtgtcattctgaaaggagtataagccaggcttttagatcctccctccctccctccctccctttcttcctccctaccttcctttccccctccctccctccctctcttccttcctttcctcccttcctcccttccttcctccctcgctccctccctttcttccttcctttcctcctccctccctcccttccttcctacttcccctccttccttcctggaaggtgtgcgtgctgtgctgctgccccagcagtgtgccttaagtcacagtgccaggatgtattaggccacagcctttttctacaacagatctatttcatttaaggtctgccagttgtctttctgaaaataggcctcaacgttttccccaaatactcttgaaaaccatctgatgacatttgagcatattgaaccgggctgagaaggctgcctttctctactgcctagaactgctccccaaactctagtgtttcttttttgaagacaatcactgaaacatgagatactgggtctcaattaagtggggttatttaggaagaaaagaatagaaaatgagaaaccaacagccacgtgacagggaggttactctgaatataattcaaatcctttgcagctttcaggaggaaactcatagaatatattttggtggcttacacactggtgctgaataacttctttgccacttaattggaaaaaaatatgacattttcccagaagactgaaatcattaagactgtgcctgttccatgggatcagttccaagaagtctaatatgtttacgccaggagctggcatccgaaaggcgtccctcttcacattgagcttttggtgtcttaaatggcaaaacattgatagcttcagccaaataggttgctttggggcttctattttattctctgtccagaatagagcctttacatgctttatcttcattctctatacgtctatgtttctttatgttatacctgcattatcatgctactaagttatgtataagatgtatacagaaatatacattttaaagagatcaagtaaagataaaagaaactattttaaatatcttgctaatgataatgtcattaaaaacaatctcaagatgcaatattccctcaggagaaatttgtgaatgagtattagaggatgcaaatctgtacttcaggccgggtgcggtggctcacacctgtaatcccagcactttgtcaggctgaggtgggtggatcatgaggtcaggagttcaagaccagcctgaccaacatggtgaaaccccatctccactaaaaatacaaaaattatccgtatgtagtggcacgcacctgtaatcccagctactcaggaggctgaggcaggagaatcacttgaaccctggaggcggaggttgctgtgagccgagatggtgccactgcactccagcctgggtgacagagtgagactcaatctcagaaaaaaaaaaaattctgtacttcacgtagtcttcttgataactaattttactggcctagttcttttcagttttgactggataatcactgattttattttgcaatgttgctgaccatcatctctactaagattaagagaagtgccaattctgacatcttgttctgtttgggcttcccttttaattatccttaatccatagtttattttataaaaaaattaaaacaatgggtcgcacttaaggagggttataaatccaggtatctttgattgtgataatgttgaaagctacagaacaagtgacagcaccacagacaaccctttaataaagctctcttgtctgggatatacactaaaggagagtgtcaatgccaatcatacattaaatcctgggaaggctacaatgtttacgttttagataacaaatttaaagaaactttctaatattttcttttcactctcgaaaagaacatcttatagccattttgaagactaatatttaaagccataactccaatgttattttttccagattatatttcctgttgcccaaagcagggtagaaacctttgatttctctcaacatatctctcatcttacccatacctcttttgagattgtcacccctttctacctcatggttatgtatatagatatcttagttcttgaacaagattgtaagcatgttgaaggcatggtccatggctgactcatgctcggttttcccagagaatctggagacacaacagtagagagactagccatggtcttacatatcacagttcttccaaaaatatacgtgtcgagagatgaattaatcaattcctttatctgagttgcaaataagcttcatggttttgagttttattttgtatgcttggttctattaggtatttccaaacaaaagattatgagaaagcatgtagagaaaagatggaaggaagaaaaaggtattcatttttttgaaggttcaaaataaaggtgacattcataatggataatcatttttgaaaccaaaataggcagtgaatgattatccgaaaacattgttcattctaaaattgttagcatgcatctactttcaacatgttactatcatctacgatgtagcctcctttcccttggctaaatcagttccaaatagaaactgtcaatgaccataaggacatatttttattgctcctcatttcagatgctggatattagagaaggaagtagtatgtaagttaaagaataactaaaaagtagtttattcctgtgagcacagatgctatagtaaagacaaaaagaattatttttaggggctttttagaccaacaaaaaacaaaaggagaaagaggaattcaaattgaaaactggaaaacattgttacaaataatgataataataaaagatctaaagaacaaaagagcagcttattttcaaacatagctattattttagaaacatggaaaataatagctgaagggctgggaattgtaggttctactctgtcttctaagagctgagtttgggcatcttttatagcaaccaattttccatacactcagatggctcccaaggatcactgaattgagatgtatgatttaattttcctttcaaagattatgttcagattattatgccacgcacatgataactaattgtagggaaagtgtgtcaggccaggcttggtgaaaactgcagaggtttcagctgtgacacactgtacaaaatgtaagcattcagtcaagtcatatgcattgcaaggccaccactaccagaaggtggtcttctactagagtttgggtcttgaaaactagaatgcatgtcaaccaactaagaagagattcttagtaggcataagcctatgttcttgctgcggtttctactttagcaatgaataggttaatgtcaccctgtctctggcatttgtagtcacccatttccatgggatgacacctcattctggctaatcttgtgttgatttgaaacacagaatcctacctcatccctcacttgacctagtctattgctttgaaatgaatgaagtcttaatttagagatttcagcctatctgtggtcaccatagatgccactcgcaattcccctccaatgcaattatttctcttttgtgggttctactcccttttctcttcctccctcttggccacattctcctcctgtgacctcatcttgtatattttatcttctctttctctttcttttctcactcttgtttcttttttattctttgtctcttctctttctcttctcccttactcccttctattctcctgctagttaaaaccagagacacttgttactcttacatgtgaattggagaggtttctgctcctgggtttcacagaagttttaatgctacccatactggtaagttttaattgtatggcattttacaacctaaacaaatttcccacatatattgcattttttatatacatagcaagtctggagtataggaatggcagagattattagccccaattacaaaaaaaaattgatgtgcatgcaagattgtgccttgaccaagttcatactgtcagaaatgtgtagagtaggggtcaatcaagcctggcacttctaattcttgtcccatatttatactattccagtttgccagtttcatttattctcttaagggccaaaaatcgacacacagcaactctctttctcttgttttaattgtaaaagagtctagtttaccaagacactttagaaaaagtgatatcacttccatgaagggttttaattcacccatacaattaacagttgttaatttgttatgcgtgtggcactttgctatgctgtatgatggataaaaacaagaataaggctggggccctgctgtctgcaacatagaatgactggatgaaaatgacaccccagtggaaagaccattttgggaacagactcttttccctattagatcttaagcttcatggatgcaaaataaaatgtggcttattcacccacgtatttgtttattaatttattcattaaatttatttatagtgcacttttaccatagaccaggagttttcctaggcatttgtatccataaggcttgaaatcaaatagggaaaagagtaaagttaaaaaaacaaatgaacatgtaaacaaataaatagtaataaggtagtttcagatgctaatagatgtaaggtgaaaataaaactgggtcatatgataaaatacttgttggtgtggggagaatattagttgaaggaaagaataatgtctgaatcaagcttggaattgaaagaagaagttatgtactaacagtaagtgaacatgaatgacaaaaaagacaactgttacatttaaagtccagttggggttttaaaaatctgacccacagagatttcccaaaggagctaatttctctcttcaataagtaccataaaccatacataattatattaaaagataaaactaagtaaaatgagacaactgcataaaaaatacataatcatagataatcagagtgggcatgaatcatgatatttcacaatcacaaatgcctttgacctataccattatagaaactaatagttgaatggaaacttgatggtcaattagtctggggtctctcaactgtggaaataatttctacaaactccatgactaatagctgtctaatttcgcactgcatatttccacattaggggcccataactccatgggatagttttctttttgctagattgacagctttaactatcagctatttctttaaattcaacaaaaatctgctgaattcctcaaattggtcctagatctattctctggaacaacacagaatccactggctacagtgcatcatatatcagctcttgtcacccaggctggagtgcaatgggaccatcttggctcactgcaacctgtgcctccctggttcaagcgattctccttcctcagcctccctagtagctgggattacaggcatgtgccatgacacctggctaatttttgtatttttagtggagacagtgttttgccatgttggccaggctggtcttgaactcctgaccttgggtgatccacctgccttgggttcccaaagtgctaggattataggtgtgagccaccgtgcctggcctcaatgtttctttttatatactgtgcatgtatattattttcatgaaatacaatcctaaaggaaagagagtatattaatttaaatagtttagcatattatatcaaccattgtattgagtggaccagaactgaaaatatgccttttgtcaaaaactataagtctatataagttacatatgagtatcaaataaaattatatgtatggacctgaactatggcaaatttttaaatagtggatcttagagcatgtgcatgatctagacctgcactgttccacgcaggagcccctagtaataacatgtgtatattttgtacacacatacacacatcacacactagtattttgctaacgcgcttttaactgataatttcaaatgtttctgcaagaggctttgatgtcaatgaaaaccttttagtcatttgaagtaaaaatatttttctattgatataaattatttcagcattgaattttattaaaacaagtatgataaaggttgtaaagtttaatttaggcaccacattgtcaaaaaatacgaccaagttttttagattttgtgttagctgtgttcctagaacatctgttatgctattatgacaggtgtttattaatatggatgtctaatcaaatctcttggttgctaatagcttggcaattcaacatctaaatattgtcaaaatccttgattatatgttgaaaactgtggataattgattcaaagctgtttgccttgactagattaaaaaattaaaacctgtcaagtgtattaatactttcctttaaaacctcaacattctcctgaaatttctaaaatgtttcagtaataacaacttgtgaaggaataaaagtcttctacaggccaacatctgtcctgatccaagtttccttagacctttcattatacgcataattttttttttttatttttatcatgggctaggaatgaatgcacagaaggggagtaacaaaatgaaagtcctacgctacatacaaagaatgccctacagaaacgtgttttgggtgcatttaagctcagatttttaaaattaaacttttttgaaagtatttaataatttctgaatagtagaagcctgcaagaagcaatttggtggccttcagcaatgtggttgagtagcttcaatgggtgccatttgcagctcagttactgagctggaatttccttttgaatgtacaaaggcattacataaatctctaggaaggttctgtggtaatagcattcaatggaaatctttaaaattcttaaataacgattatagatttgaaaagttcccaatttatttccctctgacagagtagttctctcacttctatgagatagtctgccttttagtaaatgctttaatgactataaatgtgtttttggtctagtataagtactgtccaataacacttttgacaataatggacatgttttccatgtttccactgtgataaccgctaggccaatgtagctactgagtacttgaaatactttttacaactaagaaaaaaaagtttacattgtatttaactttaattaatttgtacttaaaaagccacatttggctaggggctactgcatggaacaatgcagttctagatcacgctatataactttttgatttgccaggtgcggtggctcaatgcctgtaatcccagcactgtgggaggctgaggcgggtggatcacgaggtcaagagagcgagaccatcctggccaacatggtgaaaccccgtctctactaaaaatacaaaaattagctgggcatggtggcgcacgcctgtagtcccagctactcaggaggctgaagcaggagaattgcttgaacctgggaggcagaggttgcagtgagccgagatcacaccactgcacttcagcatggtgacagagcgagactctgtctcaaaaaataataataataataataaaataaaataaaataaactttttgatttaataaaatttactttattggagttcaaaatgatgctaaatgatttttaaaaatacatacttgagctagaattccttgattctatcaggagaatattaaccatatcaacacctaatagactagtctttctaggcattgtttgctgtggtagaaatgaaaccactatagcaacagatagttcattaaaatagggatatattcagaatattgtccacatgacctaggagtgacaaactgtaacttccaagctaagttaggacaccacttgcttttgtgaataaaactttattggaacacagccacattccccacactccttcatttatgtattgtcaataagtgcttctgtgttacaatagcagaattaagtaactgtgactgagattgctgggttgcaaagcctaaattatatactggtctttccatagaaaaagtttgccaactttttcgttacctacataaatagcagaattaagtaactgtgactgagattgctgggttgcaaagcctaaattatacactggcctttccatagaaaaagtttgccaactttttcattacctacataaatgcttatgtgtaaatattaggataaagtcccttttatggagaagcacattcttctcagttcattcaccatacttaacacatataacacacattgctaattcctgtatcttttcatatatatgtaccatataacatgtaatatgttagatatgaaattatatgtacatatatatgaaaatatgcagcaatttagcaagtatgatactaaatatatatgttaaatatttagcaaataaacctctatgtgctttcactcagatcacgggaatttaatgcacaaacaatgatttatagcatctgttttctaatttaagttaaaggtgtgagctaacatgtctctccctagatcttgataatcagatagtatcagagctagagtggaacatgaaagtgcattccaaactcattttagagacaatagttgggagatgcctaaggacacaaagagataataaccagttaatcaactatttaatagctcatttattgagacacacctatttatgtaaccagccagaaggcctagtagttgttttgtaccattcagaaagacagtgccttaagagcccaggctgcagactgggagcaaaaccctttgtgttgtcacagtggctgtgctatgaatgacatatgcccttacttcaatccaacagggaagaaagacgattcttccctggaacacttatggtctatcatttagtgaaagaagcagttggcaaaactcaccaataatctatctatcccagagaagagtctctatctgctccattaagcacctgtattttaggctttattatttatttttacagtaattttgaattgttttgaagactgtctccaaaatagaaataaccccacttggattactgtctaaagagtgagtctaattccattgggattctttttaaaaattctattcattgataggaaaaaaaatctttaacttaaaagctactttctgacctcagtagaactagtccctatttttccttctttatacaggcaacatatcataaaagagatgtgcttctattctcatctaaaatattaagttttaaggtaaaatatgacagtattattttcataagatattttcattaaaatcatcatagatttctgggtgtcaaaaatagaaattacaattgaaattaaagtataatgacagaaatgtaaatttcaaattctgcattagtataacctctaacctttaccagaataatctcacttatcagatacttaaataaaaactaatatctcaacttagtatatttttctctcccttttttcaatctaacaatatggaacttgagtttataatacaataaagttcaccatataatctgaactacataaatgcctggactatattgccttttcttcagcaacatgtgtcgatttagacctttgattggattgtggaatgcagtaacagaacaaactaatcattacaattacattatatcatacaaccaagaataatttataatatgcttcttgtactttttggaatcattgttctcataccagtgtggtgccttattaatcctatgaagtcagtcatatggtgataaaacagatacaaaagacttgccttaatatgttattattattgacttagctctgaccacaccacctgatggacaggttccaagtaaagacctagatagtcaaagtgagtactattagtagacttgaaacatttaatttctgttggaagagatgactaaagctctccatgaattctttatttatatcacaatctgaaatattattaatattattgaatgaattttatttgaactggaagaaaaaggtaaaaataaagtcactatagtgctatagctgtgaaaatttggctgacttacaaaatggcagtgagttggtgaattaggacaagtggcttccagagactaaagaacctctaaacttttatcatcaacaggcacatttaggatggatcatcctaaatatcacttaatcatgtggccaaacagaactattgttaaccgacaaaatgctatgcattgaatttctggtttaacaaatgagaaaatgggttttgtttacagtggcagttcagaattacatacttataaatattgaggttagggtctattaatgggctgtttggttctaatcatctgaagaataattcattttctcacagagatacacatgatttgctttcatatcctatacggcctcctttatgtttattcaattttgttatcatagtgaggtatatgaaagcccatgagctcggaaggtactatctttgcatcatcttaatcctttggccataaaagaaaatgattggtcctatagaggtctcctcaacttcgtccagaaacaagtgtgacatgatcgaatctctgtcatattatatacaacttacaaaagatatacatacccatagccatgaggcgcaagtgcatatctagttctatatgaggatacagctcaaatacacacacacacacacacacacacacacacactattttattggctgacaaagaataagtgcagaagtatcgagtatataaaatcactaattatgaatcaggagaactgtttgtattcactgctttttagtttagttttattcagtaaagcattgtactacttaacttgtttttgaagtttgcatacaaacttcgtgacatacaaacaatgtgaaagcattgtaaattttttcttaatatacatgcagtattattttgagaaaaataatgtcaccctcagataaacatccagatggttttacaagcacaattatgacatctattttaccagtcattctttataagcactcacaattcaggtagagcaattatattgcaatattacttacttattacataatcaacacttctgtttgtatgaaatgtcacattacatctaaagccctgaaatgcaatgacctacagagaataatcaattgtttctcaaaccgttcactctataaaatatattaaattttgaaaagaggaattatcttttctatctgtaaaatgagagggtggagcaagaaaaacttgcaagactttttagttgttagatatcataatttgaagcctttttctttttcaataaatgattcctcagaattacatagactacatctttgaaggaaaaaaaataggaagtgatagatgatcaatcacattcacgtttatggtgggatatatttattttctattttagttataaagaaaacttgtttccattttcagctatctgaaaccagttagagagacagttacacagatgatcaaccatatggcattaataaatgtataaccaagacagatatgaagcattttatattttaaccaaatggctaaactaactcatgaaaatgtcatatgttatctatttagctgagagctttattgcagagaaattgtgtcataattaacaattaccacaggaccagccatttcattttataattacttctcaaacaaattaaggaagatgaggttttacccacattcagttacagctacattcaatttcataggtaggaatatgtaaatgtctatgttttataaaaacaactcagccagctctatcagtagtatttacatagaagattcaatgggaaataaaatcactgtaattaagtatacataatttttaaatagatcagtgttgtcaacctatctttcgcttgccttcatgttgaaggatatagaatagaaatgggaatcagatcccccccaaaagtgggggatcccacttctcctactgtagcattcccaagttcgtcttcttttgcctatatttgtataatggggttatgcctaaagttttgatttttaaaatgattccaatgcttctgacataaaaaaatctgttgctgaaatacttgaatactataatatattaaatgatctaagtaaacataggactacagaaaaaagaatatgagaaaaggatcaaaaggaagtaactgataaaagtcaaggagaaatcaaaatttaaataaaagaaatgggcaaaaaaaatagttaaaaaattgcttagtgtagtttgatgttcctgcagcttcaaagtctataaaatgaattacagtgaagtaggaatgttaactttttttgttttctgtctacttagaaatggaaatatttagcataattagtccattagtgtttcctctattttatcgctgcagtattataattaacacaatattacattcagtatagatatgagaccaacttatttacctcagaggaattacaatggaaatagattgagttctccaatgctacctgatttttaagcatttaaaacttaataaaatacatgtatttcaaaacttattctttccttcatcacaaaatactcatcatcaaaaaccatagttgaatgtaattttctgtatttcaattgtgtcaataaaaatggcaaataacagcaaaacaaattccattatcattttaaagcttataagatcaattttaatttgggataaaggcatcccttgcatgcatctatcccaggaagctaagtgcaaaagtgcaggagggtagacttgagctgaagaaagtggaaggtttggccaaatagacaggagggagtggctggcacatatgagttcctgggaagagactgcttttgcactctgggaaaagactgctgattttatcagaacagagaccagaggggtgatggacaaaaagttggagagtagagacctggaaagcctgcaaggctgacatgtttagggcacctgtattctcaacactcttcaaccaacactgaacattcctgcagaggaaggcaactggaaaatatttaagcaggattaatttatcttacattctggctggtaaactttctgatgctcagggagccctagttagcctcagagataatttgccaattgattggaatatttcacatgcttgaagcctaaacacttgctgatgatctgaatttttttttttttttttgagatggagtctcactctgtcgtccaggctggagtgcaatggcacgatctctgctcactcactgcaagctctgcctcccaggttcacgccattctcccacctcagcctcccgagtagctgggactacaggcacctgccaccatacccagctaattttttttgtatttttagtagagatggggtttcaccgtgttagccaggatggtctcgatctcctgacctcatgatccgccctccttggcctcccaaattgctgggattacacacgtgagccactgcatccggccgatgatctgaattttattcatggttgatcactgactctttcttgatcactgactctttcttgatcttttgcttaaccacccacagctcataagtatctctgttctctgcccacttagagtaatcgtcacttttgtaaacgtctgtgatctctatttgtcacggacatgacttaaagacagaacgtctggtctacatattgtttgcacaccccgaaacatcgaatataagaattgtaggtgctaaaatgctgttaatacttagactgactatatcaaacctactaaattaggaacttaagaggctgaatttatccaatctttttttaaatggcagaagaatcagtgatactgaagagcaatccacatcctcatgtcttataggaggattgccaaactggaggaaattgtaactactatcaggggatttgtgtttgtcgttattctttgttatttaaaatgtgaattattgctgtcggtacttataataatactttgcaaagaatttacattaaaaataacgaggtatttgtaaatagcaatatgttgaaaacaagcagtgaactttggcagcattcttactgcttcattcatatttgcattatttataagatgctaattgggctctactctaaaggagaactctaaatatggtactccacaagagttctaatttagttaagcccaaacaacaaatattcatagagctctcagattctgaatattccatgttgggcaaaccacagtattagtgtccaaactgagacagaaaaacaaaacaatactaaacttagaatatttttagcttgattgaatgaatacttcaagtaacatatcttttttccccagaataatctggaaattccatatacaggatcttggcttttttttttttttttagatagatagggtctcgccctgtcacccaggctggagtacaattgtacgaccgcagctcattgtagccttgacttcccaggctcaagagatgctctgccctcagatcccaaggagctgggactacaggtatgtgccaccacccctggcctattattttatttttatttgtgtagaggtggggtcttgctatgctgccaaggctgttctcaaacttttgggctcaaacaatcttcctgtctcagcctccaaaagtgctgagattacaggcttgagccaccatgcccagcctcgaagatgtctttcataaacgtaaggatttgatttttgactttgaatttccttggactagttgatgacatgttcaaccttcatatgctgagttctcctcactttcaaattacttctcaaataaatagcaaaatctccagtagctttaaacaaaagttatatttcaaaaatgaatgatgtatagttatcttcaacctatgcgcaaagtacaaggttgagaaggacttcatttttgctttgatgaaaggcaattccattcatgattctctttaaattcttcagtattaacatctaccaagaaaagaattcactgttccatgacctgagatgcattaaaaattacatgtcaaatctactttacaggcaaaggggaaagaggaactgcatgtgtcctatatacacttgctttaccagtagcatgacacccaggatatgcacatgacacacacacacacacacacacacacacacacacatacacacacacaccaaaagcaaccaagcttccttagcaagagatacacaattgcttaccatctgggttccagatatctaagcatatcctcccatactaaacacttcttaccacacaaacctttgatgctactatttggacaactttactcctatatccccttgtggtctcatctttattatttagctgtttccatttccttagcctataatcgttatccttgcttctccacctagttaattccaatttatcctatgccattcattgtttaatttccacctcttctctaaaaaatgtgaggacttccctaaaataatcagttgctccctcattgttttcccatatcacttggagtagaacactgatatcaacccatatccagttattttattgttgttttaaatagtgtgtttgcttccttgctagaattcgaacacctcacggaccaagtcaaagtttttaaaccaaccatctctagtacttagaacaaaacatatcatgaactttgtacataataaatgtttttagaaagcctttcactacctattttccatgtttgcttaaaatactaacccagtcaaagaattataaaataaatattaaaaatggttttaagtagttcgtggaattgcaatgtttacttatgttgcaacagaggaatcagtcacaactttgcatttagtaaacatttttggaaaatgtagaaagttttgaacttgttacttatctgttaacatacatacctcatgagttttaagtggcaaacagagagagggagagagagagacagagagatacagtattgaagcagaatgttgactcatatttacatcagcaaattttaacttagcacctggtctctctatttccagtaatgaaaaatatggaggtgaaatacattgctctcttactaaagaaatatagatattagataaattaaagtatgcctatgaatgttacaacaaattatactttaaaagtaccagcacaaatgtgttcagtgatgaaatgttgcttgaataaagggatttgagttctccctagacgtattgtgaaattgcttcttgaagtcttgctgagtctcacttcctcacccataaaatgagaagatggtctacagaaacttttaggccttttaaatatttgaaacataactcttgataaataaagtaatttacacaaaagctgaattgctagtgcactgtcgcagttccccaagtctccttttagaaaaaaaattacaagcttttatataacggagaaaaatttctacacccatatgaaactcgttctacgatattttaaccaatacaaagtttatggtgactattcagaaacatttcttctcacaaataaactagagtcagatagcttcttgttagaacaatttggtttagtgtgagtcaaaagtatgtagctcctctagttatcacagaaacttataccatacacattttttttttttttttttttttgagacggagtctcgctctgtcgcccaggctggagtgcagcggcacaatctgggctcaccgcaagctccgcctcccgggttcatgccattctcctacgccagcctctcaagtagctgggactacaggcgaccgccaccacgcccagctaactttttgtatttttagtagagacggggtttcaccgtgttagtcaggatggtctcgatctcctgacctcgtgatccgcccacctcggcttcccaaagtgctgggattacaggcgtgagccaccacgcccgaccccatgcaaaacttttaaaaaatcaaaatttacccaaagtcgttgatacagtttcatagattgataatggtttgaaaatgtccatactttgttgtatgaccgtttaacaaaatgtaaccattctctgtaaagatgtgtactgatctttacacatacagttcagaaaaatcaacatattgacatacactttcatgaccagtcaaattaagaaacaatcactgaactctttttcctaggtaacatatgaggtcaagactaaactgtttgataatgtaaacaatggctggattaagaaatggaacataggctttcagagatgagtggcagacctggggaactaattaaacagagtcaaatgatgaaactaatctatgacaagcctgaaataggctaaaacaagttgcacgagtaaataaaagtattgcaagtcaagagacttaagaatcagtgatacagagagcagaaagctagatcctctgcagtcagcacccagcttgataatgcatcacagctggaagaaaggggctgctgattatttacagatcatgatttctaagccatagtacatgaaaacattcccaacatgaatagcaatatcttttatgtttttaaatactaaatctagcagtgacagctttgcatctatttgaatgctttggttaacagtaattagttaagaggcaatattggcttctgcaagaatgcttattttaaaataaaaattctgccaatggccattatgttacatactctatttgcatttgtccaccattgcagacatctcacatactccagagtgaactggagaagctctctcagttggttagagcattgggttaatgaggacaaggtcacagatttaatcccatacagcccagttaacttggcagagaaaaactttgctgcacaagctctagctgctatttcagcaaaacccaattgtaaattcatattgtggatcacaggggaagcttgggaaacagtggaggtgatgaaaacaacccacccatcctgtttcctggaaaacaatgtcaaacacccatgggtcaagtcagcaattgctcattttatttaaataataccacttttttcctgaatattgcctagccctgaatactgttggaagatataaattcagataaatgtgttttacatcattgaatgtgtttttgctcatcatctactatcttcctcacatctatgctttgttcacctgtatcaaaggagtaattcatacaccctaagcagcaagttcaacttgcatcaggcagaaatggtgatttccaagggtataattatgtaaaatggagtacattttctgagcctcagatttagaggaaatttttcagcaatgagatatatcaagccctactaaaaacagacattttgctccctaagcattacaaataagagacatcctatttcataaaagactcataatttaaaaatgtgtctatgtgatagattagtgaattagctgcaacaaaatatcctacatgaccaggccaaatattagaagcagcacatatgctgtacagtatgaacatacacacacactcacatgtgcacacacgcacactcaagctaaaaatcaaaatgtgagtgccattgtctaatattagtttgttttacatctcccccttcagtcacctgttttgaatttttgagagcgtatcattaaagatcctaaagaaccagaggaacaaaataaagttgctttaatgaagttagatgaactagctccttctgatttctagctctgtcactgaatgtctgtgtcatcctgctttatatgtgctttagatgaaagactgtggcatctgcttcgtataggagaaaatagagttaaagggttggctcaagatgccagtcattataataattcccatatttaatcctctatgttcctaaaaggctttttatattaatgtttactttgattaaggtatttaatcaatgttttcattgaactgagttccatcactcctaaagtttttatccctttcttccggtttagtctcgattgttctctaaagcacagaaaagggaagatatatttaaaacttctatcaaaacaaagtgaaagagtagaatcattagattttttcaggaacatctgcagaacaacaagggccaaaaatgacttcaaatgacacataaaaatgtctcagtctaaaatattggcattctgctaggccctatttgactgataagtattatgcattttcctctgtctctttcacctacaaggctgagcaacaaactgtgtctagagtttcttcattttaatattcttgttgttccatctgggtcatttattaacaaatcccacaaaagtgtatttgagtcatcttattggtcatcttattggtgttattgacacaagattttgaagtcgcacaataaatgagaagataaatcagtttaaaaaatcacccatggttgagctctaatataatcagatttaaatactactgtatgaaaatggtgcttctaagtaatattgtaaagtttaaacaacagtagtaaataaatattagcatttctaggggttattttttctcttaagttcagatttgttttttattataaacactgaaataagtcaaataagttaaatagataaaataaaacaaatggatataaagtctagggatttaaaaaatcatcttattaattttttagctgtggttttatttcataaggtattataaagaaaataattgcaatgtgaaaaatcagttctgagtttgctatggctctagtttttgtggttgtgtgacattaggcaaattacttatgttcttgcagtttcaatttccaaacttgcaaattggaagataaaaattatactaaatattataattaacacataagatagtcacacatactaggggctcaaaagtttagtgatcattttattaaggtgaatatattaataattgtgttttatgcatatttaacaattagtcttattgttgttagtaacactaggtccaaaatgaagtaatcatcatcaacaacaactaaaagcttaaatgtctgtctctccctgtgctcaccctatgtgctcccatgaaataaggtcattgaataggctatgccagaaatgtgctctctactggtaatttttcatcttgtgaatgcttccttattaattagatctcctcataattgtccctttcttagggaaatattcttgacctccctaagtcatcttgttttatttttaaaacaaaaataagagcacttaccactttgtaatcttgtatttacttatggttcacagtaaaggaagactcaatttaggattacagacacaggctccagactcagcaacactagtcatagcaaaaatgaggctaatatttggtttataaatagtcaacgccaccccactccaatttccctcctttatcttggctcaaaaaatactgacagccaaaatttatctctcaagccaaaaggcagaaatttcttctttgaagaaatatggaaagcatattctaagaattctctaactgcttacacaaatgttgacaatgacagattaaagcatttagagtcctccagtttaaaggacagattcatcctactcattctttgtcaagtgagacagacaaaacctgcataagtatataggcccccaagtctgcctttcttttacttatacttaaatatgaacagcgatccaagcattaccatacatttgaagacagccttcaacatggaaaaatcagttttttaaaaaagggaaaatggactgtaaactagtgcaaccatcgtggaagtcagtgtgggaattcctcagggatctagaactagaaataccatttgacccagccatccccattactgggtatatacccaaaggattataaatcatgctgctataaagacacatgcacacatatgtttattgtagcactattcacaatagcagacttggaaccaacccaaatgtccaacaatgatagactggattaagaaaatgtggcacatatgcaccatggaatactatgcagccataaaaaatgatgagttcatgtcctttgtaaggacatagatgaagctggaaaccatcattctcagcaaactatcgcaaggacaaaaaaccaaacaccgcatgttctcactcataggtgggaattgaacaatgaggacacatggacacaggaaggggaacatcacacaccagggcctgttgtggggtgggggaaggggggagggatagcattaggagatatacctaatgtaaatgatgagttgatgggtgcagcaaaccaacatggcacatgtatacatatgtaactaacctgcacattgtgcatgtgtactctaaaacttaaagtataatttaaaaaaaagggaaaatgactattggggaagcagagattactcaaagaaaaggaatagaagttaaactaaacccaaataaaattctccataccaatattgctaagatgatttatttatgaagacagtgtatccataatacaggtatagggtgcagtggggaaaaaaacaaacagtgaaagaacaacaaaaaatgaaactaaaaggtactttcagtggaagaattggaagataaaatgaagaataggaggtgaaacttttgagaaaaaaagctaagagacatatagaatcaatacaaaagatccaacatataactcaagaaagatagaacatttaaaaagagatagaaatttcaaggaaataaaagacatggaattcccagtgttgaaggacacatcacaattttcctgcattcttacatagcttctaattggcctttttacttggatatttgcttcttacatttatttatcaatataggagtaaccctttaaaaaatgtaatacagagcagtaaacatctttgctcaacccccgaaatgctcccctgaaatagaggaaaagtgagagtcctcactggatctgtccccaccccaatccccagccccaatcacatctctgacctcatcttttaacactttcacctttgcttactccagtctcaaagatcaggtacacttcccaggtaggatttcctcctctaattctgccttctgcttcaaactctatttctctagatatctgtgtactgaacttccttatgtacctcaaatattgtttaaatgaagtctaactgatcacactacttaaaattataacctacaaccagcaagaatggtcttcctcaccctgctttatgttttcatttccccatagctttcttaaatgtgatgtaatttatttacttactgtgcccaatccttattatttgtctctgttcaatgggatataagcttcaggaggtcaggaacatttgtagttttcactcattattttattccatgagcttggaacagtgcctgatacatagaaggtgccctgtaactatttattgaatgagtagataaacatacaaataaatgaagaagttcttcatgagtggcacacaactttgaagtactggaattataaaaaagaaaatgtaatctttgcacaccactcattgtaatgagcaatgttcatagtccaaataataattatggtattacagacttttcaaattatagaatcaggcaattgaacaaagcatgaatgacataattacagctatacaaggaggtgaaagatctctacaagaactataaaatactgttgaaagaaaccacagatgacacaaacaaatggaaaaacattccatgctcatgggtagggagaatcaatatcataaaatggccatactgcccaaagcaatctacagattcaacattattcctattgaaccactaatgtcatttttcacagaattacaaaaaaactgttctaaaatttgtatggaatcaaaagagagcctgaatagccaaagcaatcctaagcaaaaagaacaaagcagaaaacatcacattactaaactttatactacaaggctacagtaaccaaagcagcatgctactggtacaaaaacagacacaattgaaacaatagagaagccagaaataaaggtgagcatctacaaccatttgaacatcaaaaaaattgacaaaaataagcaatggggaaaggattccctattcaataaatggtgctgggataactgtctatccgtatacagaagaatgaaactggattcctagccatcaccatatacaaaaattaactcaagatggattaacaacttaaatgtaagacctaaacctatgaaaatcctagaagaaacctaggaaatacctttctgaatgttagccttggcaaataatttatgactaagtcctcaaaagcacttgcaacaaaaataaaaatggtcaagtggaatctaattaaatgaaagaggttctgcacagcaaaataaattaccaacagataacctacagaatggagtaaaatattcaaaaattatgcatccaacaaaggtctaatatctagaatttctaaggaacttgaacaattgaacaagtggagaacaaccccattaaaatgcgggcaaaggacatgaagagaaacttctcaaaagaagatagtcaagcaaaaacatacatatgaaaaaaatgctcaacatcactaatcgtcagagaaatgcaaattaaaaccacaataaaataccatctcacataactttattatgtgtctcacatgactttattaaaaagtcgaaaactgatagatggtggtgaggatgtagagaaaagggaacacttgaatactgttgaagaggatgtaaattagtacagccaatatggaaactcgattggagattcctcagagaactaaaaatagaactataatttgacccagcaatcctattattgggtacatgcccaaaggaaaataaatcctaccaaaaagacatgtgcactcatatgttcatcgcagcactattcacaatagcaaagacattgaattaacctaaatgccaataaacaatggattggatgaagaacatatggttcatatatacatcatggaatattatgtagccataaaaaagaatgaaatcatatcttttgcagcaacgtagatgcagctggaggctattatcctaagctaattaacacagtaacagaaaaccaataccacatgctttcacttataagtgggagccaggcacactggggacacatggacataaagatggggaaaatagacactggagcctccaaagttggggagggagggagagagggagtaaagggttgaaaaactatctactgggtaccatactaactacctgggtgatgggatcagtcatactctgaacttcagcatcacctagtatatgcatgtaacatatctgcacatgtcctgaacctaaaagttgaaattttaaaacatgtataattatgattataaaataaccttgcagagtaaaaatcaaggtacacttgtaagatttggaaggtagaaagtggtcagaaaaggattaaaaatggcaagacagctaccaggtcctaccacacaaattaggagtccagatgaatcctgttctcatagaaagctgatggttaacaaaatggttactaaagtattatttttaaagttatagaagtagctggtaaaggaactgaaaaacattggtataaatttatggggagtcaaaaggcaatgactgcagatgaaaaattatgaaatagaaagatatttagttaaatctaggtaactaagagaacagctaaacataaaagtagctaaagtagtcatatcttggaatttagacagggacagggaaggtgtgagtgggagaggacatttttaaaaaatatatccttacatattattagatttttctttagtgcacaatatttctttgatttttttaaaaaaattatttgaaaagtaaatggcttagagaatgcttaataattactaacctaactaacaaacattgtttttcttttgcatgtgaaaaaaccctttgattaaattattttatgaattatgtagaggtatttttaggtgaattataataaattataactatgaaattaaaacacaaaaataatgttaaatttagaatgcttgctactagtcatttatcctgagatgaaagcaagcatgacagatttaaataatactgcagatttttttttccacagtccagtggttgaagctacggtctccttaaggcagggcaatgacagacatggaaaaactgtagcttgacatttattcatttttataattcatttattaatttattcaccaaatgtatgttgtatgccagatattttccaggcactgtgcaacattttatgagagaactcacacaaccatgttctcatttctaagtaatttatcacatctaaagccataggtcaggaatttaaaaagaaatagctactgcatataatcatttgtttcatgaaatataaacatgaagatactattaataatacattaatttatataccgttttatagttgataaggcatattcatgtatattatttttcttcacaatggcctggtgtagttggtggtattcaatttctaatttacaggagaggaaatggactcagagaagtcaagggacttgcccaaggtcaccatgtttggtagaagcaaaacaaatagccacattcattgtactttccacaacacttcagctacttttgtttcattctgatgcttgggctcgacatgttcatctcatcctggttattctgtaggcctagttcaagtgctcctccctggaagttacactgattcagctcaggctgtaataatttttttttctttttttcttttttttttttttgagacgagtctcgctctgtcacccaggctggagtgcagtggcgctatctcggctcactgcaacctccacatgctgggttcacgccattctcctgcctcagcctcccaagtagctgggactacaggcgcccaccaccacgcccggctaattttgttttttgtatttttagtagagacagggtttcaccatgttagccgggatgatctcgatctcctgacctcgtggtctgcccgcctcagcctcccgaagtgctgggattacaggcgtgagccactgtgcccggcataattgtttgtttaatctggattctaaaccttttttttaaaatgcatataagtcttctaaatcttgtgtgcatgtatgcatacatgtatgcacatgtgctcatgtgtatgtgtgtgtgtgtatacaatagcactcattcagtttcagtgtgcttatgcactttcctggactgaaagccccccgagatcagggactggaaagactcaatcagtgatgctctttagcttgtatgttcccttatgaagctatgtttattatataggcttggaatggaagaactctggcttctaattctgactgattgaaaccttaaggctggattttctataacttcagacccaaccagatgacatttttttctatacctctacacgtcatagagagatatgtattaggaatcacagacttatataatgtcttcgctcctacttccttccctgcaatatgttggcaaagcctaggggcagttctggagcccggctgctcgcattcaaattccatctctggcatttaccacttgtgaggccttcagttatgaagatattttctccatgcctcaatgcctgcatctgtaaaatattaacagtatatacctcataggatttacttaaatgagttaagaaaagaatttagaacaggctttgaaatgatatgacaataaataaattataactatttttatcttcctcacaggtgatctagatatttgaattagatagtgtgagtgaacgtgaattgaaagtactcatactatttatattaattatattatattatattatataacaacaattgaaatttaaagttagaaagtgctaaatgacttcatgggaagcattacctgaaaatatttaaatgttatgcagtagagactgactgatactgtgaagttctcggcatacttctctattcaattttcatccatatctgattcattctactagagaattctgagaatgaaaacaaggaaaaatttgctgttgaatttctggagcttctgaacatttctcattatacagtctccagttcaattcttcaccattttcacctaacttcaacagcagcagcagcagcagccctgtgctcagtgacaggaaaatagcatgtttatttagatgattcaaaagctagcttctattccttacctttatttgtataatttctaacttcacactattttgaccattaactagttttagatcatttataaaactctaatttatgcactgtgagtattccagagaactcctttaatagccacttacattcaatttcctgtggcctagacattagctacctgaatgagaagggatcagttttagccaattaaagctcatgaagggaaaacagacaccacccgtaagcaaaacaagaactgtggattaaaaatagaaaatgaatggtgtacctgcaaatcagtaagtgttgtgctttccataaacatttaattatatgtttaaaaagtacattttactaaataagttactaattttaaattttaaaatagttaataactgtaactattttatatcactctcttttgttaaacagcttagagttaaatttatactccacatttgaccagcgtgcagtgtttggggcattcatttttatgtttgaatctcagtgctatttaataaccaaatatttttccttcctttgcctggcagtcctcacctatttcaaatttaaagaaaatctgtttaccagcatatctttgtagtccaaattatatatttcaaaataagcagggagggtaattagatggataaatagaaggtgagtgcatttctgaggagtttgtgaagccgaaaagggtacaggtagggaatgaaatgagcattccagggaatagtagtatacagacatggggggtctaagaaagcacttttcctctcacctccatcctcctttgggtggtattttggcagcctaagaatttagaataaccaaataactaaacaaaagttaacagtattatggtagaagcaaataatttaaataaacaaatacatatatacctacataaaagattgggaagaaataggtcaatattccacaaaagaggaagagggaatagtaggaatagagggaatgagggtattttttttttttgccgctggctttataataaatgtattatattctcagtagatactttgatacttaaatctttttaggtgaagtatttggggatgagtttaccttacacaaatttctttatctgtttatagataaaggattttcttttactttgggggggtttcttggcaacatttgagggtagtgaccatgtgtcacttatattcccatagcctagcataaggcctggcttatagtgagaagtctagaaagaattttgtgtaaaaggctaaagatggagtagaaatgaaagatgggcttattgtgaatgttaatttttaaggattacttaaaaactatcaacagaagttttctaaggagaaatataaatttatgaggtatcaaaaagaatacaacagatcctatacttttctttatcttttactttatatatacccatttactcttatcccacatacccactcaccccacaccatatttgtaacttagaagctcagtgaaaactaacttcaaatggtagaaggaatacatttagagtcaaaaataaatatctctttcacctctgcctgacccccagttctctagagaaaaacacctaaagatgttttatacatctaccagcatatggatttgtaacattactatcttctccagttaatagtgaataatattaatcatgcagtttaacctagtattttctcaaacagctcacggcagaatcaactggaaggcataaaatattctcaaatgctatactttgacattcaacctcagtaagtctctagacggcgaaaaccatgcatgtttaaaaggaccaccaggttttttttgtttttgtttttgttttctttttgagatggagtttcactcttgttgcccaggctggagtctcatggtgcaatctcggctcactgcagcctctgtctcctgggttcaagtgattcttgttgcttcagcttcccgagtagctgggattacaggcatgtaccaccacgccctgctaattttttgtatttttagtagagatggggttttgccgtattggccaggctggactcaaactcctggcctcaggtgatccacccacctcagcctcccaatgtgttaggattacaggggtgagccaccacgtccagcttgccaggcattcctgattacagtttgagaacaaccgtttttactaactccttggtttacttttattaaaactatccacatatacaaagttgaatttacttagcagttgttaaaagagaattatttggcctggactatattacagagacttatcatagaaatgcataaaatttatatagtagttccaattttttttttttttttttttttttttttgagactgagtctcgccctgtcgcccaggctggagtgcagtggcgcgatctcagctcactgcaagctccgcttcgtgggttcacgccattctcctgcctcagcctcccgagtagctgggactacaggcacccgccaccatgcccggctaattttttgtgtatttagtagagatggggtttcaccatgttagccaggatggtcttgatctcctgacctcgtgatccgcccatctcggcctcccaaagtgctgggattacaggcatgagccaccgtgcctggccagtagttccaaatttaaaatgacacagatatgaatgatataagaaaaattctagatttttatagaaaattactgctttagagcattttgcccttcagggtcagaatagttcaggactaaatttggttaaaagaataaacactagttaatataagcaacattcagattaattctgatctcttacattgaatccaagattttaagctgccaaatataatttgacaagtctctttaattagtttatgaagttaagctgttgccaagcttctcataggaatcataattcagcccattctctctcatttttctactgaaaaaataaataagcaattcatggaattaagcctcaccttaaccataaaatttaaatctaaacacagctttcataataatgaggatgaatgagaattaaacttatttaaagactttgccagtgcactacctggaaatacagagtaaaccatgatatgatacattctcatagcaaagtggattccagtacggtcaagaaaagttaatccatggtgaagtatcctgccttgcccttgtgttcatccctcatttgaaatgaaaataaatgccgttcaggaaaggcccttgttatcatcaacctctcccgtgttgttactgctgctagaaaagctatttctctagttttcagctggactaggaaaacatagagtttttttttcttttataccaaccatttgtaattgctatttttattgtgtatcaatttattagaaatgacacaacacaggaacagcccaaatggaaaggatgcataaagcgaaggggagggacagaccacaaagctcccatgcagctctacgtgttcaccagcccagaagctctacgcattgctttaaaaataacatcattgtctgtaatacaactccacaggaatacaagacaaatgtgcaacaaatataaagagatcaatagactgattctagaagtcactagtacagtttcatgtctatatgtaacccatgtataaaacatggtatggaaaacattatatgtatatgaaatatttgcttattaaggtgaattctgagcccatggatatctttcttacttgaagtgtgttccttctgatggtgatggcaactttctctgtaggagtaactgaacaacatgcattccagtggcaaggagtctcaggcagaggatgctttctatgaggatcagcctctctaacctcttttatgtttggaagacagtagcttcgtggctgcattgctgatacctacagtagaccccagcagactgactgccagaccaggagcctatgctgtctcattgtgaaaaaaaaatttgagcatttaaataacctatggtcagtaggatatacatttgagcaatggctttttcagtactgttacttgaaaattatggaaaataggacctgctgagtcaatttcagaggattttcataagaattaaattaagtaatgaatgtgtgagagctttcaaaattatagcacactttaaaaaaatgcaaattatcattattgttggaagaccacttgatggaggcatgaaaggatgagaagtttccctggatacctcaaaataataagagccatcatggcaaacccacagccaacatcataatgaatggacaaaagctagaagcattcccccttgaaaactagcacaagaaaagaatgttctctgtcatcactcctattcaacatagaattgaaaatcttagtcagagctatcaggcaagagaaagaaataaagggcatccgaatagaaagagaggaagtcaaactatccctgtttgcagaccacatgattctatatctagaaaatcccatagtctcaaccccaaagctcattaagctgataaacaactttgggaaagtttcagcatataaaatcaatgtacaaaaatcactagcattcttacacaccaacaacatccaagctgagagccaaatcaggaatgcaatctcattcacaattgccacagaatgaataaaagacctaggaatacaggcagccagggaggtgaaagatatctacaaggagaactacgaaatgctgctcaaagaaatcacagatgacacaaacaaatagaaaaacattcctactaggaagaatcaatattgttaaagtagccatactggccgaagcaatttatagattcaatgctattcctatcaaactaccaaggatattcttcacagatgagaaaaaactattttgaaattcatatgaaaccaaagaatagcccaggaaatcctaagcaaaaagagcaaagctggaggcatagactacccaacttcaaactatactatggggctacagaaaccaaaacagcatggtaatggtacaaaacagatatttagaccaacttaatagaatagagagtccagaaataagactgcccacacacctacaaccatctgatcttggacaaagctgacaaaaacaggcagtgcagaaaggactccttattcaaaaaatggtgctgggataactggctagccatgtgcagaagattgaaactggacaccttccttacaccatacacaaaaattaactcaagatggatcaaagacttaaagaaaaaaccccagactataaaaaccctggaagaaaacctaggcaataccattttggacatatgaacgggcaaagatttcatgataaagacatcaaaagcaattgcgacaaaagcaaatgggatctaactaaactaaacagcatctgcatagcaaaacaaactaagaacagaataaacagataacctacagaaggggagaaaatttttccaaactctgcatctgactaagctctaatatccaccatctacaaggaacttaagcaaatctacaagaaaaaataaaacaaacaaccccatataaaaataggcaaaggacatgaacagacacttttccaaacaagacatacatgtagccaacacacttatttaaaaaagcttaacatcactgattattagagaaatgaaaatcaaaaccccaacgagatactgtcttgcaccagtcagaatagctattattaaaaactcaaaaaataacaggtgctgctgaggttgaggagaaaaagaaatgcttatacactattgggtgggagtgtaaattagtgcaagtattatggaaagcagtgtgacaattcctcaaagaagtaagaggagaactgtcattcaactcagcaattccattactgggtaaatactcaaaggaatataaattgttctattgtaaagatagatgcacgtgtatgttcattgcaacactattcacaatagcaaagacatggaatcaacctaaatgcccatcaatggtatactagataaagtaactatggtacatatacaccatggaatactatgcagccataaaaagaatgagataatttcctttgcaagaacatggatggggctagaggccattatccttagcaaactcattcagaaacagaaagccaaatccagcatgttctcacttacaagtggaagttaaatgaggagaacacatggacttatagaggggcacaacagacactggcgcctactggagggtggaggttgggaggagggtgaggaccaggaaaaatagttaatgggtactaggcttagtacctgggtgacaaggaatctgtacaacaaatctccatgacacaagtttatctataataacaaatctgtacatgtatccctgaacttaaaagtttaaaaaaatctaccaatggatgtccaaattagtatgcgaaagtttgaggagaaacaaaataatttcatagtctcaaaatatctccttcaagatatttactaattataaaaggaaaaagtgtaactttacaggggagaaagccagcagacaccaccttaaccaaatgatcaaggttaattatcaccagtaataagacatactgacatgatgtactccctgatatataggctgagaaggttatatcactgtagcatgcctgccaaaaatgcataacttcaatccaataatgagaaaacatcaatccaaccccaactggcagttattctgcaatataactgactagtattctttaaaagtggcaaggtcatgaaagacaagaaaagactgagggaatgtcatagattggaggagccaaaggagatatggcagctaaatataaggtgagatccaattagtaaaagaactggtgaagttccaattaggcctgtttaatagtaattaatagcagtaataataacattaatagcacaaatgttaatttcatggttttgatcactgtactatggttatgtaagatgttaccttaacattcagggaagccaagcaatgtgtagatgagtgctctctgcatgttttttctaactcttctgtaagtcaaaatttgtatcaaaataaaaagtcaaaaactaacaaaacaaacaaataaaatgaaggatgagcaggttctttgctgtgttctctctcttcgatgttgacaataccttgcatctcatcactaaatatagattcctggaatcagcctctctctcactccccacatcaactagcatttgcatttgttcctttttttttctaaataattcttgaatctgtactttctggtctttctctattgtcatcctgatccagattctcataaaatagcttacaactgggatacctaactccattcttatatccctgaaatctgtcctgtctaaatagctgaaagaatatataataaaaatgaataattgtggccatttccttcttcaatgcatttcagtttcctgctcatgtcacgcttctcagcataacaaataacatcctctacagtgtgacccttccctgttctcaagctcctttgtcacattctctgtcttccacttatgctctggcaatacctaactacttcttcatctctaccatgacatgctattttgtatctctgagtctttttgtcacgctgtctcactgacctagagagcactttccatcacctcctccgtcaattcttagaggtagtaaacatcatccaggtagtttttcttgatgacatccgctctcaacccatttcacattctccagggcttctataaaactgcaggtttatttatattcatgaactttctatatttttaaaaatttattaatttatgtgtctatctcttctagatggggaagttcttgaaagcaaggtctatgtcatagtatgttcctatatgccagacacatagaaaaactcaataaatacttataaagcatgagaaagaaagtggtgggaaaagggatatgataaaccttatataaatgtaaagaaaaagaaatgactgagagatggaagaagcaagtaatttgtaaaatgaggttaaaatgaagggaaaggataattgatgagatttagataaagagggtcatatctaaaagataaatgttgaatggagaaatagaagtagtattaaaaaaaaatgagaatacagccaggcgcagcagctcatgcctctaatcccagcactttgggaggccgaggcgggtggatcacttgacgtcaggagttcgagaccagcctgcccaatatggtgaaatcttgtctctagtagaaataaaaaaattagccaggtgtggtggtgcatgcctgtaatcacagttacatggcaggctgaggcaagagaattgcttgaacccaggaggcggaggttgcagtgagccgagatcgctctattgtactccagcctgggtgactgagcgagactctgtctcaaaaaaaaaaaaaaaaaaaaaaaaaaaaaagaaaataaaaataatgagaataagtggattggagaacaggactattagagaataagataagaggagtagactatggaaataaaaggatgaaattgaccatctaattacattgaggccagagaagtagaagaaaataaaacagaaggtgtgttgacaagtaatctccatggaaagcagtaaacataaggtagctatccgggtaatgaaaaaaaaaaaaaaaaaaaagagagagagagaagagaaatctcagagtagttacaaaaagataaatgatttaatggcaatgctaagaaaaggacatgtgggggaaaaacacgaaaaagaaagtacaaaaatgtgacttggaagtatattggaagattgtcttaaatattgaacgctttgaaataatggatgcacattgaaccccaaattagcaattccactggcaatgtagtcattaagagagcactgtggagttactcatgtctttttttaggttaattttattatactttgtagctatattaaatgagttttgcccttatccagagcaattgcaattcagtatctgtcttttgctataacaaatgagccagatttgaaatatatactgtccttttctgtcaatgcactttaaaagactaccagtccccactgacctcttacagtgtatgattatacgaagagaaaaaatggaagaaaagcaccatgggcaaatgtcctgaatgctgtcagagcaggtgacacttatgtgatatgactcaacttgacatctctcagtattccattacaaatctgagagattatgttttcacctgtggaccgcagttgcctcaggtgcccagatactatccctgttcttcagcagaggtcagccaatactcactgttaaacaccagtcaaacacatggcagccagctggcaaactgacgctcctgaaatcttgaatctgccttttctaatattattttgtaggaggcatacctcaagggacatcaagatgttagttaattagggtgtgcctaaaaatgtaataggactatgctgtgtgtgtgtgtgtgtgtgtgtgtgtgtgtgtgtgtgtttgtgtgtgtctgtgtttgagatggagtctcactatgtcacccaagctagagtgcagtggtgcgatattggctcactgcaacctcccctcccaggttcaagcgattctactgactcagcctcccaagtagttgggactataggtgcatgccaccatgcccggctaattgcatctttagtacagacggagtttcgccatgtttgccaggctggcctcaaacttgtgaccttaggtgatctaccgccttggcctcccaaggtgctgggattacaggcatgagccactgtgcccggccttccattttttatccagaaaaatcaaaagcaaaccaaacaaatgtttatatttatccagaaaaatcaaaagcaaatcaaacaaatgcttatatttatttaaaacaacaccctttaatgtttgtttatcttgatttttttttttttagaaatttcttctcatttctggcaatgcagaatataatctcctcctctccgtacatgacccacatcactgaaactgcactttgccttttggctctcttctaatattatcccgccatgaattagctatctatgatgactattctatgctgtttttttggccaaaatgtttttatcctttttctgtcatcagctgttgactataaactttttcatcgtccagctatggcattatgtgggtttgccccatattctaagttttgtgggattctgtaaagaattttaaattccacaccagctctgcgctatggtttttctcctgtctgtttacattctgttttagagaatttgaagtaatttgaaaataacaatcaccatttattgtgtcgtcactctgtaccatacattttatatgcattattatataatcatcacagcaaacctatcatggatcttctttcctcattttaataatgacaaaattggaattgagaaagagtaattgatttgtccataccacagttagcctctaatgacaatctcaggattcaatagtggtgtgtgttggattccaaagccaacactcaatgagaaacactagaaaaacaaacagtagcactctggcattttccactatgcatggtacttttatatatgccagggaagattcaatgacagagataatctgatgggaggagaaacaacaacaactacaaatattacacacttagagttgctggggacattgttcatcacaattagagcagattttagagagcatcctatttactctgaacctaaagaaacaactcaaaaaccaaactactctatactgggaggaaatgacatttgcttccaatagacactcctgccacagtgctaggttttatctacctaaaccttaaaatattgtgtctcttttgctttctgttcaaataacataccctgaaaacttattgtgagactacatcctctgccccttaattgtccttaaaatgtagaacataggtgaaaacagactaaacaaaaatgttactgattgttataacattaaaatattctatgtagaaatatatttatttactttgattttggtatctctagtggcatcctaatggaaacttctttttaataatagaaggtgctctaactcctgcttaaaagtggaataaaaaaagaaagtgttcattgctttaaccctgttgctactatgtatttccaccctagagcagataagaatattgtggtagaaattcaaagctaaatttcctttttggttatattgaagaactactgaaaatatgagtattcctttttttcttctaggctactaagctctaatctggaaacaaaaccaaccaaccaaacaaataaaactgaggaaactacagctgtattcttcatagataagggatttcatggaacacctatacaatattctcattgccaggcctataatgatgatgttttatcttttattaagtttatctaagaggtatgtgtaatgtacaagaaagttttaaagagggagtggccaagatggccgactagatgcagctggtgtgcatggctgtcagggagaagaatgaaaggggtgagtaatacaatgccctcaactgaaacatccagttactcactggatgattacaactaatcaaggaaacaacttgacccacagagaacaaagaagggcaagacaggacaactgcccacctgggaacaacacagagcaaggagaacctcccccacccagagaagtggtgagtgaatgagctgccccaggaaaccatgcttctgcacagatctttgtaaccttcaggtcaggagatctccttgtgaacccattgtaccagggccttcagtctgacagacagagacacttggagtcttggaagagcagctgctcagccatatgtggagaccctggagccttagatacttgggctttccagcaaaagtagctgcaggtccagcaaagtgggaggttagacccccatacatacaatataccagaatctctgagacacagctaaggaagtgttaagagggaaattcatagcactaaatggccacatcaaaatttagaaaaatcttaaattaacaacctaatctcacaactgaaaaaattagagaagcaaaaacagataaaccccaaagctagcagaagataagaaataactaatatcagaagttaaatgaaggaaatcaagacacgcaaaaaattcaaaagatcaatgaatacaggaattggttttttgaaaaaaataataagatagataggctattatacctagacaaataaggaagaaaagagagaatatccaaataaacacaactataagtgataaggtaatgttattattggccccacagaaataaaaagaaccaaaaagaaccatcagaaactactacaaacatctctaggcacacaaactagaaaatctagaagagatgggtaaattcttggacacatacaccctcccaagactgacccagaaagaaattgattacctgaacaggtcaacaaggagctacaaaattaactcggtaataaatagcctaccaaccaaaaaaagcccaggacctgatggaaacacagccgaattctactagatgtacaaagaagagctggtaccattcctactgaaactattctataaaatggaggaggagggactcttccctaactccttctataaggccagcatcatcttgacaccaaatcctggcagagacccacacacaaaagaaaacttcaggccaatgtccttgatgaacattgatgaaaaaatcctcaacaaaatacttgcaaactcagttcagcagcatgtcgaaagactaatccactatgattaagtaggcttcatccctgggatgcaaggttggttcaacacacacaaatcaataaatgtgattcatcacataaacggaactaaaaacaaaaaccacatgaatatctcaatagatgaagaaaaggcttttgataaaattcaacaccctttcatgttaaaaactctccataaaccagatattgaaggaacctacctcaaaataataagagccatctatgacaaatccatagccaacattttactaaatgggcaaaagctggaagcattccccttgaaaaccagcacaagacaaatatgccctctctcatctcttctattcaaaatagtattgaaagtcatacccagagctatctggcaagagagacaaataaagggcacccaaataggaagagaggaagtcaaactatttctatttgtagactacatgattctatatctagaaaaccccaaagtgtcagcccaaaatctcctccagctgataccttcggcaaagttgcagtatataaaatcaatgtacaaaaatcgctagcattcctatacacccacaatagccaaaccgagacccaaatcagcaaggcaatctcattcacaattgccacaaaaagaataaaatacctaggaatacagctaaccagggaggtgaaagatctctacaaggagaattacaaaagctgcttaaagaaatcagagaagacacaacaaatggaaaaacatcccatgcttgtggacagaaagaatcaacattattaaaatggttataccatccaaggcaatttacagattcaatgctgttcctattaaactaccaagcacattcttcacagaactagaaaaaaaactattttaaaatttatatggaaccaaaaagagtctgaatagccaaggcaatcctaagcaaaaagagcaaagctggaggcatgatgttacctgacttcaaactatactacaaggctacattaatcaaaaatgcatggtactggtacagaaaccgacaaatagaccaatggaccagaatagagagcccagaaataaagctgcacatctacaaccatctgatctttgacaaagctgacaaaaataagcaatgggggaatgactccctattcaatgaatggtgctgtgataacaggctagccaggttcagaagattgaagccggacctcttccttataccacatacaaaaatcaactcaaggctcagcgcggtggctcacgcctataatcccagcactttgggaggctgagacgggcggatcacgaggtcaggagatcaagaccatcctggctaacacggcgaaaccccatctctactaaaaatacaaaaaaattagccaggcgtgctggtgggtgcctgtagtcccagctactcgggaggctgaagcaggagaatggcatgaacctgggaggcagagcttgcagtgagccaagatcgtgccactgcactccagtctgggcggcagagcgagactccatctcaaaaaaaacagaaaacaaaaatcaactcaagatggattaaagacttaaatgtaaaacccaaaaattataaaaaccctggaagaaaacctaggcaataccattctggacatacaaacaggcaaagatttcatgatgaagacaccaaaagcaattgcaacaaaagcaaaaattgacaagtgggaactaattaaaattaagatattctacacagcaaaaaaaaactcttaacagggtaaacaaacaacctaaagaatggcagaaaacttttgcaaactatacatctgacaaaggtccaatatccagcatctataaggaacttaaacaaatttacaagagaaaaacaacctcattaaaaagtgggcaaaagatatgaacagacacttctcaaaagaagacacatatctggccaataagcatatgaaaacaagtacaacatcactgatcattagagaaatgcaaattgaaaccacaatgagatacaatctcataccagttagaatagctattattaaaaagtcaaaaaataacagatgcttgcaaggttgcagaaaaaagggaacacttatacacagttagtgggagtgtaaattagttcaaccattgtggaaagcagtatggcaattcctccaagagctaaaagcaaaactaccattcggctcagcaatcctattactgggtaaatacccagaggaatagaaatcattctatcataaagacacatgcacacaaatgttcattgcagcactatttacagtcgcaaagacatggcatggaatcaacctaaatgcccatcagtgacagactggatagagaaaatgtggtacatacataatacgtcatactatgaagcaataaaaaagaatgagagcatgtcttttatgggaacatggatggagctggaggttattatccttagcaaactgatgcagaaacagaaaaccaaataccacatgttcttacttataagtgggagttaaatggtaagaacttttgagcacaaagaagaaaacaaaatacattagcatctacttgagggggaagggtgggaggaggagaggagcagaaaagataactattgggtactgggcttaatacctgggtgatgaaataatacgtacaacaaacccgtgtaaatgtatttgcctatgtaacaaaccttcacttttacacccaaacttaaaataaaagatttttaaggccaaaaaagtgtataggaaccacacacacaaaaaagagagaaatgtttaacaatttatgaatggccaaattagtatttggtattacaatatattatatttcaaaataaagactaatatctaacctgtagattcattttcttctcttttcacatagcctaccctgagaagctctttggctctcaaagctttaataattatgcctctgagaataattcccaaatttggatgtataatgaatattctcctgaaccctagctgctcttttcaacaggaagtcagatattttcacatgctcatttttttctgaaatccaaaatatctgattttgaactctctatcatcctcagaattatctttttcctttaattcacatttcagtaaaaaaaaaaatagcaccaatatttttctcgattatccatgcacaacacattagagtcattttaaaatacttgacatcctcatgcattttttttttttcctttagcaagagagggagtcttgctctgctgcccaggctggagtgcagtggtagatcatagcttactttagcctcaagctcctgggcttgatcaagtgatcatcctgcctcagcctcttcactagctgggacgacaggctagggccactatgtccggctccttagatttttataatattaagttttgattccaatcctttcatgatgtgttcccaattcacaccatgttatctcctgcttcttttcttctaactgtgccctacattccatattccttctctggggaatgctgcttccactttcccacctaggaagctactcatcctatcagattgagctcaaatagttcttcctttatgaattcttcattaatccacaggacataggctgctcacttcttttctgggttcccatttcttactttttttttttaagagatggggtcttgttctttcgcccagatgggagtacagtggtggaattagagctcactgcagcctggaacttctgggctcaagtgatcctctcgcctaagcctcctgagtagctaggactacaggtgtgggctaccatgcccagctaatatttcctttttatttttgtggtgggagggaaaagtgagggtgtggggtctctctttgttgcccagactggtcttgagcccttggcctcaagcatcctcccatcttagcctcccaaagtgctgagaatagaggcctgagccactgcacccaacctggattcttatttattacatttattattcctctaatttctgtaagtcctcaaggacagaaattgagtccaaattcagattttgttttttacgtgaagaccataatcctgtgtataatacatgatcatgaaatattttttaaatgcatgcatgaatgaatgagcacatgaatgaacaaataagtgaatgaatctttgacttctttattcagtttcctggacttcgttccactgccttttgtttttccttcaacctacttacttgcaaaataattccccaggtaattttagtatctgcttaaactgaaaagccaaggctttcatgaaatatcttgtatgaaataattcagcttatttttctagttcacaatatgttggcaaacttcaaaaacatttagtgatttccaaacagttacattaagctatctgaagatagttttgaatgaattctctacaagtgaggataaattgtaataaacaaaaatacttttaatgttcaaaggacaaaatattatatttagtgttctcattcctacaaatcacttgtttccacttttattcctatttttcttgcagactatcaattctatcagttcagaaacatgatagaaccctttcctaacatcttaggtctcccttgtgggatataagaaatattctcctgcagataataattagattgataggtttcagggtgttttcctaagggaaactcagaagttatttcttctaaaacatttaacagcccaaaatatctaattcaaaattcttaatgttttggccccacaataatgaaattgtgagtctttctttttttgttattatagatagaaaaaaatttgaagccagtaaaaattccataaattggcacatgatatgaatgctatattgatgggaaagtctagataagtaaatataatgatttgaaagcacagagtaagctcccatggagaaagtatactaaagggccattttgccattatatgaacaaacagaaggcattcttacattttaagtgccatgataattacaatgagaatgataactaatatttgtatagttgcacccaattgaccagtgaaatcatgcagaaaggacctggctaatgagcctgtaacagccaaggtataggcactgagataaattcttatccataattaggaaatgtggtcacaaaatacaaatatcaaagattgcctttgaggtgagtacttacttgaaatgaaggatggggaaggcagaggaaaatatctgtactcaaggtaaagcattcgaggtcaaagacttagagaaagtaaaagaaatgtttactagagagggtcaagttctctctcagtgtgtgcatgttgtacgttgtttaaattaaaagtgtcttaagcaattacatttcagagtagcaaaaatttactgtctctgtttctctgaggatccctccctctataacatttcctagtacaaatacctgagcactagcgaaaaatgggtgagttccacaatctgaagaccaaacaaaggacaaaaaaagtctgtggtaggattgaggcagggttgagattttgtgtcatatggacatgagagacggagagatcaaaattttcatgagagagtagttaaaatatgggcaaagcattctttctgaataagaaaataaataaagaattaagtatctaaataagtttggagagaatgacaaaatctaaaatgagacatgacgaggttgaggataaggtattacaattttttttggagagagacagaagttgaaatttaaaatttcatttctgaaaaaaattctatgcatagaatatattcattaaagtactgtagaagaccaaataaatccaaactactctaactaagagttcttgaaacagacagcgagaataaggctgacaaaaatagttatattcacaaaggtgcatccattgaactatcttactgtgtttttttaaaccaggtacttttaaactcattggactattggtttagaatacacattatcagagatcacctttttctataaaaataactattttatttttgtttttaaatatcagattaattcaatattgtttttataactacctaccaatcaccatctcaaagaaatgatattcagttaaatttcttttcttaggatgtttttcacacatttttacatttttaattttattttttaaactttgttttgtttatttttaaattttgtgggtacatagtagatgtgtatatttatggcatacatgacatattttcatatgggcatgcgatgtgaaataaacgcatcatggagcatggggtatccatcctttgagttacaaacaatccaattatactcttcattttaaaatgtacaattaagttattattgactatagtcaccctattgtgctatcaaatagtaggtcttattcattctttctatttttgtacccattaaccatctccaactcccttaatttttaattattatgaatacataatagttgtacacattatgaggtacatgtgatattttgatacaagcatataacatataatgattaaataagggtggctgtggtatctaatatttatcttttttgtgttaggaatattttaattctactcctttagttattttgaaatgtacaataaattattgtttactatagtttccctattgtgctaccaaatgccagatcttattccttttacccaactatatgtttgtacccattaaccacatctcatttttctcttaactttcatggtttattattattattgttatcgttgttgccacctattaatgagaacatgtgatatttgtctttctgtgcctggcttatttcacttaacgtaatatcttacatttctatccatgttgttgcaaatgacaggatttcattctttttattgttgaataatattccattgtgtatatgtaccacaatttctttatccatttatcctttgatggatacataattttattccatttcttggctattgtgaataatgctgcaataaaagtgggagtgcaaatatctccttgatatgctgatttccttccctttggatgtatatccagcagtgggattgatggatcacatggaagttctaattttagattttgagtaacctctatactgttctccacagtggctgcactaatttgtattcacgccaatagtgtacaagagtttccctttttccacattctcatcagcatttgttactgcttgtcttttggataaaagccattttaactggggtgaggtgacctcaaggtagttttaatttgcatttctctgataattagtgatatggagcatcttttcatataccagtttgccatttgtatgtatccttttgagaaatgtctatgcagatcttttgtacatttttgattggattgttcttttcctattgagttgttcaagctgcttataaattctggctattaatctcttgtcagatgggtcattggcaaatatttttttccatcccgtgggttggcttttcactttgttgatgatttcctttgctgtgcagaagaagctttttactttgatgtgatcccatttgtccatttattttctttggttgcctgtgcttttgaggtcttactcaagaaatctttactcagaccaatgtcctgaagtttttccccaatgttttcttctagtagtttcacagtttgcagtcttagctttaagtctttaattcatttaggtttttgtatatagtgagagatagaggtctagtttcattcttctgcaaatggatatccagctttcccagcaccatttattgaagatactctccttttcccaatgtattttcttggcatttttatccaaaatgagttgactataaatgagtgggtttatttctgggttctctattcttttccattggtctgtgtgtctgtttttatgccagtatcatgctgtttggggtactatagctttgtagtataaatttaagtcaggtaatgtgacgtctccagcttcagtctttttctcaggattgctttggctattatgggtcttttgtggttccatatacattttaggattactttttctgtttctgtgaagaatgtcattggtattttgacacagattgcatggaatttgtagactgctttgggtagtatgaacattttaacaatattgattcttctcatccatgaacatgaaatatatggccatttttgtgtccccttcaatttctttcatcaatgttttacagttttattgtacagatatttcacttctttggttaattcctgggtattttattttatttgtggctattgtaatgggattactttcttggtttctttttttcagactgcttgctgttgttatatagaaatgctactggtttttatacattaattttgtagcctgaaactttactgaatttatcagatccagtaacttttgggatagtctttagtttttttaagataaaaaatcggccgggcgtgatggcttacgcctgtaataccagcacttcgggaggccgaggcaggcagatcatgaggtcaggagtttgagaccagcctgactaacatggtgaaaccccatctctactaaaaatacagaaattagctgggtatggtggtatgcacctgtaatcccagttactcaggaggctgaagcaggagaatcgcttgaacctgggagacagaggttgtagtgagccaaggtcacaccactgcactccagcctgggcgacagagcgagactccatctcaaaaaaaaaaaaaaaaaaaaaagatataaaatcatatcatctgcaagcaaggataatttgactcatttcttttcaatttgaatgacttttatttctttctcttgtctaattgctctggctaggacttctagtattatgttcaataaaagtggtgaaagtgggaatccttgtcttatttcagctgttaaaggagaggctttcaggttttccccattcagtgtgatgctagctgtgggtttgttatatatagcgtttatcttattgagatatttttcattttgaggacaaatacatacttgttgagggtttttaccatgaagggatgttgaatgttatcagattttttttaagaatcttttgaaataattgtatggtttgcatccttcattctgttggtatgatgtatcacacttattgatttgcatatgttgaaccactgttgcatttctggaatgaatccctctcaatgatgatgaatgtactttttaatgtgttgtgaattctgtttgctagtattttgttgagtattttttttatcatgttcatcagaggtattggcctgtcattttcctcttctgctgtcttttcatctggttttggtattaggataatactagcctcatagaatgagttaggaagtactccctcctcctcacattttagaaataatttcagtaggattgacattatttatttttaaattgtttggtagaacccaacagtgaagccatcagcttttagccatttcttttatgggagacttctgttaatatctcaatacttgttatttgtctattcaggttttggatttcttcagcattcaatcttggtacttgcatatggttaggaactcctccatttcttctaggttttccactttgttggcagagagattaaatgtataaatgaacaatggccagaatttatatgacagtagagctttgaccataacctctgcagcaaccagtcctggaaattaaaccacagcttatgtagcaatagacccagaatggacatgatttggtcaatgacagccaacttacctatatttgccaaagctttcaattcagtaagaatcagagaaagccaaatatacccctcaaacccatctcataaaatgtcctgctcctatttagtctacctgaaacttctctacctcaacagtatcccatcagaaaatactagaaatctcctttttaaagctttccttttccctgcctgtttttgagactctgcccaaagcaagtgatggtagctgattcctctgtaaggtctgaatagtaaagtctggatgagcagtccctgtatgttctcattctgtttattcccacatttttgtattaatataatttaactataacacctaaaatctctgaagattcacacgatacagaaccggtctgccacttaggaactaaaatagccatttcactaaattttctgacaaatttactacagagtttagaaattgaaattgagatttcaggtaaaagcatttatgccttcccagttaattttaataaacaattactaagatcttatttaagctgaatgtttgctcattacttatcatgattagcaatcatcctgtacatttttatcatgtaaaagtaactgacagataaaatcagtctcctttatattaaagcatttctcatcagcattactaaatagtttctagtgattcaagactacataaagtaaaataaatggattatttacagggagaatatttatgggaaaggcaatgattattgcttataattactctaacacactatccaataggaaaaaaagtaagccatcattctggagcacagcaaaaaataatttttccttccagatataattatttcaaacatataatgaatgttttcttaaaagtataagctgaaaagccaggcatgtttttcaaaattgtaaataatcctcttatcccatattttatatttcaattatttgttagatatttgtgtatatttaccacacatatgagaaagagaattcagtagtcttatcaagtaatgtaaaaaatggacttctctgcctttacagtttaaatcataagacatagactgtttctaaatggggaaaacataaaacttaccaatatttctaattccctttgctgtgtgtgctacaatatttaaattgctattgtcattaacacattatattagaatataaatgtttcacctcagaaagcaaaacgagtcatgtgcaaagagatttcttatttaatgaacaaaaagatatgagccatagaacatacagatttcacatactccaactatgctttcagaaagatttaattctgaaaccctagcagaagtgaggccaggtgagtttcctccctccctcgcttcattttctattccatctctcagggttgtatcttagaaaagacagcgggggcagaaatgctttgtaaatgcaagcttgtttccagtgggaagtatgcacagggtacaaaataagttcaaccccacctcccaacctagttcttcatccaccatccctctgaagctgtgcatcccaaggattctttttgatgatgaatgcaacattatttctacatggctatttttgagtgttgctttggtttcccttctgtttgacagattttaaaacatctcccccattgtccagtcagatcttaggctctcctggacatgaggaaagctgagagctcagtgcttccaaacaaaccctatttgatccacatattcctccatgtttttggttaattcttgagtgcaacaggccatgcttaaaatggacagagtaagaaaacacctggctcacttgcagacaagttggcttagttagctggctcatcaaaattctgagaccatgtttagggatattatagaaacataataccagaaggattactggctgtgatattaagtaacaggatgaggtcaggccagcctttttagaaaatgcagcatacatgctttctcttgggtaactaatcaaaactttttagaaagttgtcttcttcccatgtttattatacatatggttagacttgtgttataattgacctttcaagttgtgatgtttcaggggcacctgaataaccttgtgattgaccacatttgtccccagaaggttggcccattaccagacaaatgatgtctattaacaaagaggttttcagctgtataaattatcataccataatttattttttcttactggtaaatattgatcttcatattttcagaggggggagtatcaggaaggaattagccccattttggtaaggaaaattggcatctcatttggctgacaaataacccgttttctgtagctatttctgtccaaagttctcttcagaacatcattctcataaatacagaattgtgtcattgaataaaattaaaatgaagacagctggataatgaaggtcctttccgttcttttattgtctgttcaacaaactaatagacttcattcaacacctgccagagtctcagatgcctgagtataagtagactcaggtataaaaaccttgaaaatctttactttccctatttatatctcagctcctagcaacattctgcattcctttcagagatgaatttctgcaccagctcgtctgctcctaactgttatctttcctttatatctttttctttccctgtctgctttgctgcccatctccttgttctcctcaattcttcttccatgctatcttatgttgctctggctctaaattctccactgtgttcactgtatgtccttaataccaaggacaaggacagtacctaatattcagcagattctcagtgaatgagccaatggaaattctagaaaaatctgtataaatttagtaaaattagtacatatttttcaagtaaaaacacatcacattgtatcttgaaatatacaatttcatgaggatagggatgtcactttggcatatctttgaataaatagttttaagcatgttggtgcttagagcagctttactttcttttaggtattttcaattttattactttaataatattcacactaaaggtggtacactcttaacagtcattatttttgcaaagataatatactggtttgtattatttattcaaggaagagttatgttttgccttttaccccataatttttctgcaacttttaaggaaatgcatcctaggtgatcatagaagatataattaaatatctggaagttatacctagagcctgtcttctgctcacatcagggaaggaatgaaatgggtctcaagtgttatgaaagtcacaaaatgtgggaactgtttaagttcacagtcaagattccgcgtggacagaatttacctaagagggagagcaaaaaacggggccataatttatgaaaaaaataatatctaatctaatatctaactctcataaagagaaaactttcacaaccttaataaaaactaatgggcttccaggttaagatggcaaactgacacatgtatctaattttgctccttttcaagtctcactaaaactatatatgagttatttttgtttatttctaaagacttaaacacactagcacggagagaatggaatggaagataaaataacagcaagaaatattaacaaactcaaaagcagatgacaagtactaaatgacatagccaatcggagaaagtcagagttcaaaccagcaacagggaaaattaagaatcaagtgattttatgcagaaagacttaggtatgattaaacttggggatgaagagagggactgaaaaaggcagtttgatcccatctcctatttcacaccactgaatatctacccccacctcagcccagcataattccagatattattctctgaagaggataaaatggtctttgcattgtgggtctttagacttattttaggggtggggtacattttatgaacaacagggtgattaaatgaatgtgtgaatactcaatgctaagtgtcaaggtcccagtcaccccatcctctaccactctgctcctagttccttaccttctaggaagaaatttgaaagatgtttttctgggaaagaaagtgattagtacaagaagaaatacttgctttcctctagaaagttttaaatcctttactctgattctagaaaataccagaagatgtataaaaggaatgctgggttgttagaagatgccaccttctcaatgttaacaatgtaacacagtttatgtgactgtaggaatggcccttcaccaaggagaaatcatgttttcaaatcataaagcctgacttctctgcccttgaataaggctatcacaaggggaacagagatgccttgctgcatttgtaactgtgcacaaatgactagagtagaacttgctccacatcttcagtttaggctggaaggtcaaggttcatgtgccaatactcagaaatggctacatcaagttttatgtaagtaattttttcacactgctgatacagtactttctatgagtttattgtgtttgaattagtctataccagactttctccaaagcgcatctaattatgagtctccaactgtggccggatccatatgggtggtctctgctacagtgccacgcataaatgcctgtccctcttctcacttatcatttccattatgcccctaccatgatcataatccttcagttgttacgtatctcctacttcataaaaagaaaaactgtcaattttctaaggccttttataacctatcactttcttcatgcccatcttaatttccttctttttcatattttttttcttagagcccctaaatggacgtgactcattcctacctgctggcctccattctcatgaactttctcacatacatcatcaccttccatgactcaaccccacacctcattcaaaatcgaatacaaatttcatttgttcatactttttcttctgtgcttattctccacaaactctctctcttccaaaatcctaacagattgaacatttaacagtttaacaacacataacataattattgttatctctgatgtgtcaatttgtttcttccttgaggaaagaactgattgggtcttatcctgtgtttagcacagggtaaagtcttgttgtacaatgggtaggtgcccaaattctgaagtcggaccaacctccattcaaaattaactttgcttgtgtgtccttgggcaatttatctgacctctatttctttattaataaaatggagggtataataatcaatcaaactgtctagaggataaacaagaaaacatgtttttctcaagatacagtacacagtaagcactcatcaaagtttagctatcattatgtcttttattaataaaataatatttgaataaaatgagaaaacagcattttgtggcacttcagaagatataaagcatgagctattttttcttttattatttttaaactatagagctatttaaaatctatatggaggacttcaagtgtactactactaccaccaaatgggggactactagctgataaatactgcactgccagctgtgaccctcactctcacaggtcccactacaaacaagcgaaaaacctgcaatgaaagaaatgtgacaaaggtggaaccaaggaatagcctatatataaaactgctaagtttaaccctcagaaaaacattacggtgtctgagaagaaactcttgaaacagaattgggaataaaatagaagtaaagaacagatttcattcattttaaaacaattggagatttatcacagtttatatgaactgaaatttaggtgactctggattcagttcaagcacaagagattatcagagtctaaaattcaattttactacccttcctttattgcagttcaaacacacaatattcctgttctgtggatgcctttgctagtgatggctatagactgagagaatgttgggctgcttagcttttgtaaaacatgaaatgtgtctattttcaaatgatttgtcactctatggagttatgaatccccttctaacaccccagctacagattaggataccctcaaagccactgatttgtcagaatccttttacaacttgattcagagtatgccaacagtaagatattaattcctttaggagggagacatgtacagagcaggaaaaaatactacaaggaggtctgtaacctcaccatctgtcaagtgacatgctgttatttttccactttggctctactccccaatatcagttcctttctttcccagtgtagacccagtcatttcaatatatccttcttagtagtttcagttctgctcctttccagccaatgactggatacatgtatatatatatatatatatagatatagatatagatagatagatagatagatagatagatctatatatagatttatatatccagttggatatgtatgtataaatctctctctctatatatatatataatatatatatatattcctagtcgattaccttttatatatcaagatctgcttctctatcaaagttgtcactccatgtttgtcttctgaaggcttctcatattccacagatggcattaccccacaaatagaagctgttaggtatttacttctgaaatttctttcactttttttacacattcctttactcttttagagagagatttcttcctctttcccatggttcctagatcaaaagattcctatacgccactatgttaaatgacagatttttaaataattttatttttaaaaaactagtaagcttactaaatctaaatattagaaatactgatattattggtatgatttataatgctattgcttttttatatttaccctaaattttcattttattctcattttctaacttatcttctctacattaattttgtctactgatatggaacatttattctatttaattctattttcattattgtaaagatgtcttggaaatttaaaatgcatataatgcatataattttctatgtagcaaagtatgttaatactttaaacttcttcctgaatataagaatagtaggccatttaactctgatcttcaacccttacacttctcctatgtagtgtggtcacttcaaatagtctttttttgttgtcattgattgtattagtctattttcacactactataaagaattgcccgagactgggtaatttataagaggaagaggtttaattgactcacagttccgcatggctggggagccctcaggaaacttacaatcatgtcagtaggcaaaggagaagcaaggcaccttctttacaaggcgcaggaaagaaaagtgccaagtgaaggcggaagagccccttatgaaaccatcagatctcctgataactcgctcactatcacgtgaacagcatgggggaaactgacgccatgattcaattgccttcacctggtctctcccttgacatgtgggaattatgaggatgataattcaagataagatccggatggggacacaaagcctaaccatattattgatggtgttttaccaagccttctttgaatgtgtcaacaccttttctaatttccttggtgatcattcttttttgcatcttaatttctctttcatggtggcatttctgattatgcaatttgaaattcatcagtttaataggtcacacacttgggatctctatttcttaaagatggcctttatttaaataagaccccccagggaaaagcattcaccgttgatgctccatcaagctggtgtgtgaaaatatctctggttccccttttaaaggtagggctataagcttttctaagagtcttagtcccaggtctccggactatgtgtctcctccaaatgccataagggcattaaaattaaaatcttagtatcaacatttaggatctatatatgggctaacaagcaagcaaagagagtgactttcaagactttcacaaagtaagcttatgcttacttccctgctttttgttcaaattttgtgtttttttgtttattcctggttccttctgaattaaagtagtattttaaaaatctaattaattcagctactacatattaaatatatactaagcatatatacacatgctgttataaattctgggtataaaaaaaggcaaatttcatacattcatacaacttatactctgttatggaaatagaggcaggaaatatgggaaaaaatgaattatttaaaccaaaaagtgataactgctaaaaggaaagtaatatagagtgataatgaaactgatgtacagactagttggggaaagtctttaccctgggtggccaaaaaaggctaatctgattctcagctcattcattcaagctgtgaccagaaggaacagccatgtaaacttatgttggtttaaatggtttttttttgttttgttttgttttgttttcccttctcactaaccatttatctcatttttggctatagctttttattccccttttacaatttcattctgtccctccccatttcctctttcccttcagcctaaaatatattcaaacatccagaagtctcaaaaatcttgtcatgatcattagtctcttttaagttactaccttgagtctctttgttttttgatctgctattctcttacctatctttttaaataaggtttttttccattcaccatttcgtaaagcaaaagtcaacaacaaattgattaaatctactaattgccaaactagtatctttttaatcattatcttcaagtaagaccattgattactcactgaaattctctgcccagcatcctcctttgtatgttacttttcttattaacacttgaatgctctttctttatcagattctattttctctgcccacttcttcaaagcttctgttcctcatggctttacccttcattgttgtcccttctagctctaaatcctgtctataaatacacccacttgaattatttatactattttatggtgagaaagcttaagagtcttctcagtgccacttaccaagttattattattattattttatttatttttatttttttgagacagagtttcgctcttgttgcccaggctgatatgcaatggtgcaatctcggctcaccacaatctccgcatcctgggttcaagtgattctcctgcctcagcttcctgagtagttgggattacaggtgcatgccaccacacacagctaattttgtatttttagtagagacagggtttctctatgttggtcaggctggtctcgaactcccaacctctggtgacctgtccaccttggcctcccaaagtgctgggattacaggcgtgagccaccgcacctagccaccaagatgatattataatataactattatagttcaggtttctttccatatgttgtttttcatataaatgtattgatactttaaatcagcaacaaattatagaaggttaaaagttgtaattaaattatccaaaatccaactactaaaacataatcattatttaaacccatgaaagtttagttttgttcctatacaggcatatacatgtctatgttatatatgtttgtattatataatgcttgtgattatatgtgtggagaaagagagagaaacagagacagagagaaagagagaagcagagacatatacaaacagatttctccgaatctttgcctgcagaaattgaaccatgggccaaaactgaattactttctatatgaagaggaataagaagacatttagaagctatggactagagttggaaaaatggcaagagttaagtgcaaaaaatagaaatagacatttaaagaggtatttttatgaaattccatgtataatacacaataaatttaattttctcactttccaatgaaatcttcactgcacataatctttggaaagtggatttctttcagaagaatacaaagtagaactgaattatattgtaaagagtaagtttggtataaaacaaaacaaagacaaaaatatgcatatgagaatatctatgcatccatatacataatagattataaaatttagactactttcatactatttaaaaaacttgactttattttctatagactcttttcatgtggcaggcaaccatttgtttaatcatcccaatttttctattattttaaataattctatagttatcctgttggggctcagaaaaaaaaaatatacgccaaaatgaaggacttagaagcagcttcagaagcaaaagtttttctctgatttttttctgttctcctgttgctcagttccattttcccctgaggctagtcataaatactagaatccttctccaaggcaggtcacagaagccagaaccccttttccccaaagctagtgataaaacataaaaatattattctaaaacgatctccatctctctgtgtaattgtactagtcatacaataattttcctacctaccttgtttgactataggtcataagacccatattccagcgagggtcttgccccatatccagaaggtagaaatacatgttcagagaagccaagaaaaatctagacagacaggccttgctgggtaccccactcagtctattaacataagatcataccttatttgtcccatcatatttctacatgattgtccatactttattgaacttaagcataaaaataaacaatttatcctgtgtctttgggtcttcattctgaaggctaccatatatacttggtaaataaatttatatgttttttcacctattaatctgccttttgtgagttgatttttcagtaaactttcagaggccaagggtttcctttattcaaaaaagtttggccaggtgcggtgactcatgcctgtaatcccagcactttgggaggctgaggcgggcggatcacgaggtcaggagtttgagaccagccacaccaatatggtgaaactccgtctctactaaaaatacaaaaattagctgggtgtggtgttgtgcgcctgtagtcccagctactcgggaggctgaggcagaagaatcgtttgaaccccaaaggcagaggttgcagtgagccgagatcgtgccactgcactccagcctggatgacagagcgagactccatctcaaaaaaaaataaaaagtttatcactttatattatttcctttggataggttccctgaagtatagtacagatatggatacagatgatgcacgtatgaaaagtttataaagattttcattttacgcatattcccaaattactataaggcttatgtcattagattttcaacacgatgctctgtaccaagcctattttaaaagttttggcaaatttgatagatttaaaatacatcttattctaactattttatttttaatatttttcaaatatttgtctgccataacttttataaggagaaagtggttaataatataaccatattctttgtccattcttccactacaatattaattttttatgtctgcaagtattctttatatataaatgggatcaaatttttgtttatccagttatccatttacatttcaatattgcttaggacattctattgatgtacattttttgaagttcaatttaacaatcctttctttgtaaattattttgtatgtaattttcataaactgtttctcaattttaatatcactgaaagattcatgtacattttctccattaattatgattttaaaattaacagttatttcattactccacctgaaagttattttggggtataaatgaatgtaccaacggtacacagcaccatatacatgaatactacatggtaatacaaatgaaagattttctaagtgtactaggtcagcttcagtgtatccttctgtactgtggcttttataactacaccacgactgaattattttagttgttatagtttgtgtacattagttactagtagggcagccactatatattttattgctttttgactaactctataaaatgacattttaagacaataacaaacatttttattacttctgcaatatgcccacaatgtacatttttttcatggctatcattaagtgattataatttcaaatatatctagttctcatctcagaagcaaaagataccactatcctgattatgctataaatcactataactaaaattacacagctatgaaactcaaccattcagatagctccaataccagcgaatcacttggtttaccaaattctttgtagaagtcacatgctagtatgatacacagagcagatgcctggggaaggggaaggtgagagagtataagtggtgtccaaaccaattccacagaagtttctgagaaacttgccatatttatttatcgatcgaaacctctagaattgtacacctacaactttctaatactatatttgcttttcccctaccacctgatttttggcacttgacactcagagaatcttgaggtttcactaatatgactaatattttcagccattatgaatattacacatcgttttccacataattacctagtgaagtctgtcatctccatcatgatcatacacatgttcttggccagaacaatgatgtcgttgcttgtatcatcccatatctcaatctcagcatccagcttactctttactttcttgaaatcagcaacttgctcagcaatcttttctttttctgcctcaggcagttgagtcatcttagcctaaaacatgtgataattagagttaaaatcattccactatgtcaaaagcattttaggaataagtagatattataggatactcataaaacttgttcatttaaaatcagaggcacaatatagttaaattcattcaattaaaactttccaggcttaatatttcatataaaaatctattaaattataatagtttgctctagaactataatgttacatttagaataacactgtagaacttggtgtccaacatacttaaatccattttataaaataaatgtgggactttgcaaatttctaatacgcttcaaattttaaattaacatcaatttagtgtaatgcatcacctttgttagaaaagtgcgtataaaaaggtggatgtataacataatttaacttgaaatgagactatgtctacctatgtgtatatatgcaattacaggatgaattagtcatgcctcaactttaacataataaagaaaaaacaatgatgcttttagtttgaattttctgtaaatatctcagcataatgcttgacacatattgaatgttccataaatggtagctatttcttattcaataaaattatcaaaatattttcatatgtctaataaattttttcattttgtttgtattttttctatgaagaatcaaattaagctacacaagactaagtttttaactgacacaagtgctatttcttagcctctgaaagtagtttgtagtttcttttctgaggaaatgtgtcctatgtgaggttgtaagagaggagcaacttttactactgctggcatatggcaaagcacgtaaatgaagacacagctcactacttctgaaatgaaaagtaatatgcaagcacgttaagtaaattataagccaccaacccattaaactgactcacgaatagaaatgggttttctccatcttgactaccggtcattatcattctctccattctcataaaaggtgtttaaatgttcaaattacaatagctccagataggttcaactggtgcttctctttacattctgtatctcagaggtcataaatctgtgattctatttattagaataaatagtgctgaatatacactggtatattatggaaaattatttactgttctcataataaagctattcaagagctgaactggttaagtgtattccaagttcagttacttggaatgccactgatttccaatatgaccttgaggaagttacctaaccctcctgtctaagtttccctagacacaaaatgacagtaattgcaactgctatccacctgccatgcagggaacagagtcaattattggataagattgcgactgaccctgttgtggacagggagctcattggttgcacttcatctccttaataacatctcaactcaaatggtgaattacaacagacatttacctctgacaagataagagccaaaagttgggcaatagtttgcaaaattaaaagttctagagaattctggtcctttttctcagggggaacaatagcagcaacaaaacattaagttactgacacctttgcagaaggttttaagtgcttctatgatttattatatgtcatcgatcaatttcaaccacgctgaaaattccaaaggaagacttaagagaatacttgatgtttggaaagtctaggtgaaaaattctttattgaattattttgttcaagttaaacaaagaaactgaggtacaaagcttaagaaaaattaagtaagtagaatatctctgatatatatcgccaggtggctatgtgtttaggtttctgcttacatctatagagcagaactctgatagaaataactgtcaaaggctttttcaatcactgccatctgaataagattatattgtgtaactattgatcttggaatgtgttaccaaacacaagaaacatttaaacttcatagcagccctatgaggaattattattatcccaattttgtaagtgaggaaatcgagtctctctgaaacattaagtgatttatcaagattatagtgtcagtcaatggtagaatcaggatgtaaatcagaaaatatagctctagagtttttgttctatcactaagccaacaaacacgaataatattgcccacaatataccaatatatacacattctccatgatggtatttctctatcgctgtctacctttgaaagcaattgttctccaaagaatagtcacattgtttagaacctaagtttccaaatctttaaattatataccatgatctttacctgacaggctgttttggacatcaaatgatatgcaagaacacactttttgagtaaagtgatgttaactgtcaaccattacttacacaaatagattcagttctttactctctgcagtgaatctcagaactctatttataatattatccattatttttcaatgaaaagctgtgttatcccaattgcctattaggcatttttaagcatagatttcatttactaatttaactctaaaagagaggtcggcagaatttttctataaaggacaagatagtgatatatgctttgcagctcacaccatatcactccgttactcaactggcagagttgttactctgttatattgcaagagcagtcatgaatactacataaacaaatcagtgtgtctctgttccaataacaccttattatagacattgaaatttgaattttacataattttcacatgccacaaatattattctgatcacatctgattacatctattctgaattttttcaaccacttaaaaatgtaaaggccattcttagctcatgtacaaaagcaggcagcaggccagatttgacctgttgactacaatttgccaacacctgctataaaactttcctatgaccagggaacacagatttttattgtttttctctgtcttcattatccttactttgtttgtaactcctgaaagtgctgaccaagtgatgcctgaaacattttcttgtttttgttttgttttgttttaaggcagagtcttgctctgtcacccaggctggagtgcagtggcatgatctcagctcactgccacctctacctcctagattcaagcaattctcccacctcagcctcccaagtagctgggactataggcgcccactactgtgcccagctaatttttgtatatttagtagagacggggtttcaccattttggacaggctggtcttgaactcctgacctcgtgatccactctcttggtttttgccttccccttacatccaactgccccttctcagagtcctccatctccccttatctgccaaacgcgcatctcccaaagaatctgtgctgacccttttaactttcttcattatcttctcccttagcacactcatctactttcttttcttttttacattgggaaataaaattgtaagtacttactatgcaccacattatgttctgaagtgtatataccttgtggaatacataatggaatactattcagccataaaaaagaatgaaatcctgtcatttgtgacaacagggaatctggaggaaattatgttaagtgaaataaccagacactgaatgatgagtaccacatgacctcactcatatgcagaatctaaaaacggtatcacaaaaggagagaatagagtaggggttaccaggagctggggtagtgggggagggggtttgagaagatgttggtcagaggataaaaaatttcatttagacaggaggaataagttcaagaaatctattatacaacatggtgactacagtgaatagtaaattgtattcttgaaacatgctgagtgagtgtaaagtgttctcaccacaaagatgataactgtgtgaggtaatgcatgtgttaattagccaatatagttcttctacagtgtacatataggtcagctacgctactttcatgacttcagccatcactgctatgaagattacttccaaacaacctcttcagtcctgttctcctttccaatactgtgatcagtacattcactgctgttaggaatacctcatcacagaaggatgaaaaacacactcagccaaaccatttatcctcttgattttcatgtttctcagtgatacttcctgccttccagtcttgaagttttatattttagaaaattatcctcttttctttagcctattctgtcagttgtccattttatcctttatcacatccatttccctctatatattaatattaccattcctgctgtcttctggtcttaatattctcctttgttttaaatcttcttgctttgctactgcttgattcaatctttctgaatatgatggaattgtgcaatccttcatctaatctccttatctttacatcaccttatcaaataaagggtatcaattcctcaaacaccaccattatatttgtttgattaaaatagaaaattcatataaaatgcctaaatcataaatgtacagttggaacgattttcacaaacagagcaaatccatgcacctacactcatatcaagaaaccttaaaaagattacagacactcggaagcctccttctatcttctgctagtcactatctcctaagggtaatcactaacttcatttctaaaactgtagatttgcccatgttttaatcttataaaggtgtggaataatagcacatgaattcttgtgtctggctttttgtattcagcacttaagtgcttgaaatgcatctattctgttgcatgtagttatattttgtttattctcattgctctatacagatattattccactctacaaatatatatatatatatttctataaatttattcatgtttttctataaacaatattttgaaaactattccgtttttggctatgataaataatgagtattcttggacttttctttaggtgcacatatgggtgtatttctcttgagtatgtatctaggaatggaattagtacatcacagggatcatcataacctttgtttctaccagcttttcaatctcatcccatcttacttccttcaacacactgtaccctcaagctaagctaagctatttgttgctgcaggtaaatatcttgagatattgcccattaattatttttgctcatcttcccttcccccaatttgttggtccaaatttaatcatatttccaggccagactcatatagtatatgcccctttctccattcttcaagtgtgtgtaattattctctcaaaatttttagaacatgttgtcagttcttccccctagatgttcatattgttctctcttgtagtctaatcttgtgaacacaactatcttatctcacttactagagatgttgttgaaaacaatatcatctttcagaataataattatgacattacacataatttttcatttgtactttttagatgtatttttttctccttcccctagaaaataagtcctcttaaagtaggaacatattgcatgataaatgtttgtttgtgattgttaacagaaatactcaagagctaaaaaaaactcaagacttttgagctcaaaattttatatcactgatcttgtattttcattgtcaaccacatttacacaaatgccaagcttttgcctctacacagatcttagattcatttctcttatgcacttttcctagtatttttcaaactcaggtccttattattcctccaagactgtattaatagcacaattgatcgtttttcatcttcatatctgcttattaattgtactatgctcattactactgcatcaaatattgatatgcttacattatttatctgcttaaaaaatttaaatgactataattaccccttaaaagagacaaaaggaaaagaaaggaaaaaagtgacataataggaaaaatgcagaaattgttgtcatacagaccaccattcaaattccactttggccaagtattagttatacagcaattaacaatcctaaaccccagtttcatatgttaaatgataataaatttataggagttgtgtgagaattagttatgactataaacaattgtacctggaatatattagggactcagtaaatggtgcatatataaataatgtatataaatgtatcatcttggcctccaagactttccacaaaatggaaaagaaggataactaaaatattcatgtagcctacctcacagagcctaggcaagaaccaaatgaaatattttgagtaagtgctttccataagcaataaatgccatagaaatatagcgccattataattatcttattctcagaagccccagaatccacatcacttattttgcagataagaaaattgtcccagaaaggggaaatgacttaaaagaactctccagctggctagtgacagatgtgatgtttcagtccatgtgtcttcattagtagctttccctttccacaattttttttttggctttccttaactataactttttttcatggaaattaaattcttaggtaaatcatataactttgctaatttctctatccatgaaactggatgaaacatagaaatattattttgttaataaataatccacaattatgatttttttaattttataaatattagagaatttctaattaattcatatcactcatatgaatgggtagctagaactcaacattcaaaataaaatgtttgataaactttaaaaatatacacatggtatatatacatattggaaaaatagttctctaatgataactcatgttcttaccttcagcgtgtctcaaatttaatagtgacatgtacgtgttttcttaaaataagcctagaggcatttgggaaatagatgtatttttaatacatcaaaagtataaatagcatagaacactttgatggaattttagaaaatataaagtgcttttggcaaaaattcaacctaattaaaattttgagaacaaatttatttaagcaagatttatgcattggtatcctaagcatactaaattgtgatctcaaatatattcctgagaattcattaagagcaattttctgtaatattttaaaattaacatttaggaattggagttggactttaagaagtggtatacatttctacatttttatgtatagacctctaaatcagacttaaaatatatatttgctttaattagctctcagtttcctcatccatcaaaaaacacccctcttaacacccagtgggttactttcactgttataaaactgtctcattttattataaaactttataggcttcagggactgggtcgaaacagagtaaattatcaggtatatttgactgattatctatgtcttaaatataataatgatagtgattgacatttgttcacacttccagtatgccagtcactctattgagcacttttgaaaaaattatgccatttaaataataatatgatgaggtagatattaatgtccatttgtcacaatcatggaaatgagttccttagggaacatttgcagatctcctataatgaaaccctctccaatgttttatttctttttcataagaaatagttatattttatctgtgaatctagtttctctccttgttctagagataaataaaggttgtaaagggcatttgggagatggacgaaggaatctgtgtataaactgagtattaaggaaaattaagaagtgattgttaattttgttcagtgttgtgatcatattgtggttatataagagaatgttcattattttgggatattcctgctgaaatatttagatataaaatgctatgatgtttcaaattactttgatgtagtttaagaaaaacccaaatatggctctggaactatggttaaactgttatttctaggtaatgggaatatgagtctgtattgtactagtgattaaacatttctgtgcatttaatttttcacaataaaaaatgaaacacaaataacattttctacaattttttgtggaggcatgagagatcttacaggatatataatatcttatttcaaaatatcattccatctataacatttgtgaccaataatgctttcaccacttttcggactttcctgaaagtccaatgctggattctctgggcctgagaaataaagcagtccatgcacattttaccaataaaaattaaaacataataaatgagactcatgacctccagaagtaatcttcacatagataaatttcattcaggatcttggcatgtatcataatgacagaaatttacacttaagtgtggctgtagcataaacctttctccaaaaagaaaagttgtttcaaaggtggtgatctgtatggagcccctaaaacaagatgctgatgtgagcaggtatcaagaaagctgacgtgaatatcctcatccttttgacagatgtgatcctagcacggccatatagttattgcaatatatattttatccagaaggtgaagatccaagcctttatactctttcctctaaaattatatgtatatataattatatattgaagggttggtaaatttgtttagcaagagtcaatctttaaaagcctggttgatttgtttaggggcatcaacactaaagagtttctattcccaacagtgaggaccaaccccaggacttcagtgacctcatcactgaggagattctacttgagctgttaaccctttttccacttgatatcttacttttgtcttccaacaacaggcaagtacttccttctgaggcactgaattacatttttagacagaggtagttattagaaaatctttatctttcctctctatgtctacatattagcctgaattcagacctctagaacctaaaggagtatatgtaatctattttccacaagatgatcttgcagttatgtgaaaaataatcatcagatgctattaactgtcatcttcccattctctcattcattccttcacctattccttttctgtagaactcttcaattccagacacttcaagaacttgttatccagaagatcagaatcaaggttttcctttggggatatttcagtatatcatcgtctctttcataaaatgacttccagacagaattgcaaattctagatgaattctgaccagtcaagaaaacaataatggtctttgttcaggacactatattcgcactctacaaagaccaaagttgtaatagaaattttgtaacattcatgtaaattatttactcatacttaacactcaactgaaatgcccattacaaaaataaactataactaagccatatcaaaactgtcctgtatttttatttttaaatataaatattgcaaagatttacactaaatttaatttatttaattgcattgtgttttctttggttcctcgttccagaatgctgatatactttttgtcttttgatgctgccaaaactgacaatatagaaatcctcaaacagttcaataaataaatattataaaggctgtgaggaaatcaaacaatgctctctaaaagtctattttattcacaagaatgcctttaagatgctattcagtgcccagaaacttatactttgcttataatttgaataagtttggttacctgaattccatgacccagtttacagtaaattggaagtagacagaaggtgtattagtctgaccacaaagatggaaaagaaaatctatcaaaaaagagacagactactcagtcagataatgaggcccttcaagttataaataagctttcctgcttatatcaggacaccttcatcctattattgtattatagcatagtacaattatatttggtcacaatactgacaatgagtcatccacagcatcatcacccagcatttattgatgtctactgtaaagtagagttggatggcaccatttctgctctcaaacagtttaaaagatccctgtgcagaaaaagacgtatttagaacattttggttggtaaggtaaagatgcatataatacaattagaaaaccaattctagtgacttttaaaaaagttaaatcttattatatgaattttataatgacaaattatatgaatagtataacaactaaagtaagatttgagaaagaattatatacctcctagttttatatgtattttcttttaatcatatttttgcatgaatataattttattactatgtatgtattaaatgtgtaattgaatataattaccagatttccctccaaattgtttatggaaatttgaaaatttcattctatctttctaacaacaattttcttgataaaataacaatttgaggaatattgtatagaattctaaatatggcatttgcttgtccataaattatgcttacatatgtctatattattatgattcaatatgaccaagactaatgatccatataaatatgctaattatagctccttccattgaaaaccagatgcaacacctgtagtgacacagtcgtggcaaagaaaatataaaatctattctcattatattattaacaactgaatatagattatgtaatgcacaaagaaaaataagctgttatatttcacataatattaatctattgcctatttactaggtttttaaaaaggtaaaataaaatagtttatatcaatttgagtaatatactactattatttctttctgactccattactgggtaatcattcatgattcggatcgcttgaagtcagtttagtttatgacctaaacccaaagttagcagaagtttccatattctgaaatataaataaaacagtcatgcttcttctcatacattctttgagagtctcaagtttactcaagaacttcataaattactgagggcttatattcccataggccacttttcttctctgcatttctgatctcgatctactgcattcatttgagagtgatcttgtataactattcccttcttactccattatagtaacccaacattgtaaaattcttcaaaatcactcttatatatatacaagagagtgatcttgtataactattcccttcttactccattatagtaacccaacattgtaaaattcttcaaaatcacttatatatgtcatttgtgtacatgtgaaggtttgtgaaaatgtttagggacaacatgagaattttacaaagtaaaatgacttaacattgcaatatctctgatttttacttaaagatgtagaatatgggtaaaaaagtatcgcttccacatttacatcaacaaccaaagccaaaactctgcaagtccatgacttttcctaaagccaatcatagttgtcaaataataatttcactgactgagttaaacagccaaggaaaattttattcaatactgctgcaatggaggcagagatggaactcaactctgctgaagcgaagtgaaggagagtttttaagcactggggtgagctagtagaaaagtactggaggacattagtggagatggtcaatgtcattagaccatctgtgtttgctaaatggtacttactgaataggcttctaccctcctacagagagtaggaaatagaggctttacctttcttgataactacatttcagagatggttcacagatgcttaagaaagatattatattttgttaaattggcaagaaactgggacaagatgtacatcacaaagggacagagaaagaatttacaatgggaagttctctaaagtagatgctttaagaaaagggaggccaggggcctgtactcagaaggaatcccatcaagacaaggagaaatttaaggctttcttggtcagaagtcagaagtcaaccaatgaacctgagatctagggcaataagcgccttctgaaagagatatgatgtaagtgtttgcttgccttgggtagatgccacctgacactggcaagtagaattcagctagaagagttgacaaattagttgagtatgaatcatcctatggtggcaaaaagtaagtaattgctcaaaaaagaaggacctgttaaaaagaaacaggatgtccaggcctggtggctcatggctgtaattccaatactttcaggggctaaggcagggggactgcttgaagccaggagttcaagaccagactggccaacatagcaagaccccatctgtaataataatcatgaaataggaaaaaagtaaaatttaaaaaaagaaaaaaactttcaataccaaaaaaacacaaaaaaaactttctatatcaaaggttggacaatttggtcagtgaaataaggttaaactccatagactacaataaatatccatgagttcatagtgatataaataaataattgaatgaataactaaatgtgggagaagggacagctcttccttaaaactccaactaataaatatagaagaagtgagcaaagtagaaaatcatgggttaggcaaacaccacagtaattattctttggcaaggttcattgatggagattaaaatttataggtgaacatttgagaaggaacaaaattgaatagtcttaaagcactgcactttggctgggtgcagtggctcacgcctgtaatcccagcactttgggaggctgcggtgggcggatcacttgaggtcaggaattcgagatcagcctgaccagcatggtgaaaccccatctctactaaaaatacaaaaaattagctgggcatggtggtgggtgcctgtaatcccagctactctggaggctgaggcaggagaatcgcttgaacccgggaggctgaggtggcagtgagccaagatctcgctattgcactccagcctgggcaacagagcaaaactctggcaaaaaaataaaaataaaaataaacataaaaactggcactgcacccaagatattaactacaaagaaaaaaaaaaaacttagtttttcagtggaaaaagccagcaaccaacaccaaatgacaaaaaccaacatcaccagaaataagatctattaatatcttgaacctcctgatttgatggactgagaaggacatgttagttttgtgatatttcctccaaaaatgcataaccttaaaataatgaggaaaacataagacaaattcaaattatatgagattctataaaatacttcatctgtattcttcaaaaatatcaagatcatgaaacataagggaagattcaggaaataccatactctagaggggactaggagatgtaacaactaaataaaatgttgaatcctagaacagaaaaagaatataggtggaaaaattgatgaaatttgaataaaatctgtggtttaattagtagtataataccaatggtcatttcttcattttgacaaatgaaccctgggtatgcaagttgttaacattaggggaaattaggtgaaaggcctataggatctctgtacttttttcagctttctgtaattataaaattacttcaaaataaaaaattaaaaacaatgtaaaatatgcacctgaattgtcatatgtatgtcagcaaatacagaataatttacttcatggtggctaccattttcagtcattggcatcctgtcttcttagatgggccccatctgtccttttctcatctttcctgtgtgttctcctgcagcaaaatactgcatattttctaagcacactttttaagtattgtcatatatatattcatccatcagagtctcatctcccaacacggtgcagcatattttcctgaagaaaaagagtcccttccctaaaggaaagtctaaaactatttttttttctctttgctagagatcttcttagtgaggagtaaaaagaagtgagggcttaagtaaacaagaaaacattatcctatgatcacagatactcaccaaagccaatttgaatgttattaatagcttataaactgagatgctataaaaactcacctaattttggataaccacatagcttgtcaattaaagctctacccaatcttaatactagaataacatcattaaataacatgcaacttgtaatttaggatgtttaaatggatcctgatgtctcaataaaatattcttgctaagacaaactccacaggggtaacgcaactggaccaagcagcctatgctagtcttctccagattcacctcccacttgagtatttcttcctaattatcattgccacaacctccttggtttcacgtgagggtcaaaggaccgccacacactttctacctaacatcttgcctatgaaaaaataaaatttctcttaactatctttgatcagctagcataagcctggactatatataaaaatattagacaagatattaaagattttgaaaggcagacagatgcagagtgatatggtcttggtaaagaggcaactaaggtctggcttattcttctacgctagttatgacccatcctatgtattgtggaaaccatcgtatatccattactgatcacccaggtacacaaacaggatattgtgtcccaaatataagtataggtagccaagtcctacagaggccagggttttcttattatggctttctgagcactcacttctccaagtgatttacattagaaatgatagtgagttggctgggtgtggtggctcatgcctgtaatcccagcactttgggaggccgaggcaggtggattacctaaggttgggaattcgagaccagcctgaccaacatggagaaaccccatctctactaaaaatacaaaattagccaggtgtggtggtgcatgcctgtaatcctagctattcgggaggctgagacaggagaatcacttgaacccagtaggcagaggttgcggtgagccaagattgggccattgcactccagcatgggtaacaacagcgaaacttcatctcaaaaaaaaaaaagaaaaaaaaagaaaaagaaaaaaagaaaaggaaagaaaaaaagaaatgatagtgagtttgcagaagagaccaaactttcaaaatgtagttctgcaggctctgaaagtatggcccatcagaatgctacagaaaagtacttaaagcaccacaaaatatttgactattctgttgcatgccattatcaaaataattcatgtactccataaatacatacacctatcatgtatccacaaaaattaaaaactaaaaaaaaagagaatgggtcttccattacagtggtattagttttggaacttcaagcaatttgtaataccttgaaatctaccagaaattgaagatgatttctaaaattctagattacttacaaaaatgtaggcagtacctaaaatagatgtttactaaataatgttttttctaaagagaatttttggaattagaaaaaaaattcttagaaaaaggactcatcttgattagttgaaaatgttttatctgtatacacactgaatttttctattttctctaagcctccttcagctaaagattcatttaataaatccccaagtgagttatgaattatttccccagaggtgggacacaataatcaaaaaataaaattgttcgggtcaatttgtaaaatagaagtttcaatggcacgtttcaatgttatatatctatcatctatctatgtatttatatatttatttgtgtatttttttatttaaggtgatatgtaacaaacttgagatcttataggataggagaacactaggacactaattaggaactggtcccaggaacaaagaccttctggactcatctgacaagataagaatcatcaagcattcttccagcagaaagtgacaaagccctccttgagctgctcatgagaattcacaaagtaaggcaatatgtgaagaattaagatagaagagcttgcaaagaatcccttgtctctattagattccaagattgagccttagaatatttcaaaatgataaaaaaagagagtttaaaagatttgtagaagaagaatgaaataatatattcattttgaaacaatatattttcattcaggattattaataaaatgctcatgttagtgatacatgattcactaaggaaaataaacaaggaagagaagatggataaagtgataggaggaggaaacatgacacaattgagaaggcactgaggtagaaagagaattggtgtttgttggtataatttaaccagttttcattcaatcacctggaccacagaaattctcaaagtacaattcacatgcaactgtaatagattacatcttgtctgtataataagttaatgtgcaagattttgaatattttcttatatatagaatagtattattttttctagtttcttttttgatttatttttctttcataatcaagaaaaaaataaatgaaagagaatatgggagaatgtcaccagagagtcacaatgttggcatgttattctgacaattcaaaaaattctcaaagaatctaagttttaagtgctaaaaactgccagatcattttttatatttattcttctgattacagtgcctacagcattcgtaattctccaaacaaaatcatgaggcttaattgttttgaaatatacttctgtgttacattgtcagatctcaattaaaggaatcttccttctatatgcaatggaagtaattcaatccctttttatgtagtaccataatttatgttaaaatatggcacaatcactgcctaagattcaaaacatgtaaaacacccctttgctgctgcaagaatcaaaacacagggttgatggtaacacctatcctacatcagtagcactaacaatacaatcagtttgtacaagctaaatccatctggtcagaacacacaccaacattaaataaacaaaacataattcttcttgtcttctgaatgtgaatttggagggggaacatctggattagaaaggcccatagcaatagacaaggcttttccaagtaaaattccattcaggcactagaaataagaccctctgctcaagaggcagcagctgacacacgagcctatcttagtactgagacaggatatagatgaagccatgtctataaatgagcacaaaaggaaattaaaagtaaggcttcaattagttaagctttcaaaggtaaaactctagggtgtttggaggaatctttcaggaagatatattccagttttactgcagactcaacacaaatggctctcagacaagtcacatctatagtaattggaaacattttcaaagtaaaagatgagagaccatggtttttgccaaaggttcttaagcatgggctttcatgggcatgcgaattttttttaaaaagtagcagaataaacatatgtttgcaaattattttattttaccaagtaagggcaataaaacacacacgtttaaaacaaaaaatttaaaaaggaagaaaaaattaccacaaaaaacttaccatccactatcactattcttttcttaaaaagaatattttaacctcaaaattaggaaggactcagtagaaaagaacgatctttcctaagaaagaatggctgttcctttggttgattttacctctccccgactccgcaatcacaacctcattgttacttggcaatctcttggaagattattgttagtcacaagtgatgtgagaggtgtgcgctactggtgatagagtagtaagaaattatttaggcagttagtgagggtgaaagagttcttggtagaattttcttttaataaaaagcagcccccaaatcatttcttttctaataaaaagcagcctgaaaaatcaagttacaagcatagataagcaagatggaaatttgcatagataaatggcatcagctgtacctggaagctaggtacatccaacatggtgattccttcttccttttccttgtcgccacatgtgcaggtgtcatggcaccagccaggtaaaaccttatctacataataaaagatttgtgggctatgtaaatagcacacctggtcaaaccaatcccctgggcccaatttaaatcaaacaccatctcctcaagcccctctataaagtggacctcatctcaccccaaacccagaaacatacttggggaccccctttctctgcatgaggaagctctctcttctttcttttgcctattaaactttccgctcttaaacccactccgtgtgtatgtgtcagcatctttgttcctcttatcgcgagacaacaaactttggctgtttccccagacaatgatggtgcttcattggcatctactgggtagagaccagagatgctgctaaacaccctacaatgcacagggcagctactacaacaaagaattgtctggtccaaaatgtcaacagtacacggtagagaaactcctccctacactgacattttagctaaggaccagtggacattttggctcagactgaccctcatgtaagctaaccagtttacggagccagtgatctctggagtgcttggttgactcttttgttttcagtcatttttaacaataatcatcagcaacagaactgcagtggtggaattctactcaatcaattagaactagcctgaaaaattgtcactaaaatctattctgcaattctatcactttgacatcaatcccactggcatattagtttgtatctgaacttcagggcattagacttagtctagaggtagtgctactgtttggaaatgaaagaatatttagccagtttgagacaagaattagtagcctctatcaaaagatagagaacaaaaatttcgtcttacagtgggctttaataatgtatgcttcattaaatattcagtaagagtatatatactttctattaatgtaactttttaaagattaagaaaatcaaatggattaacaaccacggctcattctagatagtaaacttatagatagctattttttccttatgtttatttgaaacattttggtctataaaattatgcacaaactctcagtagtatggtaggcttctttttccctctgtactttcatacagaatacctttattttcataaaatattgtttcatataccaaagattttgaaagcaatattttaagactattcttgtaggctacatatatatgtgtcattattttacaaattatattgcaaaatgagatcatattatgtatactgttttgttccttattttttaacattataaagtagaccagtgtctgtataatatagatttgtcacattttataactcttatttcatgatttagatctggtatcatttatctacatgttattaatggttatcagttgtttcatatttatgtagataggtaggtgttttgtgtgtgtgtgtgtgtgtgtgtgtgtgtgtgtgtgtgtgtgtgtgtatactgagtggtgaatatctttctgcagttctccaaatgtatctgggcaaacattctagaagacaaagagaatgcacttttataaaggttttcaatgcttacttcccagttttcctgcagacagcttaccctaattggtatctccacaaagtgtttgagtatcaattttccataaaaactttctgacaatggatattaacaatcttttcatgtcttcttcaaatgttatccgaatatagtatttcattgttgttttcatttgcatttttgtaatctctgatgagatgggacaacaattaacatacttactataaatgtacatgtattctttatgaataccttgtaatagggcctatgcccagttttctgttggccaggcgtggaaagtggggtgaggagtcatttcttcttattaatttgtgaaaatctatttctatgaatatataaacattttcttatataatttgtgattattatctcctcaaatggatgtttgtctttattttgtgttttgtttgcttgggtttaccttttttattttgtattctcagcagtaaagttcgcgccccttttcttttgtttttggtctttggtatcacatttggaacatcctttaccatcctaaagtcacaaaaataaatatttactcctttttatctagtacatatagggccctttgttgttgttgtttatgttgctggaactcaggagctgaggattgcattagtcatattcttcagttcattgcacactattactcttggtaaatagagagtcttcctgccccaacccaaacctctcctctctttctttctccctcccttcctttgctcccttccttccttccatccttccttctttccttccttactcccttccttccttcctttcttccttccttctatatacttttgtttattcctattccttgtgcctttttttctattccctccctgcaaattaaaacataaactgtttttttaaatctactctggttcgcctttaccttaggtaacttatatttaattcactgcacaatatgaatcccttatgatttgaagttactgttctttataaacactatattttaatagaacagaccatgtgttaggcatctactttgtttttatcactacacaaggtcctttatatgcattatttctaattataatattacaaggtaggtattctctgagttgaaatataaggaaccagtatctcagagaaatatatatatatatattactaaatgtcatactgtcactaataaaaagagccaagattaatcttagggatggtgaccctaagacccaggcactcttggtgcttcttacaaaaacaatagcaaacaaaaccaagcgagttctgcatatttttagaaactatatttgaaaatgaaatcctttttccttataacaccattttatattattttaggaaattttagtaacagtagtttctaatttcatcatttcaaagaacaacatgaatctaatgctacattcgtgactacataattgcaagcaaacggatttaggcatctggtgtgataacagccctgacaacacagcacttcttttcttctgagctgcagtttgaaactggaccagggtaggcatgtggctcaagagctacccatctataaattaactagaaattcatgaaagaatcccatgtaaaggactttgtacataggaggaaatttatttagcttggccaatcaggctggctctccccagaaacccttctgaaaaatctgaagagaactaattagcaaggtgaatgttgccaagctgcaaaaatagcagagatgtcataaatgtgaatccactcaacaaataatgatgacaaccgtgatagtggtggtggtggtaatgattatgatgatgacagatattttttatcacttaatgatacatcattccttataaatattaactcctagaagcctcacaataaccctatgatgtatgtccattttaaaaataagtaagcaaaacacagaaatgttcagtaacttgctcaatgacagcagttagtaagtggcaaagtctgattcaaacataggagtctagctccagaaattgtgctctcctttaaaatggtcttagcatcagaaacgaagagacatgtttggaggctgactttttctaaaagctctgtttcttacaagtacatgactattacatagctgatgactttacactcaaggaaatgcttctattatatgtctgttcatatttacatgggattttagccaagctttagatgtttagagtgctatatagcctaaacaacttatatattagaaatacatgttcacatttctaaaaaataaatgtaagttagaagttactcactgattaaaaatatgaatataaaaatactatttcggttatggtactttcaccgtacaaaggtaatttttagaatattagaaagcacgtaaaagaaggtgttgcatttggcttctttttctgctaccttacctattactacacacttattgtctttagtaggaaaagatgtaagtatatttttgttaaccagggactaataattcaacaatatgtatacatgttcaattttcaacataaatgaaataggactttttcaatgatgacaatttaaggcagaaaaagcagagacatacttgctagccagatgtctaccacaaacacctttaaacctacaaagagaaagaatcacctgagtactttagcctcaacatttttccaaatgcccattgtctaagtaattatctactaaaatactattttggaaatataggagctaccctatttattctgtagctacattataattggttggattcaagtgctgtatctgaaacaaccccaccacccccaaattttctgcacaggtctcttttcccaaagcacatatatggttaacactgtttatttattgactcaataaatatttaaagcacatttactagccagacactgttctaagtgtgggggaatacatcatgggaaaaaaaagaacattaaaactgttgccttcattgaatttgctatctaatagggagactaaacaaacaagcaaatatgtaatacatcagagagtgaaggtaatgttatggaaaaaagtaaagaaaaaatggaaagaggttataagagagttggaaatggagtcacagttttaagtcagtggttagtggtggcattactaaaaaggtgctattcaagagaacaagtatgtcagaaaagaggagatttgttgggggatgaagtctgaaatttgaaggaaaacagacctaaagccaattccttgaggaaaaaaaaatggtcaccaagtaatacataaaacttcactgtaagtttagaaggttgcaaaataataatataaagctatgcatataagataatttccagtctagctgacatctttgcttggtttttcaactgacttttagtctagtcacagtcaaaattaatttctgctctttcaccatctccagactgctcaattcagtctcctctgtatcaatataaatagtaagcccatcttcccagttctgaagccaaaaccttgagttgtccctgactcctgtctctctcattcccaatatccaatcttttagcaaatttagttagttttacctctcaccatatatacacaatcaacaacgttcaacctccccatttctaaaatcctggtctctgtctccaccatttttcaccaaaataatagcaatggtttttaactttctgcttcttcctgaatcacttctcagactattttcaacacagcattcagaaagactcctttaaaacatgtcatatcatgattcttctggcttcaaacccctccaatggcttctcattctactcaaagtaaaaggcaaatgtcttatgatggtttatacatcatctggaccaggcctcccttttagtttcagacttctattactgctcacttcaccaacattcacctccaaaaacattttcttctcagaacttctctgcttgctatttcttccactgtaaatgcatcgatgagtagaaaactctgtttaaagaatggatggcaggctaggttcactaagtagcaagtaagtcacatatatcacaatataccacttaaattcatgccttggtggcattataaactactaaagatatagaactttggtttttttgtccatgttataaggtggaaaacgggcatttttgaataccaacgttctactctataaatcaatggaagaggagagagatttaggcttaaatcacagaagttctaattgttgcaaaaatatacttgatgcctataccttccctcactctaaaatatacttcatcattggtgataagaaaattttgacaacggaaaaactaaattaagaaaaactataataaaaaagatatctttttaatttttaaaaattatatactaagcaattcagattagctattgaatattaatttttacatagaacttcccagtaaccaaagcaggatgaaaatgtacatattttaatgaagctccactgtctgataagtaagagcatattaagatatttggtaaaaatctttcccagattgaaatttcaagaagcatttattaactcgtatataagaagttttggatactataatatacagtgttttaaactttaatttttctctgtctagatttttatacagtgacttataaaattaaagaaatgacactaaatttaaattcaagtaaagaacttaaagatcaaactgctcaagtacactactttacaatggatagagatagagcctagtgcacttgacatgtaaaaatccaaaaggagtgagtaaactgtcctttagacagcttttcagcagaagtttttgttttattaaatcaataggggctaaagtataaagaaagctttatgagaataaagggagttgggctcatctagaagaacttttgaaaggaagtaaaaaagacaaaactagaccattctgacatggaaaaatcagaaatataggctcagggaaaatcctaactctctgtcagaaacacaaggatcattgtagcaaataaaaaggattgaggttctatatcccttatatggccaggaataaaatggcgtagtgaaggacttcggcaaacaagcagatcaattaatatttacactagctggtactaaattgaatatttcagtgtagtgtctaagaatttatagtaagatttatctggcacaaggagttacaactgttggaagaaaaaagataaagaaataaattcatgtaataccctaggctcaatatattagcctagggtgtgcttttggggcaagatatcttacaaaataaagcctctccttatgttctttcctatatgacgtgattcacatatgaatctcctctgtactaagtagtgtcctacgttctgcaaatgtagtgctaaaagaagacaacatgtcccctgctgtaatggagtttagaatttagcagggagaaaaatccattatataggaaattatacagacacaatgaatatcaaaatgtgagaatccacatgtaatggaagattattggagggaaactatctcagacttgcgtatcagagaaggctgggctaatctggaatcctaatgatgagcagatactagtaaagggaaagagggggcagcgtaggaattgtgtttctcagagataatgaaatggtgtgagggtgagcctgatggttgtaagacctgagatttctgcacgaggaggtagcattgaagagaaaccggcaaaatataatgcaaatgagagcagaccctgaagttcctttacagagggcattaggagattggatttcatgctaagggcaaggggtgacactaagacctaaaagggcttttatgtatgatgatagatgacagatttttcactttggaaatatcacaggagcttaagtatggacaatggaagtttacaaaactgatggcaggagacaagttaggaacatgctgcagaaatctaggtgagaggtgccggtgcctaaactaaaggagggaccaagatggcatgaatgttcccctccgcttgaaaacggctttctccaagttgtaaaaccatctcctgttataaagaaaacatttatgagaagttttacgatttctttggttaaaggcaattagcaaatttgatggactataatccctctcaccatatctctgacaaatctttgtttcagcagagttgagctcagaatgaattctagcctttgttccattgcaaaagccttgaataaagtcttcctctcttatttaactttggtgcaattcttctttgacagtggtgatagtggagatggtgaaaaatggacaagttcagaaaatacttagaagagagtaaaaccagaacatgttgtatgattagctatgggaagactcaaaaactattcctgagtttagatttgtgcaactgaatgtacagaggtgccttaaggaatgtaagagtttgagtagattagtggattaaggtggtgcatttaggtttggaaacagtgggatctacagatgcctgtgattatttcaaggagaggaaatttgtaggcctcccaatatatgtagtcagagctgaaaagacaggactaggctagaatcacatgcctacatatgatatttgaaatcttgggattatgtgacaatgtctaagaaaagtaggaagagctggaggactatagggcttatatgagaactctaataaaccctaatgtttaaaaatagatagaggaaaaggaaaccatgaaaaatatgaaaaagatcacccagaaagataggagagcagagttactgccaaacataaaattgaaatgatagtaaccaatgatgagaaaatgtattgcctgctgtgttgctgctgattaatgaaattttatctatattgattaaaactgttttttataataagccaaattagatcatgaagatggtaatgaggtcatgtgtcccaatattctgtaaggtaattccgtacaaatttgagttattgagagtatatactgataataattatggcctgttaaaatgtttttaatttttagagtaaaccactcatccatggaattgtttttctatttcatagtgaaggatattcaggtaactgcatgtaaacaagcaaaagtgaggcagtttttcctatcaccaacataaagtttacatggcattttttttacactaagaaccatcgcaagtattttaagatttgatatgctccagttcatctgttgctattgacgttttgaggttgtgtccagtaacctaggcaactgttcttatttctgtcctaaattacttctatttatagaccttatatagattcaatggccccagagattttctctaaggcagggcaggttgacaaactatatgctcttaagtgaatataatgttaaacacatgacagaccttagtcatcaagcaaagactgcatattacaatttctgtaatttggggtcatcagtatatatgacaaataatgtatctttaaaaatgtagtataacctggtcacaatgaaatatgaaatgactatcgttgaaattataatatttaaatgtcttgtttttaatgttctattcattaaactcaattccagcaattagaactagcagattcaaatatccttaaataaaaatcttacccagtctaattcagtgctaacaaattccttttctcaccactcacctacaagacactataatcaaagtttaagttgtgtgagacagaacaaaacctttgatttagtatttagaccttattggatttcaagttgtacaggcggaggaaagaatgactgtagaatatgttcttcttgggcaggggcaaagaaagaagaggtaattataaatgactacttgcagaactatctccaacatgcatccaataaatatcagaatgagatgtatttttttctctttttttaaaaaatcattatacatctagaaaaattaaatgttgtttttttcttttttctttcttttcttttctttctttttttttttttttaggcagtctctcactctgtcacccaggctggagtgcagtggacacaatctccgctcactgctacctccacctcctgggttcaagcaatcctcccaccttacccttcctagtagctgggattacaggcatgcattgccatgcccagctaatttctgtatttttagtagagatggtgtttcaccatgttggccaggctggtcttgaactcctggcctcaagtgatccacccacctcagcctcccaaagtgctgggattagaggtgtgagtcactgcgcctggcagaaaaattaaaaattgaaaagtttaagtcctatgcaactttatgagaactgacagagacagaaactaatggattaccaagctaccaaagttccacaaggaagaaaaactcccagtgcagagccaggcattttactaaatggtgagggaaataagaacttgacaactattgggtcaacttttcggtgatgttgcattaacaagagttgcttttttggatatctatttcagttctagcttacttttgtgaatacagatttacataaacttgctggcatcattaagaatcacaatgccttcttccttttaatctcttaaagcatttcttcattagtccccttcttgaggcaaaaaataatttcaaaagacttctggtagtaaagtgtccatgatgtcaaaaatacttagtaccatgaaacaggaaaccaagtagtcccatatcaggagtcagagagatttgtatttacaaagctccctgagctactcaataaaaagtcaaagcacatcaggagcacacaaagatctgcatttttcatgagattcattttataaaaatcaaaatttattgttcacttcctatgtgccagaaaccaaacaagaattttcacatatctaattgaatcttcaaaaacacctataaaatagatattattattatcatcatcatgattttacagataagaaaattgaaagttagaaatgtaactttatgaaggtcatatggacagtaattggtggaactgagatttgagtcaaggtttatgtgactccaaagtccattctcttgacttatacattacagtagttctataaaaggcaagtcatttgctcacctattctattccccaaactctctttcaatcaattttatgaagagcctttttaaacccacagttattactcaggtaagtttgaggaacgttcagctgccaccctgctgcaacttaaataatttcctaagtctctactacgactgctgcccctattgcagaaaataaaacaggaaaaacttctagaaattagaattctcgttttattgaaacatcacacaggccaatgtgatgagacaatgactaaggagcaactgcctttgctcttctggattccgtggtgggaactaactttggatcctcaccctgcaggatcccctgctatatgaccctacttgcccaatactccacttcatcaaggtgaagtgacccaccaagagagactttcagggtctgggcattaccaggtagtttctaaatggtaatcaacaagccaattttgctattgatagaagattgtaggatggggacgtgtagaaatttgcaaggtttaaatacatctaattttaaggtttgtggtcttcagtttaacaaaccatctttctagtacagcaatttataatattgactctataatgctggctgttgcaatagtagatcaatgacaatattaagggatgatgagactattccagtttacaagtgtgctgtactggaaagagaacatgtttgaggccaaaagacctgcgatttggtcccagttaatatggcttgcataaactacttaaattttttgtttcatttcctaattagtaaaaccaaacggaaaagataacaaaaaataagctccagggctttttataaataagctaccaatttgaaaatgttctgtaaactatgatgtgttaaacagtatcaggcactgctctgtttaaatagaaaatatgatttagtctgtatgtcatataacattttaggaagcttttaggacttacaaacatcttattaataagtttagaaattttattctcttttaaaaggtgtattttcatgtctcttttgaatttgagtttttcagataaaagatgcctattttattctggctgaaagcatgaacagaataaacaatgagctctgtgaagaatgttctatgaacccgaatcaaactcaaactcctgtgtcactccggtacgcctgatcactggatataaccacgtattggtccagtgagtattcatgtttaacaattaagataattactgatttccactgctatttccattgtcacttcgtaagtcatgcattattggtcttttaatattttgttctcattgaccacagactctaaatcattatatgttagttacagacctttacaatgcctactggcatttgccactggtgacaacaataataaatgatgttgagctgaagctagtaggaatgaatacagaaagtaaaatgataataaataactgtcactccattactaaacagtgcctggttctagcgcatgtgcaatacagcagagtctgcatgatccaagaactaaaaaggcatttactctttagaaacagcaacaacaaaaaagaaatccatttactcatcttgtgctgtgaccccaaattccacactgagcatggcatgagtatttaaagacttctcaacagaatctccttcaatatcttatagtatcttctcaaagtgagagtgtgtgtgaaatgtgccaaaagttacactcagtgcaatggatatgaaattacagcaattacagctagaatgtgacaataatgtctcagatggataagagattgaagatataaatgtcattttattattataaggagtatggaacacagatattagtataaagaatatgggactcaagaatacgagatgtctggtagatattgtaaaacctatctaaatataatgttggttcttgttgggtgatttgggtggggaccaaatctgagctatccttttccttggccatctgtctcataaacttaacttatgagagtagaatctgttgtaataaactcacaaggcagatataatgtaaggggtgttattggtaccaaattatctacaatataaaataatttctcttcaaaatttaaaggaaaatttgtgtcttccccttgtcagacagctgtgacatcctttgctctgtcctctttctcattccattaatgatacatcaggtttattgctctggtggtggtctatctgtttgttttttagtaaaggacttatcataactttatttcctaagtaaactgacatgtggcaatcacagaaggtctgagtctgaagacataatcctcttactacacaagttacataaatttgagccttagtgatcttattagtaaaactggaataatattaatatagcaaatttaatgtaaaaattaagtaaataatatatatggagtaattttcttttattattttcttccaataagcagagtctgagattggaaggtagtttgttttggaaatagatattagtaaacggaactgggagcctgggaagaacgaatcaggaaagaaaggagagccagtctaaagacacagtatcaacatggttactacttgatcctactggggaccctttcaggttctgtggaaaatgcatttccaaattgtccatcttagaaacagaatagggttattggtcaagagttgctctatgtggggttcgtgcctcatataaggttgtatatgtattatcatgactgagcagttatcagagggattccacatagtagttgctagggagccccaatgcaggaagtgaataaaatccaattatttgggatttatgcagaggatatttataagagcagagagtagccaggttgaatataatgttgccaccagtagatttcgtggtcagggatctatcttgtcactaaacagtggtgaggttttcacccagcggcattccgaatgaactggattgtctgagaactgtacgcagcagaacactaatgcaagatgcagagcagtttcagggtagtttccacaacattagaagcagtggcttctatgaaaaattcttaagattcagaatcatagagatcatcaagtttgtaacctataatgggcagccagtcatctagctggcctggcctatactttggaccaagaacaaaaatacaaatgaaaatagtagtaataagaagtttaccatcgtatataatgtggaaatttttgaaacacttccatatgcattatcttatttgaagttaccagtgatgctgtgagaaactatggtattattcatctcatttttcaaatgaataaatttggttttctaaccaagtcttcatcgtctacaagtgctaagccagaataaaaactgaggtgtgtttatcctaattccagcattctaaaaagagccttaattttaacaaaatttcctttggtcaattactttgcaagccttgacacctacactttaccttcagtggcatcagcctgagtgaaccacgcacccacttccctgaaagcaagagcaaagcttacttttagcaaaatgtatttccaattcaatttccactcataagatgtgatctctaccaatgatgccaactagatttgaaggaaactaaatccagatgctgtgtgaccctagacagttttcaacacaaattggctagtagagggctgacaaataacccaaataatctgtaagaaatggaaactcaagaaagtagcatttcccaatatattaccaaatactatctgtctggctatgtgataatggtgtctactcaaagaacattttttctccactgaaatgaaatattcctattaccaaaatttgagataagcaatgtttctgataaaacacaggttttattttcttggctgatatatattatttctaggcaatctgaatgtctgaaaacatggaactttcccaaatttatcttttcccatattatgttttaccatattttctgtattttatagtaaatgagaaaatacttagcgcactgtaaaaacaaatatgtagatgcaagatattattgttaataaaaagatatagttaagctctaatgagatagctttttaaacattcatttcacatatgtcaaagtagataaacaaacaaaatattttacataatatgttgtgggattttaaaaaggcaatcaaaaagaatagtagaaacagaatgtgactctctgcatctgtttaaaattagatatttttcagtgtatttatcttatattacattcttagggaatagaaatccaaaggattctaggtaaaatttggtaaggactaaagttgttttttcttcttcaaatcagtttccacaagccatagattacaatagaatatcaaaacatgtgaggaatatcaacattttttttaaggaaatgtgcactaacactcattgtgacatggagttaaccaaacgggtctttgcttgaaatgtttctgcagagcttgtataacaatatgtctacaaaaacagagtatgcgccagcctttcaatataagtgcttcaacatcagatacaaccataagaggccagaaaacagagggaaaggttaggaatttgcttccatctccaaattttatgtcaccgaatttaactaacttaataataatattaataatgatgatcatgataatcctactattgttgctgctgctattactactatgaatgatagtaactaacagttattgagaagttactatgaactaggcactatataagtggtctgttagttgactcagttaattcccacagtaatcctcatatgaaggatactattagtatctctgctttacaaatgagggaactgaggtacagagaagctaattgactttcccaagtaacactccagaaggaggtggcagatgcacatgcattcccaggaaggcttaggcactgtgctgtactacgtgggtttcagatccaaggtttgttgtctggtctgtagttgcaagcgataagtggctaggatgccaaactttcacagatacccaggcactgggtgggagtaaagtgaagtacaatatctcagagtaattcagaaattagaataacatatttggagttgtgtggtggtggtggcagtggtggtggtggtggtggggtgtgtgtgtgtgtgtttgggggcaggcacaggagaagttattgtagagaaagaaaagtagattattgactcagacgagttttcttctccactagaattcccgagtatatttacaacttcttcgtttcttttttctagtctaagcaaacatgtacatatttcacttttatattcccatgactcctataaagatcaaaagcagtatggagtgattcactacatgacctgaaatggacttactgtgagctctcaagatagaggaaaataattcccctcatgtggtttcccttaatgctaaggcttttctccatgtgcttcacagaactagctccagatccaggagtcccacccattagaggctgcctagattgacaaagggagggcacagccttcagtgacacagtacatggttctcccaccagttgaagtgacataccctatcagttttcccttcggtctgaatgctggtgtgactgcggacctcgtgttcctcttcaaggtcagaaacatcctccagttcctctggggtctataaaaagaaagcaaaacattgctagtgggaatgtaaaagcatttcttctttggaaaacaacgcggcagtaccttaaaagggtaatcataaagttaccatatgacccagcaatttcactcccagttatatactcaagagaaaggaaggcatatgtccacacaaatacgtatacacaaatgttcacaggagcatcagtcatgatagctaacaaatggaaaccaaatgtatgcttactgatgaatggataaacaaaatgtggtgcatgtgtacaatggaatataatttggccataaaaaggagcaaaatactgatacacaccacaacacaggtgaaccttgaaaacatcatcctaagtgaagggagccagccacaaaaggccacatattgtatgatcctgtttacatgaaatgtctgcaattggcaaatctatagcaatagagatttaattagtgtttgctaggtgctaggggaaaggggaaatgggcaatgacagctgatgggtatgtggtttctctttgagatgataacaatgttctgcagttagatagtaggaatgatcacaaacccttctgaatatactaaaaaacactgagtttcatacttcaaaatggtgagttttatggtatatgaattatatcccaataaattgtgagagaaaaagaaagcaaaaaaatgatcacagggaaaattttatttcagtgaatagcaatttggctacccactatgtggttactgcaaaccaagatgcttacagttgataaatgcattagataatcatcattaaaatcatatatcatcaaaatgccaccagaaattatcaagaaattaaaattttagggacttaataaataattcaacttgaaattcagtgtctattataaagagttagctaacttccattccttctttcaatttcagcttaaatgcctctttctcagggaggtgtcttgctcaggaatcctctagactgggctggattccctgccaagtgtttcctagccccctctactttatctgccataatgatcattatactttaatatatcatcgctgaattaggcagctaattgttgaattgtctattctgtgaggcagggacatgtcttccttgtcatttttgcaaatacatgtcaaagtgcttaacaagaattagcctagtatttgttttagtgcacaaggtctcaacttaatatattttttttatttcaatagctttggggatacaagtgggttttggttacacagatgaaatgcatgaatgtgaagtctgagattttagtgagctcttcatccaagtagtacacattgtgcccaatatgtagcttttcattcctaatctctctcccatcctccctgcttctgagtctccaatgtccattattccactctgtatgattcctttgctacaaaatcctggtgacaaacccagaaaataagtatttaggtttcatagaaaacaaccaaaaacgaagtagaagatgtccttgggcctgcatctttcatgcacatatggctgctgaagactggaaatgggcagagcccatctccttagactagctctggtttgccttaaacgttgctttacacacagacattctgtttattgtcagggctgccaatagcctttcatcccttgggagcactccagagatggggacatttgatgattagctcatattatatagcaaaactaccaatttcctattcattaatggcttcagattctttctcatctcatagatctttaaacagcactttctttgttctcacacacttgcactgagcaatacccatccctttgcagaagagcattttgcatttatttcaaccaattcctatcagatattaacatcccccctctcgccaaagccttcaatgtgctattttttatctccgtgttgatctctttgcaatccttctttgctgcaactacatgcagctattatctcaggacaatttattctttcttcttaggtattaatagcacaagttcattacgatgtaatttctatacaatcatatatcgcattattagcctttttgtgcattcttgtcacagtattcttgagaaagcatctttgcaatttccctccttgttatatcaccaggccctataacatttgaacaaattcagttaatcaaattctctttcttgtgccctgttgttttgcaactgaaggctgtctggtgtccctactgtgatctattccttataaatgtctgctgtttattacttgggttatatcctatcatgcaatgacaaataacttcatcatccactcctatagtttattcaacccccaaataaagtaacaaactaagaacaattgctgctatcagaagtcacaagtgccatttttgttggggatgctgtacgaagagataagcctaccatttacacccacatacttctgtgtttttctttgtgtttaacacaggattaatagttttcttgcaaagctacaaaaactgacctcttcttttcatgaacaaaatcagtggggaagtgttcaaaacacttgctggcagcatttcacattctgtaaggcatggtgttggatggtattgtgaaaataaatagttaaatacaaaatgctacagtttaagtggaaactaagaaagagaaaggagtactctaataattttgagggcaatacattaactccttcagcactaaacacaaataatagaaacagcaaatatcccagcactttgggaggccaaggcgggtggatcacctgagtcagatgttcgagaccagcctgaccaacatggagaaaccccgtctctactaaaaatacaaaattagctgggcgtggtggcacatgcctgtaaccccagctgctcgggaggctgaggcaggagaattgcttgaatccaggcggcggaggttgcagcgagccgagatcgcgccattgcactccagcctgggcaacaagagtgaaactccatctcaaaaaaaaaaaaagaaaaaaaaatggggtgggaaaggagggatgatagagtaccctagatcatgccttcttaaaattgtctgcttctacctatctggtaaacatctggaagttttgtgtgtgtgtgtgtttgtgtgtgtgtgtgtgtgtgtgtgtgtgtgtgtgtgtgtgtttctaatcaatttcattctgtgaaagattaactatcttagaggcagtgttatatattagaaaggccctataatattgagtaatgcagacctgaatttgagttctggtcctctaatgagtgattatgggcaatatgtgttctcttttaaagtttgtttccctcagaataaaattcggataataatacctaatcccaaaagttgttgtgaggctcagttacactaagatgctttgggtaagagcttagcccacagacctagctggattgtggcaaaagtttatttctgtttgttgcttttcctcttctttctccactaccttatacctcatcccaatatacacctttatatttttattaaacatttatgtaaatttatccaaattttaatcacctttattccaaatttaataattttaatccagtataatccaaatttatttttgatttggaactttggataagccaccaatgtttctgtcctttagattctacacagacattattttgggttgacatggtacatttactagttgcctctagttacagttacctgagtttgattatctaatgtcattgtgctaaacagggtttaatataattacccatgcactgcttccttctaaaatccatgtaagagatctcttttaattggactttaatcatgtctaacagcgaaattatctcttaaactggcctcagcaaagattcactctagcatgattctcagggatgatggaaataatttgtcttctttaagctgggctgtctctaaaccagacaaagatgaagagagcccattttttcagaaaaagtgttaatcaatgcagacattaacgttatttctcatatcagaattgtggagatatatttcatattttcctattttacctctggcttattatggtgtcttccttaggcagcccaaaagtgatttggaataggcttagtttcttcacctgtaaaatagcacaaatactacctaatttttagggttattgtaaagataaaacaagatgacggactagaacattattcggtgactgggaaatactgaattattaatattgtttatgaatattatagattatcattactgttgctatctcacttgattcaagcaaaagaagccaaaaacaaatatagaagttgaagctgaaaacattcaggctgaggtgtttacatagaagccaggacagcaatgacatagtagtaatacattaagacttcagggtcacaatacatttcatatatatatcctttttcccacaaggagttcaatcctttctatagacattatctcactaatcctttcaggatccctaatgaaacaggtggcattattacaattaaaaattcacttgcgcagactttataaatatttaatattaaaatacaaaaaagaaatttgtggttgctaaattttaaagaagagagaaaaaaacacaggaagaaaataaaaaagaaataaaaagtattaaaaatactgtggaaaacaagagtcatgcttggcttcttctcagaattatgtttgaattctaaaccatacacatgacttattaaaaatataattcactggctagctttcactgacttactaaaatcaaataaccaccacagtaatgtcaggagtggtctcgcactcagagaagctcttaggaaacatgctatgaatgtccatcccaagcaggagactaacgtcacatgttcaatgatttcattccagctgaggtagtaacgtaggatgattttgcaatgtcaaaatggagagatcacaattaaaatacatttaaaaaataaaaatatatcaatgacacaatgccaaaataaagaaaattaagacatggcccttgtttaacacacacacacaaacaaacactgaagttcctgccccacacctttgaccatgagactggcactctaccttataaatattcaagaaatcagtgacatttctgttacactgaccccttttctcctcctcaaacatgtcccacttgtcagcactttccacttaagactctttgtgtctttctatttaccccttcttgcagactggatccttctcggcatgggagctcagatgctctctactcagagaagtctcccctggccagtctaactaaagttaacccttttccccatttcatttatttcttatattagtgtatatattttctttaggtcctttttcatgattttcacctaaaattatattttctcttcatttttttcctttttttggcaggtgggttacattttttattttatccctactagaacttaacttacatgaaaatagggatgttgtttgtcttgttttccactcatgaaatggcacatagtatgtctcaatttttctatttcttagctgaataaaggagcaaacaatttaattactgacaagcttttgttattgatcaatttcacaagaaaatcatgggaacatttttgagctgtggagaatgtataatcctttgccttctgtcttttaataagtattgaatcaataattccttgcctaaagaaaagtatatgcaaatattcttgaattttaaaaaaatcctatggaaactagagatgagattttgtgtagagaaaggttttccataagctcagaagagattctcagatgtggaggactaaaaagtttatgattccataatcagtactaacttgccctactccttgacaatccaatatggataaaaaagacttcagagaaaatgtcatccagtaagcccagaacagtgtttcaaatcttaccatagccccgtgccacaaacttgtcatggaaacagtggtagacctgaaagggttacatgggctgggacaatggatgtctcattggcaaccagtgtgggtaaatgacagggtcggtgagactccctgacatcttgatgcagcccaagcctccagagacagacttagcctcaagagaagtgtttctcagtcttagcattgttgacgtcttgatctgaataattccagttgtgagaatctgttttgtgtattgtaagaagtttagcaccaaccctagcttctatctaccacacacatttggaccctctcaagtcatgagatataattaaatatgtttccagacattaccgaatatcccctggaaatttggaggcttaggaatcacccacttgagaaccattgctcaagaattttggctcacttggcccaacataggtagcaggagtaagggaaggcccaagaatgactatatttaaatttcccatgagccaagttaaaaataaatttacttgcaaataagtatgtaaactgaaagtcatatcccatataataacattatgtttacaagacaaaagagagaagacattttagtcttaaccagactactggaagaagatatcagaaaatgtatgaaaatgagttaataggtgcagcacaccaacatggcacatgtatacatatgtaacaaacctacacgttgtgcacatgtaacctaaaacttaaagtacaaaaaaaaaaaactacaaacttgcttgcagccttttttaaaatttgttttttaaatttttaattgataattgtatatattatatatttatgtagcatactgtgatgtttacaacagtatatattaacattatgaaatgattaaattctaattaacaaatctatctcttcactcatgtatcatttttttgtggtgaaaacaatattcaaaagggtctgggcacagtggctcatgcctgtaatcccagaactttgggaggcaaaggagggtggatcacctgaggtcaagagttcaagaccagcctggccaacatggtgaaaccccgtctctactaaaaatacaaaaaattagacgggtgtggtggcgtgtgcctgtaatcccagctactagggaggctgaggcaagggaatcatttgaacctgggaggtggaggttgcagtgagccaatatcatgccactgcactgcagcctgggtgacagaatgagactctgtctaaaaaaaaaaaaaaaaaaaaaattcaaatcaatatgcctaagagatatctgcacttccatgttcacaatagctaagagatggaagcaacctaggtgtctttcattggatgaatgaataaagaaactgtgagctctccctctctctatatatacacacacaaacatatacactcagtgaaatactatttagcctttaaaaaaaggaaattctatcatttgtttgtcatcttaataccagaatttaataagctgctttcattctgctgatcttgtttttatcttttattcataatgagattatctaaagatatccagtgctaatctaagtttgcttgattatataatcaactcaagttaactcaactaacatattcgattgtcttacatatacagtcatgttgcttaacaatcaggacacatcctgagaaatgtgtcattatatgaatttgtcactgtgcaagtatcatagagtatatttaaacaaacctagatggtataacctactacacacctaggctgtatggtataacccattgctcctaggctacaaacctgtatggcatgttactgtactgaatactataggcaactgtaacacagtggtaaatatttgtgtatctaaacatatttaaacatagaaaaggtaaggtgttgtgtcacgatgttaagatggctatggcatctaatatggtttggatttgtgctccggacaaaatctcatgtcgaattgttatccacagtgctgagggagggacctggtaggaggtgattggatcacgggggcagatttcctccttgctcttctcatgatagtgagtgagtttccatgagatctatttaaaagtgtgcagcatctcctccttggctcttttcttccacctcctgccctgtagatgtgcctgcttccccttcaccttctgccatgattgtaagtttcctgaggcccctccagccatgcttcctgtacagcctgtggaactgtgtgccaattaagtctcttttatttataaattacccagtcttaggtagtgctttataggaatgtgagaacaaataatacaatgtcattaggtgataggaatttttcagttccattatagccttcttaggggaccattatcctatatgcagtccatcactgaatgaaacattgtcatgcacggcatggccgtatgtagacaggaacaattatgctagatactgggaatcttgaaggaaataaaacacaatccttgccctcaagagagataaagggtaagaatattagatggagatgaaagatattccatagagttatatgatttgagactgaagttgagtggttagagatgaaaaaatttcctgggatgtgtcaggcagaagagaggaacgagtgtaaagcacctgaggaaaaactgggaagatatttcttatatcgccagaaagctggtaggcttgtgttacggtgggatattaatggaacttgaagttaggatacttgggtgtcctaactaaactagttgttttttgttaggccaatctcagacttttcctatgcttaaattccttgacctttaaaatgaagatgagaagtaagtaaaactgataatttttgtaaatcctttgaattttcagtttttatgaattgatgcttaaactgaaaacataataaggctgtgacaaacattaggctggatcaaacacctcctcaacactgagagatctcaacgctagtgaagattcggtaaatctgttgagttcagttgattgaaacatagtccactctaattcatcacatcaattcaaaatagggttaatctcctgaatacacatatctttctgttatagccaccagagggagaaggcatctagtattattctcagttttataacccaagtgtctaacggtgcctggcacacagtcagtactcagtaaatacatattttattgagttaatgcaacagaagaataaatgaagatgcaaataagatgtatgtctctatttgtcaaaatcaagaattggtgacttttcttcttacaatcttttaaaatataattcaaaactgcctccaggaaccattagcatccctctattttgttattatttttctttacactattattatcagtattgtattaacatttaatatgaaatctacccttaacaaatttttaagtgaataacatagtattgccaattataggtacaatgctgtatatatagtaggatctttatttatttatcttgcataattgaaatttcataactttggagcagcaactcctcatttcccctcccctcagcttgacaactaccattctgctcatggtttctaggagtgtaaaaacattagttacctcatataaggcaaatcatgcagtatttgcctttctgctaatggcttacttcacttagaataatgtccccaaggttcacacttgtcgttgcatatgactgatctcctttttttttaaggttgaattgtattccatcttacaagtttatcacattttagttaccctttcatctgtcaatgaacacttagattgttttcacatcttggctatcgtgaataatgccgaaataaacatgggagtccagatatctctttgagatcctgatttcaattctttgggacatataaccagaagtaggattgctggatcatatagtagttctgtttttaattttgagaaacctccatactattttttaaagcagttgtaccattctacattcccaccaacagagtactagggctccaatttcttcatatactcaccaacacttatcttttctgtggctgttgataataggtatcctaagaagtgtgaagtgatatctcattgtattttttttttcatgtccatgatgattagtggtactctggctctaagttatactaagcttgagatgaattcaattttcacctatagcatgcatagaagtgtgtcagtggacctgcaagatgttcctaagttattcttttttctttaattgtttgaattaagctctacgaataagcacacctactaaacatgctctgagacagagctgtgagtttatatcctatttccaaattaggaacagaaaatctatggtaagtgacttgcaaaacttcttacaacataaggctggaactatggtagaacataatatctaggattgactatccagattcaaggtcaaacgctgcccttaatatcttgtgacctaaaacaagaacttaacttgttgagaacacagcttcctcagtggtacatgaaaagattggactaattatttataaaatttcagtcatttttattaactttagaattttatgataggtttagcaaggtatcaggaaagataatgaatatctatttcagaaaactttgtattgtcagcatatcctttattcaacatgctgaatacaattttagatcacaaatctcttatagattgttaacttctcaggaaattagaaacagctttttaaacttcctttatgcaggactatgtaggatgatgtgagggttcttcacgcacagcaattgctgatgccattgacaattgtggcaataccattactcttcttgatctatggggggaggtggttgaaaccatgcaataataataagagcagtagtggggggaatgctaaaaatggtggtggcagcagtagtagcaacagtagcagcagatggctagaaacacaccctgaccttcaactcttatgtctgaatgtcggatcaaaaatcagaacaccggtgccatgaatatcagacctattccaatttattttagtgaggaaaatctcacctttttcatcaaactctatagccaaataaactctacatatgtgattttttttatcttatccttagactagacagtaaaagggagtctaacttaaaatttgttcatttttcttttccaaaaatgctattctatagatattaaaataagagtttcagagaatgtctaatagcagagaaaatgcacttgaaatattgttaactgaatatctgtatatatatgtgtgtgtgtgtatatatgtgtgtatatatgtatatgtgtatatatgtatatttgtgtatattcgtatgtatatatgtgtatatatgtatatatgtgtatatatgtgcgtatatgtatatatgtgtatatatgtgtgcatatatgtatatatatatagtctaattatttaaaactcatattgtccgtgtatgtgtgtgagaaagaggaaaataaaatgaaaaatatatatatatcggttgggtacagtggctcacatctgtaatcccagcactttgggaggcggaagcaggcagatcacgaggtcaagagatcgagaccatcctggccaccatggtgaaaccccgtctctactaaaaatacaaaaattagttgggcgtggtggcacgtgcctgtaatcccagcttctcgggaggctgaagcaggagaatcacttgaacccaggaggcagaggttgccatgagccaagatcaccccactgcactccagcctcagcgacagagtgaggctccatctcaaaaaaaaaaagaaaaagaaaaagtaaaagaaaatatatcaacatattttattaattatcatctatgggttgtagaatattataagtgacttttcctcttttagttgatttgtctctaagttgttacaaaacatttttctatcttttatcataaggaaaaaaaacaagcaatgagtgttataggaaaatctgcttaaggttgaacgtaccatttcaaggacgtgtcagcaatacaaaaaggacaagattgcaaaatctgcagtggggtagtatagctggccttgtcaccttgcaataggtctatcaacgttgcatgatatttgaagctgatgtggacacagaaaaaatctttcgattgacaagaggaaaattgcagtgtatgtctttattatcagagcaaacattaaagggggtggtgacagcagatacagagaagtgtcccttaccaggtcccatgctatttccctgttttgtatggtcttttttgttctgtggatgcgtaaaagctgttacttcattattttaggtattacattttcagtgtcttggaaagtggttttacaaaagttttccataacaaagattttgagggaaagagatgttgtggtttgacttcccaatggggaatatagatagatagatagatgatagatagatagatagatagatagatagatagatagatagatagacagatagatgatagatagatagagatagagatagagatagagatagagatagagatagagatagagatataaactgacacgatgtcttttactttcagaaatcgttaagctgccaggtatagtatcaacaatcctaaccaaattcatctggttacatttgcaaagtaatcctaggcacagtaataaagcaaaaaactgcctgctgtgttccagccacggatgttaagtaaggataagcaggacggccaaaactgacactcctatttcactggtcaaaaaaaaatatgaaagaaattacacattactgtaggggggtgttgctccataagacagtaattcagatctatattagacttttggacatattattcaaggttactggattgaagtttgctttatgggacataagaattccctacactgctaaattaaagtagcttaagttggcagcttatatataaaatagaaaactagaatgcgacaaaacaaatatttggacaacacctaaggaagaattatgctctgtatttaaagagatttttaagttccaaaactaaaaggcctatttgtagaggcaagtgaatacatcattgtataagatgtagtcagatataagtggctgtgaaactagctcatggcaaatgcattgtgctgtttctacacagacttgtcctgaccaaaggaattaggacaaatgaggaaacaaacttaatgtggagaattgttttttttaaaatgtccatgtatttcttaacatattaaatattaaatatatacacaccatagaatctagtcattctacttgttagtatttaccaaagaggaatagaaacacatattcacacagacttgtatacaaatatttatagcagatttatttgtaatatcccagtagtgagaacaactcaaatcttaatcaacagatgaattatttaacaaatggtatgcccatttaatgaaatatgattcagtaataaaaaggaataaatttgattaaagcaacaatatttatggatctaaaaataattatactgagtaaaagaagctaaataaaaacacatactgtatgtattagtctgctctcacactgctatgaagaactacctgagactgggtaatttatgaagaaaagatgtttaatcgactcacaattccacaggctgtgtaagaggcatggctggggaggcctcaggaaccttacaatcatggtggaaggtaaaggggaagcaagcacatcttcacatggagcaggagagacagagccaagggggaagcgctgcacacttttaaacaaccagatctggtgagaactcattcactatcacgagaacagcaagggggaagtccgcacacacgattcaatcaccacccccccaggcccctcctccaacacatgtggattacaattcaacatgaaatttgggtggggatacagagccaaaccatatcactgcatgattccatttatataacattctaaaacttgccagtcaatctgtagtggcagaaatcagatctgtggttatttgagagttggtgggaggagtgaacagattgtgaaggggtatgagtaagcttttgggtttgatatatgggttccttatcttgattatggtgatagccttggggttttatacataagccaataaaacatattaaattgtatattttaaatgtgcattttattaaatgttatgcctcaatgctgtcaaaaatgtgaaatgcctatatgaactcttattacatagtgtaacattgtttggcaaaatactatattatatatgctactaatataatatagtatagctgaagttctgttgaataaatacataaaagaagtagtaatgctacaagatcatttttaatcaattaatatacacacttattttctattttaaaaaatgaacttgattttgcagcaggggaccacatattttgttgttgagtaatgaaagatgagcttcagttgagagacaccttgttcatgagtcctctcaccagaggaacttagagatcaagaaacattgcagcttttagtaagcatgctaccaaatgtaggcttttctatatggatgtgaatgtgaaaggaccactaataaggctggcaatatggcagcaaatgtgattctcctatcactttatagtgtttatgaaatatcaaagcaagtttcatttaagtcaatggttttcaaaagtaatttaagtagtaaaaccatttttaataaaattatagaatgccaatattattgacaactatataagagtactatggagctatcctaagtaagccataacaccacggagctggtgtgtgtggatatacagtgtgaagtctggatcatcaggccactggccctgcccgccttctaaagcagcccaagagagagaccacagctgagggaccaccatgctgtgtaacctgggagagttaccgtcagatgtttgattatgtctgactgaattggcatggaccaacttttagttaaacatggaggatttaagaaaattatgcacctatacttcctcttatatacgactaatttgactatagtttatttaaaaatataccagagttaagtaataataaagcaattacaaataatcattgtaataagtacaggtggcatctactggatttcatcagctttccttatgtctttgctttgtcctatttttttttaggaacctccctctctgttactactccctttggatttatccagtagtcttagacgtcaccagggccaagccatgcatatatagattgaaatgttgttttcaaaacctactcaagctatctcttgatgaacaagattagtaccatctgattacaaccctgaaggtatatgctaaagaaaactaataataacatatactattcttaaaatcaatcattctttttacaacatgaccgaaataagtcccaggcactctttagctatgctctgtcctctcttttggaataatcttttcttcccttctaaccgtcaccttatattcttatctttccacctattcaaagtaatttagtatgtcaacaatgttttttctaacattgttctgtcttagaactttttctccctgcagatctcatccactatgcagaaaccagtaataatcatttgtctctgtaaaggtgactttgttttaaaattagttttacaatgagagagctgatctactttggaaaaggatcactgttatcaatgtggcaagatgaaaaagcatgccatattctatctacttggtttaattgaaccaagcatcagcttggtttaattgaattaaccgcaatgactgtgtttgtgtgtcacactattctttttatatttatatttattattactattttttaagagagacagggtctccctatgttgctcaggctgacctcgaactcctgggctcaagcaatcctgcctctgtctctcaaaatgctgggattacaggggtgagccaccatgcccagccacactattctttttaaatttaaagatataaaacattgatttttattaaattttaaaacagagaacttttaaatagatacagattacattcagcaggtattcatggattacctactatgtatgaagtacagtatgctaggtatggtgggactgtcataaattagatgaggataccaccattatgaagctaatgtaacattgcccaagttctgtgtactgttttattcaaaacttcatgaatattgaaacagtgttcacatttttctatcaacatacagtattatttgtaagatgaaattgttaaatttaattacaaagtgttcagtttggtttgttttgctagacaccctacaagctgttcctattactctctctcactctaatgtttacaaattgttatagcttagtgctaaagtgaacagcagagtactcttcaagattttctaggatcttgcagacaaatgtatacatatattttttactcctcatgctgttttatcactttttgatccctcctaggggattaggctgtgtaattgtaaagcttttttaggctttaactatggattatttgtataatgaaaaaataagataacttatattatatattgaactgagtaaggggtaaattcagtcattcttaggtaaaaagacaggataattaggttctcattcttgtttttcattcgttcatgtattcaatcaattttttttattaaataagcactcattaatatgccagatactgtggtagttgctgatgaggaaccaataaagagcccatgtggtatcaaagggctttcctgtctaatatttatttattctgttactctggaaaacttatttggcatctggtttcatatattgaaaaataaagatagctgtctctgccttctttatgttctatattttacctctttctcattgtaaactttgtatggtcaatggagaaggatgtggattcaactctgaatatacactatgtaaggcacacttttcattctcgtgtgaaactagttttataactcagctcagagcacacagtaggttctcactaaaaattttatcttccttctcttttttcttttctaagatggtagtgtagaagataagttgataccatgcacattcaaataattaattttaaattatgataaaccatggataagaagttgtgtagcattaatcatattaaattccttcaattgtgatgtacctatcttatagggttgttgtgaggaatatatgacagtaatgtaaagtactgaatatagtgccaagaacacaataaatgctcagtaaatattagctatcatgtcattctgacttatgtcaataaatattaagtatactgtctagttaatactgttagaattacattaaataaataatgtagaaaatttgtcctggtccagttatctactgactaggtgaccttaattatgtctttttttgttaacttttagagtctagattccttattctgcaaaatggatttattgtatctcaaggcactgtgaagtttgcagtagtaagttatatgaaaatttttaaagcattatgattataaataatatgattataaattggagaacagctgctaacacaattaagaaatttaaaaatattattgcttttttactttcactcacattttgttttgttagataattgaaaacactaagaagtaacttttagagaagctaggttgtacccagacagtgaaagtttaaataagttttaaaaactgaaaactattttctctttaaaaggcatgtataggcaaaaaggaaagtccaaagagaggaaaagaaagcaggagagatctgaaatgacacaagaagtgactcagaatgggaagattgtgcactccttgttgtcccctaatgcacatggaagtatgcaacagaagctgtgaaaataacccaggtgcgaaggccaatggttttcatacatttcaagcttctctccgtgatgtccttttccatgtaaaatctaaatcaggtgtcctatatacataacatgaaatggagatgtaatgcaactgaagctaggaaacaaaaatcttgcctactagccttctctcaaaccagtgatcagaaccctgagttatttctttgagagactaagtacaacacagaagctcaagcatagaaattaagagttaaaattatgtcaagtttcttcactgaaaaagatccctattagcctttgacctaattttgttaatttataatggaagttaacaatcactaaatgttattgcttataaatctctttacctaatttaaaacactgctagttgtagctagaaataggtatttctttatttcttttagctatgtattccttcaaaagaagctccagacttttaaaattgcaccacctcagtatttcctcagtttctttttttaatacaacatacatacacacacacacacactatcttatatatactagcttaataaatcacatggtattttagaacagatcaaaacttggaataatcatgtgggaaaaaagttgtagccaggtgcagtggttcatgcctgtaatctcagcactttgggatgccaaggcaagtgaattgcttgaggtgaagagttcaagagcagcctgggcaacatggtgaaacccctctctacaaaaaattagcaaggcatggtggcacatgcctgtggtcccaactacttgtgaggctgagttggatagatcgcttgagccctggaaaaagaggttgcagtaagaccacaccactgcactccacctgtccagcctgggtgacagagtgagaccctgtctcaaaaaaaaagttgctgaggtttaccaactttttaaaatatttgctcttagacaaccagtaaaattgtttctggtacaaaagatgttcatggtttccttccaattacaaattaaaacatattgctatggttttgttataaatacttaatcacataaatgacaacttcccacacaaccagattgaaacatgacaccagtgttatacttatcaggcagagaatttaaaatactactcttaataaaggctagaatggaaaaacagataacaaacaaaaggtagtgggtaatataaatagagagatgaaaactctaagaaaaaaatcaaaaggaaatataaaaattcaaaatcactgtaacaaaaatgaagagtgcctttgataggcacatcagtagactagacacagctgagaagagaatcagtgagcttgaaatttgtcattacctacttcccaaattgaaatgtgaagagaaaaaaaattacttaataaagagcatccaaggagtgtggaacaattagaaaaggtgtaacatacattacatgtaatagaagaaagaaaaaagaaaatgaagcaaaagaaacattgaaatgataatggctgatcgttttcagcaattcatgatgtataacaaactatagatagatgaacctcagagaagaccaaacgggataaataccaagaaagtacagccaagcatattatattcaactacagaaaaccaaagacatcttgaagaagtcagtgaaaaaaggataagaatgataggatacttataatcagaaaccatgtgtaaaccattttcatactgctgataaagacataccaaagactgggcaatttacaaaagaaagatgtttaatggacttacagttccacatggctaggaatgcctcacaatcatagcagaaggcaatgagaagcaagtcacatcttacatggatggcagcagacaaagagagagcttgtgcagggagaactcctctttttaaaaccatcagatcttgtgagactcatttactatcatgagaacagtgcaggaaaaacctggccccataattcaatcaactctcaccaggttcctcccatgacatgtgggaattgaggagttaaaattcaagacgagatttggttggggacacagccaaaccatataattccaccccagcccctcccaaatctcagtcctcacatttaaaaaccaatcatgccttcccagcagtccacaaaagtcttaactcatttcagcatgactcaaaagtccacagtccaacatctcatctgagacaaggcaatttccttctgcttatgatcctgtaaaatcaaaggcaagttagttacttcctagaaacaatggaggttcaggcattgggtaaatacagcaattccaaatgggagaaattggccaaaacgaaggggctacaggcaccatgcaagcgtgaaatccagcagggaagtcaaaccttaaagctccaaaatgatctcctttgactccatgtctcgcatccgggtcatgctgatgcaagaggtgggttcccatggtcttgggcagctccgtccctgtggctttgcagggtacaggctccctctcgactgcttttatgggctggcattgagtgtggcttttctaggcacagggtgtaaactgtcagtggatctaccattctggggtctggaggatggtggccctcttctcacagatccactagacagtgccccagtagggactctgtataggggctctgaccccacatttcccttctgcactgtcctagcagaggttctccatgggatccccaccctgcaataaatttctgcctggacagccaggcatttccatatatcctctgaaatctaggtggaggtacccaaacccaaattcttgacctctgtgcactggcaggctcaacatcatgtggaagctgacaaggcttgaggcttgcaacctctgaagccatggcccaagctcgacatttgcccctttattcatggctggagcagctgggaggcagggcaccaagttcctaggctgcatacagcacagggaccctgggcctggcccacgaaaccactttgtcctcctaggcctccaggcctgtgatagaaggggctcccatgaagacctctgacataccctggagacattatccccattgtcttggtgcttaacatttggctcctcattacttacgcaaatttctgcagctggcttgcatttctcctcagaaaatgggattttcttttctatcgcattgtcaggctacacattttctgaacttttatgctctgcttctcttatataactgaatgcctttaacagcacccaagtcacatcttgaatgctttgctgcttagaaatttcttctgccagataccctaaattatgtctctaaagttcaaagttccacaaatctctctagggcaggggcaaaatgctgccagtctctttgctaaaacataacaagagtcacctttgctccagttcccaacaagttcctcatctccatctgagaccacctcagcctggatttcattgtccatatcattatcagcattttggtaaaagccattcaacaagtctatagggtgttctaaacttttccacactttcctgtcttcttctgagccctccaaaccatttcaacctcttcctgttacccagttccaaagtcacttccacattttcaggtatcttttcagcagcaccccactgtactggtaccaatttactgtattagtctgttttcacactgctgatgaagaaatacttgagatggggcaatttacaaaagaaagaggtttaatggacttacaattccacatggctggggaggcctcacaatcatgaaggaaggcaaggaagagcacgtcacatcttacatggatggaggcaggcaaagagagacagcttgtgcagggaaactcctctttttaaaaccatcagatctcatgagactcattcactatcacaagaacagcacagaaaagacccaccctcttaattccatcacctcccactaggttcctccgatgacacatgggaattgtgagagttacaatttaatatgagattttggaggggacacagccaaaccatatcaccaaataagagagtagagtaaattttttgaattgtcaattaggaaaaagaactctacatttctacacacagcaaaattattcttcaaaaacgaagaagaaataaaaactttctcagacaaacaaatcttggaaaattcatcaccagcacatctgcccttcaagaaacattaaaagaagttcttcagtgagaagggaaatgatgtgttagaaacttagatctaaaaaaagaacatcagagaagcactaaatgaaggtaaaattaaatctttttttcttatttttaattgatctaatatgtaacatttgttcaaaataatactagtaacaatatattgtatgattgtagcattgaggtaaattaaatgaatgatagcaatattataaagagttgaggggaggaattgagaatactgtattgaaagatgaccctactacccagaaagcagttttatgaaagtggacctaattgtaaatgtatattgcaaactctagggcaagtactcagttttttaagaaaagtataagttatatgctgacaataaaaaacaaaatagaaaccatatgcaatgattaaaactagagaaggtagaaaagaaaaaagaaatgaaaacaacagaggtaattcatagaaaacagaaatactaataatcactttaaatgtgaaaggtctgcagcatcatttaaaagacagagatgttcatgcttagaatggagtattcttcataaatataaagaaatgaactatcaagctatgagaacacctggatgaactttaaatgcttatagctgggtgaaagaatcccacctgaaaaggctacagactatatgatcccaattgaacagtatgttgaaaagaacaaaactagaggaacagtaaaacaatgagagactgccaatgattcaaggcgagaggaggaggattgaataggtgaagcgcaggccttttttgactggtaaatcaattttgtatatattaatggtggatacatgacatacctttgtcaaaagccatagaaatttacagcacaaagagtaaacctcaattatgtaagttttgaaaaaatcatttaggagggctaggatcctaggaaagaatgcaaagtttgacaacattatttacacatgttctgattgtaacaaataatctcactgtatggggtatggagagggaaaagttgctgatctaataaactttgaaaattaatgtaatccataagactgaagtcaaaaggaattaccagtaagcaatatgctgcacttgataaagctactttccataagggtacaggttaatgattctcataatgttatactagtgtactgaaattaaacagttaggtaaacaaatgatggtgatgggagtcaggtttttcattgttagaatagaagtttatagatgaacaagggaagaaggctagaatataaattcatgtttagctaaatatagatacagatgtagaaacatttatggacatgtggatttaccttagttagtatgcacacatatattcccttgctctgtcagctgtcacctaaaagaaatgacaccttagcagcaacaagcatggctgacactcagattttggtttctgataccattcaccaataaaggggccagggctccttagagaaatgctaattctacgactgggaaggaaatatatagaaagaacctgaagtattagatactgccaaaaaataaggaagaactaaaaaatttaaatctgcaagtacacactgaaagagttgtcaatagccatatctggaataatttgagcagtaaaataaacaaagcaatatggaattctaacccaatgtataaactaaatatccataagtccatagtgatagaaataaatgactgaatatataaataaattgaagaacatatacaaatataccctgaaaagcaattccaagtaaattccaaataattccaaagtattatatagcctgccctcaaggagcggaaaataacttccactccttaactgtgggctacatagtgacttctgtccagggtagagtgtagaaaagggggaaaatggccgggcgcggtggctcacacctgtaatcccagcactttgggaggccgaggtggatggatcacgaggtcaggagatagagaccatcctgctggctaacacggtgaaaccccgtctctaccaaaaatacaaaaaaattagccaggcttggtggcgggcgcctgtagtcccagctacttgagaagctgaggcaggagactggcgtgaacccaggaggcggagcttgcagtgagctgagatcgcgccactgcactccagcctgggcgacagagcaagactctgtctcaaaaaaaaaaaaaaaaaaaaaagggaaataaactttatagtgtagatactacaacctcagccaggtcatcaatgtcaacatcaacagcaatacctaatatcaatacttgaaatgatatgataaaaatggtactttttctcactggtcttcctcccaaaaccacatattcccagactaatcataaggacaaactcacaaattccaataaagtgacatcctacaaaatctcttatctgtattcctgaaaactgtcaagttcgcaaaaacaaggaaagtctaagaactgtcacagccaagaaaagactaaggaggcatgactattaaacgcaatgtaatatcctagatagagggctaggaaaggaaaaggacatgagataaatactaaagaagtctgaataaatcatgaacttaatattacaatgtgcacttattaatttttaacaaaagtactatatgaatgaagatgttaataataagggtataagccatatgggaacgctatgttctatcttctcaattattctgtaaaactagaactgttttgcctgtaattccagtactttgggaggccgaggcgggcgaatcacgaggtcaggagtttgagaccagcctggccaacatggtgaaaccccatctctaataaaaatacaattagctgggcgtagtggcagacgcctgtaatcccagctacttgggaggctgaggcaggagaatcgcttgaaactgggaggcagaggttgcagtgagctgagatcacaccactgtcctctagcctgggtgacacagcaagactccatctcaaaaaaagaaaagaaaaacagttagaactgttttataagataaagtattttcttaattcaggaactaacaaggtagaacattaacatacaaaagttactaatcttcatatacacaaacaataatcacttagtcaatatagagaaaagaaaataatctgtttacaaatgcaatagaaataacaacttatttaaaaataaatttggaaaaaatgagctaaatttctctgagaaaaactttcaaatatgccaggtccacataaaaacctgcacatatatttatagcagctttattcataactgccaaaaattggaaggaaccaagatctcctttggtaggtgaataaatagatatactgtggtacatccagacaatagatattattcagtgacacaagcatgaaaaaaaagctgccaagccagaaaaagacatggaagaaacttaaatgcatattaccaagtgaaaaaaaaagccagtcggaaaaggctacatactgtatgattccaactatatgacattctggaagaggcaaattatggagacaataaagatcaacagttgccagggcttagagggaggggatgtataggcagaacacagaaggcttttagggcagttaaactactttcattacattatgatggtgtttaatgtccaaactcataaattatacaaccaagaatacaccctgatgtaaggtacagattttgggcaaaaattatgtgtcaatgtaggttcaccaattgaaacaaatgtacccactctggtggaggatgttgataacgggaaaggctgtgtgagtttgtgtgtgtgtgtgtgttgtggaggctatctctgtaacttttattcaattctgctgtgaacctaaaaaatagtctgtttaaaaaaaaaacaaaaaacaaaaaaaaaacttggctgggcgcagtggctcatgcctgaaatcccagcactttgggaggccgaggaggacagatcacctgaggtcggaagttcaagatcagcctgaccaacatagagaaacaccatttctactaaaaatacaaaattagctgggcgtggtggcatatgcctgtaatcccagctactcgggaggctgaggcaggagaattgcttgaacctgggaggtggaggttgcagtgagccgagattgtgccattgcactccagcctgggcaataagagtgaaactctgtctcaaaaaacaaaaacaaacaaaaaacttctattaaggtacaggcaagcagcaagctactctcacattgggcctctggaatactggcaggatgaaattcctcaaccaccatggcattggagttgccagggaaagctgcttagagaagtggtaggatcagaactccagccagggtggagcccagagggtttggtgtgggattgtctgtagtgcagcatggccagggacacccatcaccttaagctcgacttgcttccataggagactttagccataggagaactgttgaacgtgaactctgcagggcggtcttgcctctgagatggggttgattagacctgggcaaccctcagtctactggcctcttctggggccccagcctggccgtgcctgcttgcagtgcagcccccaggtacctgtgggtgtctgcatcatagctcctgctcttgtggactgcacctgataagcagagtgctcctgcagagtggcccccaagacacacaccaggccatctgtgtcctcccctcactgcagcctcccccagccactgtgcctgcatgaacacaccataggcacccccccacatcacttagccagtgcctatgtgtgcccttgggttggatcttgcttttacttccccgacagtgcacatgaaccctgcactatgccatgccactactgcctgcatgagggtaccccaccacccttctccccaccacaccaccattgtcctaggagcattggcaggcatgaaacctgcctgcttcacctctgccagcatcctgcccctgtgccaacactgccatcagtgctaaactaggcacacagaacagtgacctgcccccagccctgagcggccaccatgccagcatgaacacatgcagagggcacacatagtcctgcacccaccacaaacatacaacacaccataatctctgggacatagctaaagcagtggtaagagggaaatttgtagcactaaatgcctacatcaaaaagttagaaagatctccagctcacaacctaacattacaattaaaggaactagaaaagcaagagaaaacccaccccaaagctagcagaagacaagaaataactaaagtgagagctgaactgaagactgagacacgaaaaaccattcaaaacatcaacaaaatcaggatctgttttttttttttggaaaaattaataagataaactgctagctagactaatgaaaagaaaagacagaagatccaagcaaacacgatcagaaacagaaaggggaatattactactgactccatagaaatacaaagaatcggccgggcactgtggctcacgcctgtaatcccagcactttaggaagctaaggcaggaggatcgtgaggtctcgagttcgagaccatcctggccaacatggtgaaaccctgtctctactaaaaatacaaaaaacgagccaaaaaatgagcctggcatggtggcacgcacctgtagtcccagctactcaggaggctgaggcaggagtattgcttgaacccgggaggtggaggttgcagtaagcccagatcgcaccactgcactccagcctggtgacacagcaagactccgtctcaaaaacaaacaaaaaaaaaaaaaaaagaaagaaatacagagaatcatcggagactattatgaacaactctatgcaaacaaactagaaaatctaaaagaaatggataaattcctggacacagacaaccttctaagactgaaccatgaagaaactgaatccctaaacagaccaataatgagctctataattgaatcagtaataaattgcctaccaaaaaaaaaaaaaaaagaagaagaagaaaagccctggaccagacggattcatagctgaattctaccagacacacaaagaagagctggtgcctttcctactgaaacttttccaaaaaattgtggaggaggtgccccctcttcaactcaatctatgaggccagcatcatcctgaaccaaaacctggcagagacacaacaaaaaggaagacttccggccaatatccttcataagcattgatgcaaaaatcctcaacaaaataccagcaaaaatccagcaacacgtcaaaaaactaacccaccacaatcaagaatgctttattcctgagatgcaaggttggttcaacatatgcagatcaataaatgtgaactaatgaagaaaacattccatgctcaatgatcacactgcacaaagtaataatttgtagactcaatgttatttctatcaaactaccaatgacatttttcagagaactagaaaaactattttaaaattcatatggaaccaaaaaaaggcctgaatagccaaggcaattataaacaaaaagaacaaagctggaggcatcacattacctgacttcaaactatactacaggactatggtaacaaaaacagcatgatactggtacaaaaacagacacacagaccaatggaatagagaatagagagcccagaaataaggccgcacatctacaatcatctgatcttcgacaaagttgacaaaaacaagcaatggggaaaggactccctattcaataaaaggtgctgggataacaggctaggcatgtgcagaagactgaaactggaccccttccttacacagtatacaaatatcaactcaaaatagattaaagacttaaatgtaatacctaaaattataaaaaccttggaagaaacctaggcaataccattcaggacgtgggaaggggcaaagatttcatgacgaagacactgaaggcaattgcaacaaaagcaaaaattgacaaataagatctacttaaactaagagcttctgcacagcagaagaaattatcaacagagtaaacagacaacctacagaattgaggaatatatttgcaaattatgcaaatattttctgacaaaagtctaatagtcagcatctataaggaacttatacaaatctataagacaaaagcaaacaatcccattgaaaagtggacatgaacagacacttttcaaaagaagacatacatgcgtccaatgagcataggaaaaaaagctcaatatcactgatcattagagaagtgcatatcaaaaccacaatgagataccatctcacaccagtcaaaatggctattaataaaaagtcaaaaaataacaggtgctggcaaggtagtggagaaaaaggaaagcttatacactgttggtgggagtgtaaattattagttcaaccattgtggaagatctgattcctcaaagatctcaaaacagaactaccattcaacccagcaatcccattactggatatatacccaaagaactataaatcattctgccataaaggcatatgcatgcatatgtttattgtagcagtattcacaatagcaaagacatagaatcaaactaaatgctcatcaatgacagatttaataaagaaaatgcagtacatatacaccatggaatactatgcagccatataaaagaatgagatcatgtcttttacagaaacatgaatggagctggaggacactatccttagcaaactaatgcaggaaccaaaaaccaaataccacatgttctcacttataggtgggagctaaatgatgagaactcatggacacaaagaggggaacgacagacactggggactaccaaagggtggacggtggcaggagggagaggatcaggaaaaataactgttggttacttgtcttagtacctgggtgatgaaataatctgtacagcaaacccccgtgacacaggtttacctatataacaacctgtacaagtaccccagcacctaaaataacatttttttaaaactccagaacatacaaaatgtacttgaaaaaaaatagaaaggcaccccatgatctacaaataaacatcacaaatatgtaaattctcctatgttaatatagttgaatcctatcctaataaaaatactacaagatacttttctggaataaaacttgtgggaaaaatatctagccatgtgcagtggctaatgcctgtaatcccagcactttgggaggccaagacaggtggattacttgaggtcaggagttcgaaaccagcctggccaacatggcgaaaccccatctccactaaaaatacaaaaattagccaggcgtggtggcagccgcctgtcatcccagctatgggggaggctgagacatgagaattgtttgaatgggggttggaggttgcagtgagccgagatcacgccattgcactacagcctggtcgacagagtgagagtctgtcttaaaaaaaaaaacaaaaaacaaaaaacaaaaaaaacagaagaaagagagaaataaagcgagaaagcatctaagaatatcctggaaaaaaaaaaagtcgatgaagcgggattagcccaattagaaatgaaaatatacactaggtgatctgaaatcagtctatactggttctcatatccacagcacaatgtaacaataaaagaaagtctagaaataaatctatatttggcaggtaataaggatgaaatctcaaaaatgtttgaaaaaggtagacttttttaaatgaatgaggttaggaaaactgtatactcattaggcttgacataaaatggatgtgaacaacatactctatagcagaataaacttcacatgaatttttaaaaatctaacttaatagaaaagtaacatacagaaatagaagaacatctggataaattatttacatcctcatttgggtaaactctagcaaagactcaaaatgcaatgcaatgaaataaaagattgataaattcaactacaggcatattaaacattaattgaatgacaaaaacaccacagtcaaaatcaaactataaataattagaagaaaatatcgacaacatgcaactccgataaaaagctaatatctctaaatgtataaaaaactcataaaaaccaagaaaaaagaacattaaagtgatcttcattttaaataagaggtattaagactccacaaatatgtcatttccaccctgttagactagcaaaaaatttaaaatcttaataatacactctgttggtgtggctgtggagaaatagcactttcatgcactggtggttagattgtaacagttattttttctaagatacaaatcaatctttggcaatttctataaaaaatctgtatgagaagttcattatttgtagatattatagaaaatattaaaaacaaattacatggtttactatgtagtactaaaaataagatgaggaagatttgtatgagataattagaagtgatattcaagatgttcaattaagtgggaaaaacaagtataagaatatataggtatcagaagcattttctgtatgaaagaaggaaatttaagaatatttgctttcaaacagaaacatagggtagataattagtcattaaccaaaatggttaactacaagatgcaggtgtgaatggatgaaagaattaagaatgggtatcagacttgtgcaagcatgcgtttgtatctgtggtgattttttattcatataaaggtcaaaatgtcacaaaataaatacacatttttaagacagcaaaccataaattaaatataaaaataagaattgatcctaatagttattaacagagaaaaacaaagatttaagtcaaggaaattttgatcacagtactctgtacactcttggttggaaatattataacaaaagaatcttgaactttacatggtaatggtactggtaaaatgattctgaaaatattttgtgtgattgtagatagagtgaatgtttaaagatattgttgtattggagaactagaattcttaatgtaagaagagatactgaactggaatgaaaaatgataagaaaatattcttgatcttatatttgaataagaggtattatttttcataatgcaatatttcttagctagtaacagtaaaagaatgacacctcaattgcaacaaaaacacataacaccgaggttttgatgactaaatataattcttcactacaaggaactagaactgtttggagatatggttctttctggctaaggtaatgtgtgcaatgaacgttgaatattttgttgggcgagaaggcaaaaaaactgccccaaacctagagatcatgactaaaaacacagagaagctagtttaaaagttctcccctaaaaatgtttgggacaaattagctaaaaaaattaatgatttcagtagtgttaatgtattaaatcatttcatcaatcccatctgtaacagtgagagagaaattgaaacagcttttctttgtagaaaaatcacagctaaaacatatagaaagaataaaataaaatcactattttgctaccagtaatgtactaattgattaaagcaagaatcatcaatggatgctaaattcattaggtaaaagtgttgttgaacaacaaggatgttactatgatctctaagtatcctcaagcagataattaagaacaaaagaaaaagtgtttcttcacaatgcggagatattgcagacaccgcctttactaagtaaaacctatctatcattactgaaacaaaatagcttgcatgcactggtgttctgctaaatgtttaacaattgactctaaaacacatgcatataaaaagggcaaaatgcttatataatatttacaaatattaatagaaacgatatgtaacacaattttttttttttttttgagatggagtcttgctctgtcgcgcaggctggagtgcagtggtgcgatctcagctcactgcaagctccacctcctgtgttcatgccattctgcagcctcaacctcccaagtagctgggactacaggcgcccaccaccacgcctggctaattttttgtatttttagtagagacgggggtttcaccatgttagccaggatggtctcgatctcctgaccttgtgatccgtccttctcggccttccaaagtgctgggattacaggcgtgagccaccgcgccaggccacgtaacacaatttacaaataacatataatactctttattgtaaactgcatataataaatcaattctcaaagaatattttcagttttattgccaaattgtcttcaattcatgttttggttgttaagtgatgaataagtgtagttctaacatggatgttggttaatatgtttgtttaccttaatgagtaagaccaacaaaaaacaataaagatgtatgccagaacttaatcatggcataagctactttttactaaattggataatagttttcaaacactaaatagtaatttcttcactttttttttttggtgttacaaggtaattgttatacacacagcaaaatataagtttagtctacattattaacacttttctccatcactttctgacaatcagtatcataaaccatgttctgatgtgtagcatttgccaattcttgcaatgtaattactgcacaatggcctacttccagctattaatgtgacatcactgaaagcggagtttagaagagagcattgtgttgtattatctccatgacagatgtaaatttggtaaaataattaagaaggaatgaaattttagtatctattacatttgcttaatacttattatttgtgagttcacataattttttttttttgagatagagtctcactgtcgcccaggctgaagggcagtggcatgatctcagctcactgcaacctccacctcgtgggttcaagcaattctcctgactcagcctcctgagtacctgggattacaggtgcgtgccaccatgcccagctatttttgtatttttttagtagacatgggtttcaccatgttggctaggctgttctcaaactcctaacctcaagcgatctgcccacctcagcctcccaaagtggcttgagccaccgcgcccagcctagttcacataatttaatgtttaataatgaccatgtttaacaactagctcagagacttcttgagacttttttttagcaatcagcttccagcaaaccactgctttgacgtgactcctgtgcaacgcaatgaggatacaatatcagcttcatagcacttctacaaaagatatttaatcttttaattataaggaaacaatcaggaaaatccagaatgttagatattcaaaaagccctctagcttggaatcttcaaaattataaatgtcatggaataccaaatgtaaaaaaacaaagtaggaggactgttctggattaaagaaaaccaagaggcatgacaagaaaacccaatgcatgaatctcaattacatacaatggcagggggcagggacagaaaaaaatttaaaactaaaaacaatacttagagaaatttgaatatgaaccatatattaaataatacaatatcaacattaaatctgttaagtataataatattgaggttatactggagaatgccattgattttatgagatacgcggaacagcaaaaataagtttgtggactgggtttggtgcctcatgccttaaccccagcagtttgggaggctgaggtgggtggataacctgaggtcaggagttcaggattagcctgggcaacatggcaaaatcccgactcaacaaaaaatttacaaaaaagtaagtgggcatggtggcacgtccctgtggtcccagctactctggaggctaatgtcgggggatggcttgagtccaggaggtggaggttgcagtgagccaagattatgtcattgtactccagcatgggcaacagagccacatcctgtcttgaaaataacaacaaaattttgtgcatagatatataaataacaataaatgatatatatctatatagagaaaaaacaaagaaaataaaatagtaaaacttattaaatctaagtaaaagaacaaaattactccaaagaaaaaataaaagcccgcagtctttgaaaagtatatgaaagaaataataataaacccaaatatatgtatatatgtatgcattaaatttaaaatttgcattttcaaagacaaagtttgaaactttctccttgaatccagaacaattattttagttgctatttattgagcaacaggtgtggatcaagaatctggcaatttactttatctatattatctcaatgcctccaaccacatgatgacatagtaattcttattgttacagataacaaactttgaatactgactatctttgggcaatgatatcatgctatataaccaacaatccataatggtcaaagaaaaattgtttctatatggccttgtattttgttgaggcaaagaaaacaatagtaggcttattcatgataattctttatgtattttgctcatttgatgataaaaatccttatttaaaagacgaattgggctgggcgcagtggctcacacctataattccagcactttgggaggccgaggtgggcagatcacctgccatcaggagtttgagaccagcctggccagcatggtgaaacccggttggtttcacttctaaaaatacaaaatacaaaaatattaaaaatacagaaatcagccaggtgtggtggcatgcacctgtaatcacaattacttgggaggctgaagcagaagaatcgcttgaacccaggaggtggaggttgcagtgagctgagattgcaccactgcattccagcctgggaacaaagggagactgtttcaaaatgaaatgaaatgaaataaaaataaaagatggattgacaatgatcaaacatctggacctttacacatcactctctctaaataagagtaatttaacattggtcttcatttcttcacaatttcaaatttctgcactatatgaccaggaaagccaaagtttcccccaggctttctggtcatgttgtttgcctctgccctgtgtgatttttctcctgactcaatgaagggaattctaaaatctgacagattagcaatgaaatcttttacaccatttcctaagattcctcttagatttatggctgcacgcttagggatatcatgatgccgaaatgttaggcgagaaataaaactatattttcccctttcttacttcagtggagcacaatttccatttattcacactgtatttcctcacacaatatgttcttcccacccaaggctataaatttgaaaatatttataggcaagattacccctgatgccatttataccttgatggctttgtgtttcagctcctaagagccactcatatgtcatatgaatggcttacaaccatgtactgccttggatttttccctgtcaaatgcaaggcccttctttgactacaatactcttgattcaatttattattaataacacaccctgctaatgacttcaaagaaagcctctttatgtgtgttcagaggtttcccaactcttgctttctaggttttacaagtcacttttagattttgagagtgagggttgtgttccccccttttctcctatatgtatttttataaaaatattcaaattatgacatttctcacactacaatagaccatcataattgtccctctcattgtgtcatatttttcaagtgaaggacatggacagacactgcaagcattatacagctctgggcgggaatcaggcagacaggcctgtagtttgtacatagaaatccagcctcagtcatcctgagatgatgtttaggtcaaacaagaagggaatatcctgggttgaactccaataaagagactttgccttcgtccggttctcccttttcctgatgattttgtaaagggactaggaggatcaactgggtatgtggcaatgggggcttttgtggttttgaaggtggcctcattagtgaatatgagtatcttgtaactgcacgctccatgtctggcatgttgcatagcaatcattaaagcagctataaaactttcagatatgttgagattttgagcagctccatttatgcacagagtagggaccaaaattctaactaactaatcgccacataacatgaagagagcttagaaatcctaaagagagaaaacctattagttgttcctcatccttcaaatttttgcaccaaaagcagagaaccagaggaaatgcaatttaacttaatagtaaacccccttcaaggagattaattaatccctcctcctttcaattctttccagatgaatgttgttaagtaccaatgtaatcgtatctggtatctttgaggtatagtgaactctgaggaaggtaatgttaagatgcatttcaagagtataaacaatccacgagcaaagtagagaaaaaatttagtctcctgacattttataatacaattaacctgaagaacagagatctatgttacgatttctctaattttatctttctaatgatttaagccctattcataatgtcgttaggtattggggtttccatttgtctttatgtatttgttctctcctagcaataaaatgacctattgtttattggtcactgttgaacaacatacctgaataactctttaggaacattctgtcctattctgcaaatcccacattgcatggctaaaaaggaaatgcagccaactcatttgtaaaagacctatgtgaggaagtgccagttgttatttttaaacaatttgttataacagaagtagttctgacttttcttcttaattgcttggatagttcatggagagtatcttctctcttactttagtctatgcttctttatgtttttatttaagagattttgtcattgttgttgctgttggttgtgatgatacttgaggagaagcagggtttaagaaacatcataatctaagaacatttcaatagaaaattttctgagtctgggtacactggctcacgcctataatcgcagcactttgggaggccgaggcgggaggatcacctgagctcaggagttcaggaccagcctgggcaacatggtgaaactccaacactactaaaaaaacaaaaattagcctggcatggtggtgcatgcctgtaatcccagctgctcaggaggctgaagcatgagaattgcttgagcccaggaggtggaagttgcagtgagcttagatcatgccacttgactctagcctggcaatagagtgagaagactctgtctcagattaaaaaaaaaaaaagaaagaaagaaagaaaaatttctgagaaaatgtttaattgcagtatagtttgcttaacagtaattagtttaatatttaaaatttcaagaatgtttgaggttaaaatttacattaaagaatattgttatttataccaaaaaaaagcaaagagatgactccccagaatttaggattgaatgaagatatcctcaaacagttaaacaattgttaaactgtaaaatcaacatataatttgccaagatcagagacataaaaattctccaattatggagaaaatctccatcctaagacagatgtatcttaacttgcctcaacatatttaagtgagatttggagggatgaggtacagataaatatagattaaagttttattgtttttgtcatactccagtgaattgattttatataaacgataaataatttattcatctgatagtgacaaaatatccccaaaataacagcacatataagagaggttgacttaaaattgtacttagagagtcactgaaaacagtaaaacaagcaaaacactgtctattcgaattcaagcattgccaacaaattgatgataatgtgtattctgaggcagatgtttccttatagagaagatggatagcccaggttattaaagatatatcccatatgtctttcgcaattattgtctccatgtctgtggattctctttttattctcttgaaagtgtctttcacagagcagaaagcttacattttaataaagtccagcttatcaatgctttctttcatggatcgtggctttggtgttgtacctaaaacgtctttgccaaagctgtttacctagatttttctcctaccttttagaaatgttataggtttgtatatttatttaggtctttatccatttttagttagtgtttgtaaagcatataaagtctgtgtctaaattcttttcatttgtttgttacatgtagatatccagttgctccaaaaccatttgttgaaaagactatcttttcaccattgttttgccttgactctttcatcagtggtcagctggctttatttagttgggtctatttctgggctctgtattctattccattgatttatttgtctattatttgaccagtatgacactgtcttgattatggaagctttatggtaagtcttgaactcaatgttggtcctccaacttttttcttttctttaaatattgtcttgtctattccaggtcttttaactctacatatatactttcaagtcattttgtcaataaaataactttctgagattttgattgggattacactgaatgtgtagatcaagttggaaataatagagccagttttgaaacaggatttaaacaagatctgttcagctccaacattaaccttttgctatgacactgtgacagcaattaaacaaccataaatcacaggttaaaactgatatatttcaaagacattttaagaattagagacctcaccacaatgcataatacttgtttttgggtagttttcttcagtgaattctaatgctataggtattactggcagaaattttctaggaaaagagcagagtataaaaataataaataagacaagcatatggaaagaaaaagtcagttgcagaggaagaaaagttaaaaggattgtgtctttttaaggcggtgaataatacttagtagatcatctcaaatgtttctgatttctggctctgcttccagaatagcaatccattttaagcagttaaatacactaaatttctgacagtgtaatatacaatactttatgtattttattggaaaaatattttaatatatctggtctcatatatttcctaatagaatataccaccaccattattatggaactcaattataaaaatatgaaccatttgacagaaattggctatcctgaaaaattggaatacatatgcattattgatcaaaatatgcttacagtaccaaaaaagcatagagttagttcagtgtttttaaagcttgatattatgataccaagcaatagccgctgaaatagaaaggagtatactttataaaattaaaatcaggtttttaaaaaattttcttcagagggctaactggtccataattgtttttaagtttcttgctgaaaaattgaaataggtcccaggagaacttatggcactgataaagtaaaactgtcactttccagtttggtcgtcaaatatatcatccctctgtctattacacacagcagttctgccacaaatcttgtttctactcacaattaattaagcaaaactaaaatgtttaaagctaccacaaatcaaatttaatttaaatggctacaataacttaaacagagataaatgaaatgactttcttatgcttcattacttcctctaattccttttaaaacatttctgtagaagaagttctgaggatgaggagacaggggtggaccaatgagatttcaattaaactaccaaagtaataccttaaccgcaggtggtcccaggaccagttatttccacttattccattccctttgccacacagacactttaatgtgaattttaaagatatatatgttacaattttcagagtctgatttatcttaaaactttaaaccatatgacatttctaatgtaaaaatgtaatcttgatttaggtgcttaattaaaaggatggctgctttattaataactcaattataagtttaaaatatgtcatagtataatctaatgattgtactgttttcccccatgggacctttaaatacacacaaaataattctatgccctgatagaattctattttttgttgttgctaagacaatttatttttgttatttcgtgacttcactgcattttattgcatttctgtgatttctttttttactgcagcatctctaaaatctcttcttacagtttgggcatagaattgagagcaaaatggaatttatcgcaactacctcatgcattttttcttaaattgaaatcagattacacaaatacttatgttttgtttccatggttatgcaagaaaatagtttttcagtcacttatacaaatctatgcagaatttatacatgtattgcttattttattttatctttttatcaaacttagcatgttaggaaacattactaaattctgaaaatgttaggaatttaattaataatgtatttgtagcctcgaccatcttaagaaaaatatatggtgttggctggttaatttatatttatttatttatttttttttttgagacagagtttcgctcgtgttgcccaggctggagtgcaatgacataatctccgctcactgcaacctctgcttcccgggttcaagtgattctcctgcttcagcctcctgagtagctgagattacagggaccagccaccacacctagctaattttgtattttttagtagagacggggtttctccatgttggtcaggctggtctcaaactcccagcctcagatcatccacccgcattggcctcccaaagtgctgggattacaggcgtgagccatgacacccagccttctatttaattttttaataggcaggcattaatgtcagttaatgctatataaaatgacatatatggagaagtctcaataccaaaattgccttctattccagtatccactccccttccacatatgcatacttttagggaactctataactagtttatttatttcagtatttctcttaggaaaatgtaatgaaatgcatatttgtatacccctacttttgtataaaaagtagcttctatattatgcatatacactattctctcccttgctttctttaataatatttccttatgaacaactcatatcagtatatagacatcttcattcataaaggagaccctacaaactactaagtatttattactagttaccaggaatcaaaagaatagccttttagccatcctttgaagtatatccatatgccgttcaagactctaaaacctgtaagggctactccacagctctagcacatggctttcctttccaaggcccttctccacacaaagacaaaggggaatgtacattagcaccatatcatgtacaggtaaactagagtggaatagagaaagcctacagatatggaagtagcagagaggcccatgaagctgtccttatgccccagagaggtttgctttgccccagtgggcatagttgctttaaatatatcattgaaaggactccaggaaagagttcctgacacccaaatatctctatatatcatttatagagaaagtggggaagggtttctctactctaaatgactatgtaaaaataggtccttcttggtgaagaaaatggtcttgtggaaagaggtaaccactggttctcaatgcctgataacagcagtcattttcattgcactaacttggacctgctgagccagcttattgcaaagcaagtaacagggaagggaatgagcctccagggtcatctgggtttgtttctcttcattaagtgttttttattttttttcataagcattgctgcttattcatagatacacatagagatgcagaatcaaaatgagacatgaatgctggttatcagctgcactcactcactaagtggctttccttctttttcttttgagatggagtcttgctctgctgccaggctggagtgcagtggcatgatctaggctcactgcaacttctatctccccggttcaagcgattctcctgcctcagcctcccgagtagctgggactataggcacgcgccaccaagccctgctaatgtttgtgtttttagtagagacagggttttaccatgttggccaggatggtcttgatctcttgaccttgtgatccacctgctttggcctcccaaagtgctgggattacaggcatgagccaccgtgcccggccgaagtggcttttttatatctcagctttatactatgaggtgaaaatttgagtcttagtaaaattcaaaatactggcccttccaggtcattttcagatggctgaagctagtcaaaccaggagtagcaactgcctctactgaataaaatacaacagtgtaaatctaatataataaaaagaactagacctgcctcagtagaatatgatctggtttacactgagtaatagatactttatttaacaggagttactccaaactttcatgcaagtattcattagacctctcccactctctggacaccacataggatctaaaggaatatgagttggggtccagcataaagacaattacagacaataggataagacaaatggcactctgttaataaagcatgtattctgtttgtttggttggttggttttttgagccacagtttcactctcgtaactcaggctgcaatgcagtggcatgatctcaggtcactgcaacctctgcctcctgggctcaagtgatccacccaccttggcctcctgagtatctggaactacaagcctgcaccaccatgcccagctaatttttgtattttttgtagatacagcatttcaccatgatgctcaggccagtctcaaactcctgagctcaagcaattcacgcgcctcagcttcccaaagtattgggattacaggcatgagccaccacacctggtatttttaaccagggaaaatattagtacttaggagatctgatagaggcagaagcagtaaagggcagtttgttgaaataatatgaaaagttttcctgtagaatatgcaaattttgactggttagaaagtcagaaagaaatgcttttgttctgaggatataaaccttctaaattgctcttgaaggttgaaattttttggttgctgttttgttgcttcatgttttaattattattatatttatatctctcttgttaaatctggggtatggggaacagtgccattaccagagaagaatttacaggattaaccttaaatagaagaaagtgtctctcttctaagtattaagaaattatctctgtaatagtgaacttatcggtaatatgattcagggacaatcattctatgaaatataattaaatgcccaatattcttcttttttaaaaaaagtttctattagatttttaaagtacagctataattcatgttgtttgtaacaaaagttgcaaagattaaaaagaactaatattttaccacttgtcctcctttctcagtctctgaagtataatcaaaatgatatgatatatagtgttctcattttatccaggtgttttatgcatctgtagtatcatctctttgtttgtagaacaacagatgactctccctcatttatttttaaaggctacataatactccatagaataactgtaccatggtatttcagacagccttttgagggacactcaggttgctttcagttttttttttttttttttttttgtcgttgttgcgccaatgctcttaacagtagaaaaatacctttcaatatatatctatatttagtggctgttttatacctgtaagatacgtttataaaagtatgtaaaatatgtttatattagtatgcatattatgtttagtatagtatgtatagtatgtatgtatagtatgtatgtatagtatgctatgtttatattagcatgtatgtatattaatatgcttataaaagtatgtaagatgtgtttataaaaattgaactctggattcaattttaatttgtatagagactgctagtttattaatttatcaaaatccacatcaccatatacttagtcacactagatgctatccccatttttgttcttctgaagggtgatacaaggcagctcattattgttttatttcctatatccttgattgtaaacagaattgaaactcatatccttattgctcaaatattttccttctctgtaatttacttttccatttttctgatgaatcatttgcttttcttagtattttcaggagcttgtcatatattatgggcattaatgtcgggtcatttacaataaaaacatttttcttgtcaattttttgttcttttactctgtttatagtatagtattgcctatatttttagttatattttatgtaaaccagtcctggcttgtttaagaaaaatctcaccacaaaaatgttgcacaaatagtatctactagtttttaaaaataatatatatatgctatggtttgaatgtattcctcgaaaattcatgttgaaatctaatccccatggtgttggtatgaataggtgagatgtttgcagaagtgattagtcgtgaggtctctgccctcgaggatgggattagtgcccttatcaaagtgactgaaggagtccctttggctcattctgccagaacacagcattccccttttcattatgtgaggatacagtacttcctgcttcctccatatgaggaatacagtgagaaagtgccatctctgaagcagggagagagccctcatttgacaccagagctgctgggtctttgaacttgtacttctcagcctccaggactatgagaaataaataaataaattatccactctaaagtaatttgttatagcagcaggagcaggttcaggctaaggcattatgtgtgtatgtatttataaaatgttgcacaaatagtaactactagcttttaaaactaaatatatatttatatgctatgtatatatgtacactgacagctacttatcatattcaataagttttaaatagattacaaatctaaatgtacagttatatacattaattttgaccttacatgtaatgaacatgcattatatttagatatttatgtatataatttaactacatagttataattaactgtaatttaactacgtagttaacaatacttgttatagtttatagttcaattatagttaactatatagtaaaattatgtgcacatatatctaaatatgaataaatgcatatatatctaacgcatatatatgtatatataaagctaaatatagttaactatatagttaattataactagttataatatataatatataaatatatataactctatatttatagttaactgcatagttagccatatcattaaaatatatgcatatgtatatttaaatataaggaatgttcattatacataagattaaagtcaacatatataattgcacatttagattattaatttctttaaaaattattattgaacattgtaagtagctgtcagttttttgttttccatgtaaatatccaattaagccagccataactattaactaataacttcattagttaaatgggtactgaattcaatcaaatcattttgtggaattcactatacaattatatttttcttcttttattgtgtttttatcaattatactgttagtttttctaatgtatgaacacccttacacttttaaaataaagtattcttgatcacaaatgatattcttattgcactgtaaaatttgatatacttttactttatttagaatggtagcattcttaatcataagtaaaattagtttgtagtttacattcttatgcatctttttcagattattaaaattacagttctttataaattaaattaagctgagtatcatccatttttatagtctttcactttaaaaacaatggaataaactatctcattattatagcaaaaaaaattaaaccataaaagtatcaggcccttgtatttatttgtaatggtaaatattcttcaatatgtttttccacacttcaataaaagtttttcttttccttctttatggtttctaaatgtccttgagttaacaatggacttggattattatttcataatctttctaatccacaatgaacttattttggtttttctttgttttccataatggttgatatggtttggctgtgtccccacccaaatctcatcttgaattgtaactcacacaattcccacgtgtcatggggggaaccccgtgggaggtgattgaattatgggggtggatatttcctggtctgttctcgtgatagtgaatgagtctcatgagatctgatggttttaaaaacaagagtttttctgcacaagctctctttgcctggcaccatccatgtaagatgtgacttgctcctccttgccttccaccatgattgtgaggccttgccaggcatgtggaactgtaagtcccttaagcctctacttttggaaattgcccgtctcgggtatgtctttatcagcagtgtgaaagcagactaatacaatggtgtttgccaaaatatatctattatggtcttttaaaaaaatagcttaatttttttctatttttttatttttaatttttatagatatataatagtcatacatatttatgggctacatgtaatattttgataccagcatacgatgtgtaatgatcaaatcagggtaactaagatatccattatctcaagcatttatcatttccttgtgttggggtcattctaaatatcttctattttgaaatatataatagattattattaactatagttaccctataatgctattgaacactacttattcctcaggtaaaactacttatcattccatttatttttattagctgattttctagttcattataatcacatatttttgttttaaacctgatttcttaaggtaaaaacttatcttttaatacttttactgaggaataatgttatgctatacagtgtagcattgtaagtgtacaatacaattatttttaataagggatgggactgtatttcttgagttgtttcccttcagtggcttcaatccattattaggtccttgtctaatttatatatttgcatttctcttacgaagtataaactgtatttaataaacttttaaaatgcaattataaaattgattcatcacttgagcaaatatgttttattccttcataagatgtcaataattggttcaagagttggtaatataatatgtattcaatctagtggcagaaatagacaagaaaagacttaattgtaattcagaatgtcatgtctaaattgatatttagataaagtactatggggacaacttatgaaggactggttacttctagcttgaaggaagtgtgataggagggctgagataagataaagttttcacgaagaagctcacatctgacatagctttcagagactttcttaaaagagaaaaaggaaaatgttttaactaaaaaatgataatagtatgtgcaaatattaggagttataatgacacatggaatatccatagaattttgaggatatttacttctgatgctcttcagtttgttttcttatgtttggtaacatgaaatttaaaaagaccaaattcaaaagtttcataacaaatgagtcacacgtgactcatttagcaagaaaggatttcttcacttacaaatctttggatttctagaatgtactaaagatagaagtatctcctgtaaatatctgataaaaagagatatacttgcctctgttcttcagccactgaagggaaacaagaacgacaagctcatccctaaggatgatatcatgcaccttcctaataactttaaatgtcttgacatattaaagtttgagttaagctacaccagagttaaaagcaccaaccaattcctcagtcactttctatacatgcttcaattctttttaaaattaggttgaataataagttatagcttaatcattgatttaactagaaatgataatcatctggatcatattaatattggaacacatagattgaatgctatagaaataaaatttatgtggctacatttctgccagggaacttaaggagtcctataaatcatcatttcagataatccaaataaccaagaatgtggaaatcatattgtatctatgcttattcttgtttatataaccatgacaaattatttttacataattgacacagaatcatttcattcctgctgtaaaaagaaggaaaaataagtaccattcaaaaacattctactaaacttgacagaaatattaagacagcagaagatgttttcaagatattgaattatgaataagcagaatgctagaataaccatgaaagttaaatatacatccaattttacaagcacttggaaaaataccagaaaataaagatacaggcactgataatacagatattaattgtaaatgatatactatgatggaagttgataactaatacaactcattagctaaattatatttccaaaacaggaagcacagatatacataatgggacaaaaagtaaaataatgaaaactaagaatgttctaacaacacaaagtataaaaattctcatgtatactttcacaatataaagaaaactaacaacatgtattctgaattcactgtatcagaatgtcttatagacattaatcaaagtctaataataactaaaaatgattttaagatgagaaagagtgtataagtttttaaactaagattcttggtaattttcaaaatgctgtgcaaactatgcctatgaccctcaagagcatttttgaaataaaaaagaaagtatgactttttcctattatcacctcttctggcaatgctgtacactaccatgagctttgactacattttccagccttctaaagtgccctactgaaactttgttatcctttctctttattgaaagtagtccaattcactgagctccaggaatgtgtaaataattttcagtaagtcatcgttcagtttgagttttaagccattattttcttgaatattttttgtgcctcattctcactctcacctgggactctaattaaatatatgttaaaagttttaatattatctcatagacaacttgggctctgttgatatctttaactttttttctcttttcttcatattgatctatcttaaagtttagtaattatttcctttgtcatcttcattcttctataaagcccataaaatgtttctttttcaaatatgcgtgtttcagtatgtttcagttttataatttgcattcagttcttttaaaatattttcaatttctttactgagatttcctatttatttattaagtttattttattaagcatagatttattggctgatttatagtctttatctgaaatttcaacatctgggtcgtctcagggttggactctgttaatcatatattttttctttgaatgtgaagccagtctgtattgtatccaagtcattatttctgcattctctaatattcctccaaagaaagatactatttttatattagaaggcaattaattggttaggctcaaattacatactttgtgtgcctatggagggagacagccaaaatctcagtgttgttcttttagccttagctgcaggatgttttgagtctgctgcagacatgctcaattcacctgtcagcctgagaattgggcaaagtttgtataccaatttgggggctcttatcttctggatttctcttttctgagatgcctctccaccttactttctagtacctgcagttatcccaggctcattcctggatgccaagaggatagattctctaccacagtgttagttatttgcagtccactgcacctgcagactgtccttacactaagactaaaaaatgaaaacgtatcctatgctggtcctgtcttccaagttttgtatcatctccaaatctgcctctgatacttaataatttgtttacacacacacacacacacacacacacacacatacctatataatataaattatacataataagtttttttgtttatagttgtgatctgttggcgggctggaccatttgaaacttactccttactctatcataccagaaatggaacttttagtaattaatctgaagggctgcaatctctatcatcactcataaggtcaagattaaacccatacctttaaacacagctcaaaatattcagcaaataaataaggcagtcactactgatggtagtaattattgtccaagacttgtattttttggagatatttcttatccccaaacatatccagcttcaattggtttatttctggtacttaatccttggttctactcttttatttataatccagcaaatcctctttggacttatattttaaattactcctgactctcaggtctccttatcaaggatattagtctactgtagacttaaacaatcagctcttttaacattgagcaactagagtaaaatatacctactacccaccctctcccatactacgacaggtcttttggaatcttacttatatagcacattcacaaaagacagcctacaaatatatcttctgctgcaaaggatgtttgttttagtgggtcttaaaaatatcttgatattcattttcaagggtggatttttacattagctgtggctcttacttgcaagctactgttaatggcaacattttcccatttgccgaaaactactcacaatgacagtggcttccaccaacaattttcgtcaaaggcaagtgatagtatatttcgtttttagaaactccctgtagtagtttctggcaatcatctttttctctctctactttttgaaaaagttcatatatatatatatatatatatttcccttgaacaatttatatgaagctcaatattaggaaaatgtcctattaattttttaacactcactagaaagcaatataacaagatgacctgtttaagcccctagtacagctgtggtaaccaaacagttcttttagaggaatatgtgcacattctctagagttgtttgacaaagagttgacaaacattttctataaacagccagacagtaaatattttgggctttgtgaggcatacaatattttccacaacaactcaactttaccattgtagcacaaaattagccattaaaactttatttacaaaaataggtggcaggcaatttggcctgcgggctgtagtttttcaatctttgctcaagagtatagtgtgaaacaattccaatttgccattgaacttctccagcattcttttatgtgtcccaaagcagacagaagtacagagactcataacttagagagaactcttgcatcttaaaggcaacttaactcttgtatcttaacagtaacttcctaggtattgatatgagaactcattatttcagtgattccataagccaagtgactaagacacttggcgagagatacaaattatggaatttctgctgtcctactcaactggaaaatcagtatctgtgttatacttgtgccaccaaattaaataaactaaacttcatgtcacattttgatttcaaaagtggcaccattctataaaagttatatcttaatcaggaaataataaaagaaatacctgtggctaaaaatggcaaactgatcaatggaaaaaagtccagaaacaaacccacacacgttcctgatctacagcaacaacaataatatgaagctttggtgctgtggggagcggaggaccatcttaatacattgcactaggtcaagtggatatatgtatgagaaaaacatcatctagattctcatctcacaccatacacaaaagttaatgtcataaaaatgtgttatataaaagtaaaatataaaacaataaagcttttagaagcaaacattagagaacaattccatattcttagggcaaataaaaagttgatacattgaactatataaaagccaagaacttctgttttttaaaagacattgttaatagagtcaatgaatccacagtgtgaggagcgtttcccagaataaagaaagaactcaaaaaaaatcagtaaggaaaaggaaacacaacagaaaaaatgaacaaaagattgaaaagacactttatcaaagaatatatccaaatggccaaaatagtatattttaagaagacttcaagttaattagttatcaaattaaagtcatgctataccattacacatccaccagaatagattacgtatgctgaaactctgaaaggtagacagaagttagactggtcaggcatcttgggacccaaggaacagcatgatggtgaattacctgggtttttattctccctcatatatcccagacttggagctgaagaagctgaccacaggcctaaagaagcttgcaaccgactaaagaaaggaaacaggagggatccttgtgatgatagaaatgttctatatcttgactctatcaatgtaaatgtcctgtgattttgttgtgatgttggaccacactttacaaataccgccatcaggaaaaaactagtaaaggatttgtgaagcttctattacttcttaaattcacaggtgaatatacagttaaaattagaaagttaatttaaaatatttattcaatgctttctgtgtgccaagtacaattatagatgctaggaaataagcagtgagcaatgccaacaccatctcttcaagatgtttgcaatctagttagggaaacagacaataaacaaacaataaaaatgtcaagtggtgaaaatgaaggaaaaaaaaacagtagtgaacatatagaaagatagaggagatgatatttcacatatggcattgggagtggtcttggcatggtcaaagaatagtaactaggcctttgtatccaaagtgtggttaatgaggtggagactggtaggattttgagttccaacatagtgggaagccagatcatatagtgccttcactcataataaggctcaattttaatctaagtgtgtgaaaggtgctgagggagagggatcatgtataattttgaatagggcattgccttgttctgacgtgtttaaataaggtgactatggctgtcttgttgagaacagactgatgaggaggacgtaacctattgattttcagttttgtatttcatttgcatttgggttttggttttgttttgttttgctttccttatttccttttttaaaatttttccataagttattggggtacaagtggtattggttacatcagtaagttctttagtggtgatttgtgagactttggtgcacccatcacccaagtagtatacgctgcaccttatttgtagtgttttatccctcgtccccctcccactactcctcgcaagtccccaaagtccattgtatcattcttatgcctttgcatcctcatagcttagttctcatatatcagtgagaacatttgatgtttggttttccattcctgagttacttcacttagaataatagtctccaattccatccaggtcactgaaaatgctgttaattcattcctttttatggctgagtagtattctatcatagataggtaggtaggtaggtaggtagatagatagatagatgatagatagatagatagatagacagatgatagatagatagatatgtagatagatagatagatagatagatagatagatagatagatagatagataatcacactttctttatccattcattgagtgatgggcatttgtgttggttccacaattttgaagttgtgaattgtgttgctataaacatgcatgtgcaagtatctttttcgaataatgatttcttttcctctgggtagatacccagtagtgagattactagatcaaatggaagttctacttttaattctttaaggaatcgccacactgttttccatagtggctgcatgagtttacattcccgcctgcagtgtagaagtgttccctgattatctcatccatgccaacatctactgttttttttattatggccattcttgcaggagtaaggtggtatcgcattgtggttttgatttgcattttcctgatcattagtgatgttgagcattttttcatatgtttgttggccatttgtatatcttcttttgagaattgtctattcatgcccttagcccactttttggtgggattgtttgctttttcttactgatttgtttgagttcattctagattctgtatattagtcctttgtcagatgtacagattgtgaagattttctcccactctgtgggttgtctgtttactctactgattgttcctttggccgtgcaaaagctctttagtttaattaggtcctagctatttatctttgtttttactgaatttgcttttgggctcttggtcatgaaatctttgcccaagccaatgtctagaagggtttttccgatgttatcttctataatttttatagtttcaggtcttaggtgtgcatcttgagttgatttttttataaggtaagagatgaggatccagtttcattctcctacatgtggctagccaattatcctagtaccatttgttgaaaagggtgtcctttccccactttatgtttttgtttgttttgtcaaagatcagttggctgtatttgggtttatttctgggttctctattctgttccattggcctatgtgcctatttttgtactagtaccatgctgttttggtgactatggccttataggatagtttgaagtcaggtaatgtgaagcctccagatttgttctttttgcttagtcttgctttggctatgcaggctcttttttggttccatatgaattttagaattgttttttctaattctgtgaagaatgatggtggtaatttaatggaaattgcattgaatttgtagattgttttggcagtatggtcattttcacaatattgattctacccattcatgagcataggacatgtttccatttctttgtgttgtctatgatttctttcagcagtgttttgtagttttccttgtagaggccttttgactccttggttaggtatattcctaaatattttatttttatttttatttttttgcagctactgtaaaaggggttgagttcttgatttgatgctctgcttggtcgctgttgttgtatagaagagctactgatttgtgtacattaatcttgtatctggaaactttgctgaattcttgtatcagttctaggagatttctggaggagtctttagggttttcaaggtaaatgatcatgtcatcagcaaacagtgacagtttgacttcctctttaccaatttggatgccatttatttctttctcttgtctgattgcttggctaggacttccagtactatgttgcagagtagtggtgagagtgggcacgcttgtgttgttccaggtctcagagggaattctttcaacttttccccattcagtataatgttggctgtgagtttgtcatagatggcttttattacattaaggtatgacccttgtatgccaattttgctttgagttttaatcataaagcgatgctagattttgtcaggtgctttttctgcatctattgagataatcatgtgatttttatttttgattctgtttatgtggtatatcacatttattgacttgcatatgttaccatccctgcatccctggtatgaaacccacttgatcatggtagattatctttttgatatgttgttgggttcggttagctagtattttgttaaggattttagcatctatgttcatcaaagatattggtctttagttttttgttttctgtttttttttttttttttggttatgttctttcctggttttggtattagcatgatgctggcttcatagaatgaattagggaggattccttctttctctgtcttgtgaattagtgtcaaagggattggtaccaattcttcttagaatgtctggtagaattctgctgtgaatctgtctagtcctgtattttatttttgttggtaatttttcaattactatttcaatctcactgcttgttgttggtctgctcagggtatctaatttgtcctgatttaacctaggagagctgtatttttccatgaatatattcatctcttctaagttttctagtttatttacataaagatgttcatagcagccttgaatgatcttttgtatttcagtggtgtcagttgtagtgtctcctctttcatttctcagtgaggttatttggattttctgtcttcttttcttggttaatcttgctgatggtttatcagttttatttatcttttcaaaggacccgttttttgttttatttatctcttgtattttttgtttgtttcaatttcatttagttctgcttggaacttcgttatttcctttcttctgctgggtttgggtttgatttgttcttgtttctctagttccttgaggtgtgactttagaatatcagtttgtgctctttcagtctttttgatgtaggcgtttagggctatgaactttccttttagcaccgcctctgctaaaaattccagaggttttgttaggttgtgtcattattgtcattcagttcgaataatttcttaatttccattttgattttgtttttgacccaatgctgattcaggagcaggttatttaatttccatatatttgcatggctttgaaggttccttttggagttgatttccagttttattccactgtggcttgagagagtgcttgatataatgtcaattttcttaaatttattgaggctcattttatggcctattatatggtctatcttggagaaagtttcatgcgctgttgaataaaatgtgtattctgtggttgtgagatgaaatgttctatatatatctgttaagtcatttgttccaaggtatagttttaattcattgtttctttgttgattttctgtcttgatgacctgtctagtgctgtcagtggagtactaaagtcccccactattactgtgttctgtctatctcatttcttaggtctatgagtaattgttttataaatttgggagctccaatgttaggtgcatatatgtttaggattgtgatatttttctgttggacaaggccttttaccattatataatgtccctctttgtctcttttaactgctgttgttttaaagtttgttttgtgtgatataagaatagttaccctggcttgcttttgatgtccatttgcatgaaatgccttttcccacaccttttctttaggtttatgtgagtccttatgtgtaaggtgagtctcctgaaggccccagatggctggtgagtcctcatgcattctgcagttctgtattttttaagtggagcatttaggccatttacattcaaatgttagtattgaaatgtgaggtacctttgcattcatcatgctttttgttacttgtgtactttggatttttggttttgcttttgttatttacttgtgtttttgttttataggtcctgtgtgatttatggtttaaagaggttctgttttgatatgtttccagcatttgtttcaagacttagagctccttttagccattcttatagtggtggctaggtaatggcaaattctctcagcatttgtttttctgaaaatgactgtatctttccttcatgtatgatgcttagtttcgctggatacaaaattcttggctgataattgttttgttcaagaaggctgaagatagggccccaatcctttctagcttgtagggtttctgctgaaaaatctgctgctaatctgataggttttcctttataggttatctggtgcttctgtctcacagctcttaagagtctttctttcatcttaactttgtatagcctgatgacaatgtgcctaggcaatgatctttttacgatgaatttctcaggtgttctttgtgcttcttgtatttggatgtctaggtctctagcaacacaggggaagttttcctcaattattcccccaaatatgttttccgaatttttggaattctcttcttcctcaggaacactgattattcttaggtttggtcgtttaacataatcccagacttcttggaggctgtgttcatatttttttattctattttctttgtctttgatggattgggttaattcaaagaccttgtctttcagctctgaatttctttattctacttgttcaattctattgatgagactttacagagcattctgcatttccgaaagtgtgtctaaagtttcctgaattttttattttttttttctttaagctatctattttcttgaatatttctcccttcacttcttgtatcttgttttggatatccttgcattgggctttgcctttctctggtgcctccctgattcatttaataactaacctcctgaattctttttcaagtaaatcaaggatttcttcttggtttggatccatggctggtgaactattgtgattttttgaggggatgttgaagagccttgttttgtcatattaccagggttgcttttctgggtctttttcgtctgggtaggctctgtcagggggagggtctagggctgaaggctattgaccagattcttttgtcccaaggaatgttcctttgatgtagttattctcccccttttcctatggttgtggcttcctgtgagccaaactgcactgactgttgtctcccttctgggtctagccacccagcgagtctacccggctacaggctggtactgcaggttgtctgtacagagtcctgtgatgtgaactgcctatggttctctcagccgtggataccagcacctcttccagtggaggtgctgggtcggggggtgctatggactccatgagggttcttagctttggtcatttaatgctttatttttgtgctggttggcctcctgctgggaggtggccatttccagagagcatcaggtatagtagtatggagagggactgacagtggtggggctctagaactcccaaggttatatgccctttgtcttccactactagggtgagtagggaaggaccatcaggtgggggcagggctaggcatgtctgagctcatactctccttgggcgggtcttgctgcagctgctgtggggggtgggggtaagattcccaggtcactggagttgtgtacctaggaggattacggctgcctctgttgagtcatgcaggttgtcagggaagtgagggaaagctggcagtcacagacctcacccagctcccacataaactgaagggctggtctcactcccatggtacccctgcaacagccccaagtctgtttccaggtgaagggcgagatgggcttgaaaacttgccccaggctacctgcctttcagctatgaaagaaaagggcttggttattccccctcctgtggagtctgcacacaggatttgcaccctctccccatttctggccaggaggcttctcaccctgttcaaatttttacaaagttccgttagtgatttcctcctccctgtggagttttaccccctgctcctctggccaccctcccaatggatctctgtggtgccaggaaggaataggctgctaggggacccagtgagctcccagggcctttctgctgctttctctacccctgtatttctcttggttctctaaattgactcatctccaggtaaagtcagaaatttctcctgcaaacagaccttcaggttctccagtgggggtgcgtgtttgagagaggagggtctccctttcccacttcttcagttaggacactcacagtatttgcagtgtctcccacgttttgcaggagcagtctgcttccttcagagggtctctgggtcctcttgggattgctggtttgttcttgcagttgatttcacttcttacttctgggtttcagttatattattatatataagctatatgcacaaggagattatattttttggcagtgatgcttaaaaacttggattccagacccagactgacaatcactagctgcatgaccatgttcaagttatttagcctctttcatcttcaatgttttcatatgatctatggtgcaataatagcactcaagtcagaaggcttttattgggattaaatgtgttatatgtgtaaagatcttcaaatagcttgagacatggtaagtaccatggaagtgtttgctatgtcatttttgtgttggtacatatttgagtaacattgtaatgaaaacaattaaaagcaacatgggagaaagcataaaaattattttccttaagagggttcatactctagtgactttgaaaaactgtttgagagcgtgctaatgtcatatagctcagatgcttactatttacacatcagtaattattgtaggggcagggaaggcactataaaatttgtctgtaaccaaaaattaaatatttttttctaacttgcaggccaatcacattttattttaattttaaaattaaaaacccaaatatgatgtatatagtaaataccatcaagatacctattaatgagaactattattttctaatttcttgagtggaagttattgtagtagatatattctgctttttgtcctgcatttgtacatttgggcaacttctcttctctctgtattgcactattgggaatataggtcatagattgccaaagtgtcctgttctcctggccacaatcattgattcaggaataggaaggtatccaagaacagctaaccagtttccacatggaattggacatatggacactgttttttttttttttagatgtttccctcttcccctcagacacatagcaataagagccaaattaacaacacagagtctgtctgagaattaagttaaataatcccaacgtgaactagaaaaagaaagaaaatctctgtaaatgttatttaattatagaacaattgacacaatacataaaaatatggttgtgttctatgtgaaatttgtctttattctagaatagtgattttaaacatgagagattcttacctaataatatcaattgatcaaatttgtgatactaaaacataaatcagtattcatccttccaacactggttctatttacatgaaattgtatcattttagaggggaacaaatgtgatttgccgttttttaaatgaatcttctgtaggtcacattatatttgggagtagtttctaattattattcaaaaaaagaaagaaaggaaaaagggaaaatttctgttcctatctgacacttggcatattagtcaagatcaaatacagaatacaataccctaaatgaaaataatatgtgctatatacaccatggagtactatgaatccataaaaaagaataacgtcgtgtactttgcagcaacatggatgcaactggaggctgctatcctaagtgaattaaggcaggaacagaaaaccaaatatcacatgttgtcacttaaaagtgagagctaaataataggtttcatacagctaaagaatggggaccctatagctcatatgccatatataaagatggcaacagtagacactggggaccactagagtgaagggggtggaggaagagaggggaacaaggaatgaaaaactaattattgggcaccatactcactacctgggtgaagggatcaatcatacatcaattttactctaagtaaaattgcattatgcaatatacccaggtaacaaacctgcatatgtaccctctgaatccaaaataaaagctgaaattataaaaaacaaaagaaaatagtatgtgctaaatatttatatggtgttggttagtcatcatttctaaaaacccaatgagtcctaatgccagtcttctcaaaagctcatatataggatagaggaaaaatggtgaaatatatagtatttatttacaaagagaaggcactatagatgttcatttacttcactgtagtgaagtattattaccatcttattatatatgtgcatgtgtcatcattttgtataccttcaatatacacaatacaatttatttatttattttattattattattattttgagatggagtcttgctctgtctcccaggctggagcgcagtggtgcaatcttggctcactgcaacctttgcctcccaggttcaagcaattctctgcctcagcctcccaagtagctgggattacaggcacctgccaccacacctggctaatttttgtattttcagtagagatggggtttcaccatcttagccaccttggtcttgaactcctgaccttgtgatccatcctcttcggcctcccaaagtgctgggattacaggtgtgagccaccgcacccagccataaaatttattttcaaaaatgctttcacagaaattatctcatttgaacctcaaacaaaaccttcaagaaggtaactgcattattttttaagaaaaaagtttcacagaggccaagtgtgatagctcacacctataatcccagcactttgggaggctgaggtggccggatcacctgagatcaggagtccaagagatcaggagttcaagaccagcctggccaacatggtgaaacctgtctctactaatggtgaaaccggtgtctactaaaaatacaaaaacttagcaaggcatagtgatgggcacctataatcccagctacctgggaggctgaagcatgagaattgcttgaacccaggaggcagagtttgaaccgagctgagatcgcaccactgcactgcactccatcctgggggacagagtgacagtctgtctcaaaaaaaaaaaaaaaaaaaagaagaagtttcagaaagattaagtagcttatctatggttaaaaacaaaaagcaaaaaactggtaactcacagaggtagaatctagtctcagttcagctgtttccaaatctctatgtggtacataacatattttcgaagtttgcatctcatgtgacaatgtgggaggcataatcaaaacatggaaacatgaaacaactagagaagtaatcacataattaactattataacagcaaaaaaaattaaaataggattaaattgaaggggtgaatgaaggttagtgtgatcagttagtatgatggcagaaaaagaaaaatattcaatgtgtcctaaaggatacataaaacaggaacaggtgtcgatagagttcatgtaacagtaagggacatttcaggaagcttgagtttggtgggaggagtggagctttggagatacaatgggaggttggagaggtgtgaagaaaaaggtgatgtcactttataaaggaaactggaaagtaaggcagagcaatttagacttgaaggaatttcatttgcttctaaaaactgaagtattgtaacatgcaatatgcctttcacaaacaaaatagtcacatatgcctctcagaaagaaaaggtaccatgaaataagagaaagggacataggacactgtgctgtatgtaaaaaagaggagagattaagtgtgataaaatgttctacttttaaagcaggtaattccacctttctgccaacaattattattttaaaaggaggcaaatagaaaaaaaattatatgttagattactaaagaatatacttcaaatctataagaattgaagcagttagaaaaactaaatagtttacaaatgtgacagcaaacgttaagtttcctgtgagatttacaatgtctttgtatctgccctagagatcactggggcttaatagaccaccaagtacaaatgaatcgttttaaaagattttaacgtcttttgaagttcctacttagaagtaggatctttaattgactaataattgtgttaaatcaaaatcatggaaaataagaatgtttataatattattttactttaatttttggcaaggtagaaagttatttaaagagacatcaaaaacaagttgatctactttattactttgttaatctatgtcctctgagaagcagacatctcatgggattaaaatcaggaggaagctggaaaaggctaagagaacagtcagatcatgatgaaattattaacctgagtgaaggagagaagaaaggatgattgggtacaaacttcctagactgctgtgcagtttgaggaaaatgaagtgaagttactgaggagtcccaaggcacaggtagccaccagaggcatcaagtgtgtccagaaattggcctgccttaatatcccagatacacctagtcatcggctaagcacagcccatgggaaatgtagacatagcctcagcatagatgcaatcatgggtttcagagcatgacagctggagctcttggccaattgccctccttgtggttggagatctaagaggtgcattcctatgggtgccagagtcactttgcttaaggctggacatgatctcatgcaacattaaaaagagcttttggcattttatttttgatgaacaatatataactgtgagctgtctattctactggaatttaatacttctattactttgtagttcttatattgtgtcacaaatggaaactccccataccatattgtgaagtgacatcctgaaagataatgagagccacagctataggcaggcaatgccaccgtttctagtaggccactgaattatccgtccactcatctagttaaggtatccatttattatttttttttaaaaaaatacacatagtctggcctttgcctaacttttcaacctcatcttttatatttcacctatggcttactgtacactatcgttcagtggtttttttctgttcattgagcaagccaaactcattataacctcagaatagtaatagctatactctcctttgcccggaatgttcttttagattttcacatgttggactctcacactattcagacctcagtgcaagtattactacctcaatgaagctttggttgatcagctcatctaaactagcaccttgtcatccaacaacagctatccaattactggtgcttttttatattatagtacttactagtaactgcaataatatcattttgttattctccagtctttgtagatttgtgtccctggaaaatcatagaactaatgctctctaccatataatcaatatctagactagcaattggcagctaaaagtcaataaatatttgttgaataataattgacaaaagaagacttctatatttcagttgctataatgggtctgagaattcaaagatatgatttcttccctcactagagattatagtccaaatagaaagtacagtctaattgcttagaaattacttttccctcacctcctaacagtcatctattctttcttaagttgctccaggcattccttctcatgtaccaattaattgtctatttttgttgttgttgttgttacataaataagttctttagtggtgatttgtgagattttggtgcacccatcacctgaacagtacaaattgaagccaatctgtagtcttttatccctcactcccttccttccctttacccccaagtccccaaagtctattgtatcattcttatgcctttgcatcctcagagcttaggtcccacttttgagtaagaacatacaattcttgcttttccattcctgaattacttcacttagaataatagtctccagtcccatccaggttgctctgaatgccattaattcattcctttttatggctgagtagtattccattgtatataatagtttctttatccactcgttggttgatgggcatttgggctggttccacatttttgcaattatgaatattgtaatgctataaacatgcgtgtgcaagtatctttttcatgtaatggcttcttttcctctgggtagatacctacagtgggattgctgggatcaaattgtagttctacttttagttctttaaggaacctccacactgttttccatagtggttgtactgtttaccttcccaccagcagtgtagaagtgttcccttttcactgcatccatgccaaaatctattatttgtttattttttgataatggccattcttgcaggagtaagatggtattgcattatggttttgatttgcatttccctgatcattagtgatgctgtgcattttttatatgtttgttggccatttgtatatcttcttttaagaattttctattcatgtccttagcccactttttgatgggattgtttggttttttcttgctaatttgtttgagttccatagattttggatattagtcctttgtcagatgtatagatggtgaagattttctcccactctgtgggttgtttatttactctgctgactatttctttttctgtgcaaaagccccttagtttagttaaatcccacttatttatcttcgtttttgttgcatttgtatttgggttcttggtcatgaaatctttgcccaagccaatgtctagaagggtttttctgatgttatcttctacaatttttatagtttcagtcttagatttaagtccttgatccatcctgagttgatttttgtataaggtgagagatgagaatccagttgcattctcctcctcattgtctttttttttttttttttttttttttagatggtagaatagctctgaacaacagagactttggaacaacagaaatatggcattcaagaaggcaatttctctagaactttatttccacaaattcataaataataaaacactagattgcatgcttctgaaaaatttgaagttttacatatcaagatcttttagaattttcttgaataaaacattactacatttggtcaacaaatgtctgctgataccaaccatgcaccaagcaatgttttgaaaaaatggagatacaatgcagatccaaacagataaaatccttacagacttagtgtttacttggaaagagagatatacacaataggcaaagaaatgaatatcacaaactgagatagggctttgaagaaaaaaggcaccaagtagggaaaactgcatataaaaggcttagtctagttatatagatcagagaagatgcttcagagaaagcaatgtttacccaaaaaaaaaaaaaaaagttactgggtaaaagtgaagggtatgtagttaggaacatatgaaggcaagagccttctagcagatgaaacagcaagtgtgaaaaaactgaaagaaatatctaacaaggggctgggcacagtggctcttgcctgtaatcccagcactttgggaggccgaggtgggtggatcacttgaagtcaggagtttgagaccaccccagccaacatggtgaaacctagtctctactaaaaatacaaaaattagcaggtgtggtggcaggcacctataatcccagctacttgggaggacaaggcacgagaatcacttgaacctgagaggcagagattgcagtgagccgagatggagccactgcactccaacctgggcgacagaggaagactctatctccaaaaaaaagaaatatctcacaatgacctgaaagaaaataaggaaccataatatgtgtaagtccttgtaaagtttgtaaattaggctaatcttaattttaaaaagcaaacaaaaaactaactatgctagcctttatttaaaaaaaaaaatcctaactttgggctgggcacagtggctcacacctgtaatcccagcactttgggaggctgaggtgggtggatcaccagagatggtgaaacaccatctctactaaaaaataaaaaaatagccaggcatggtggtgggcacccgtaaccccagctacttgggaggctgaggcaggagaattgcttgaatctgggaggcggaagttgcagtgagcagagatcgcgccactgcactccagcctgggtgatagagcaagactccatctcaaaaaaaaaaaaaatttaatataaaaaatgacataaattaaatgtgcacaatctatggaccttaagcatgtgttcgttatgatgtcctgcttggcaaagcttctagaaaaactgttgtttggttaggctcatccaggtttggactagccaagtatggaagaaatcgagcagtactggttctaatgatggaattagctgaaacttggagccatgattttgcaggtggtgtgatgaagaatggcagaccctggatttattgaaaatttaattacatacttagtacaattaaaccatgaaatcatgagggaacaaaaaaaattaaaaaaaatcatcaatgctgctgggcagctggaaacattttcatattacagacttaacttctattatcagtgtcaatatctatatcatcctctaatatctcatatgaatttcgctaatggaattaggaacaaaatcaggtggcaaagagcaagtatgctcacttattgataaaatacactggcgttgtttgatctcttcttcacagtactttgcttgtcctttgttgccctgaattacatgtatcccttatgagatgaaaagctaatttatatgattgatgttatatgcttcctgaaagtttaagtatatgaccaaatgagagagcagcaagaaactcactattttttaaaccataattgtgaaagatatgattaaaaatatagagtttctatatttgatagaaaacacaaatttatgtaatgatcttttcattagtttagcaaagcctttgttttcctgcagtaaatgtataattacaaaacttaatttagtatttggctcaattaactctctgcctgtaagttatagaacttttgtaacctgaataattgaatatgttttacattatcctatgtaattgtttgtttttaattttagacttaacattcttgtttattttatctatattattttatgtatgtgtgtatatatatttatttttcttgtttatttcagacattttgttatgattttttgattttgatgaccattatttgcgagaaaatttccaggtaatttttcattcattgcatctatgataaattgatggtatttctttaggaaagaaatacctgttttatcaagcaatcaccttcagaagaattcatatacagtgaagaagaaaatggtccttaacccattagttgaatgaaccctggagcctgtgttgcagctagcttgtcctcacattcatatctaaaccctgagctacaaaaaatttcatcattttaattagatgacttgttcaaaacaaacacatctacgagcaaacaacaacaataaaaacaacttggcatctaatttgaacaaggcattataatagctgtcttgggtgatgccgagatagatacaacaaatttacagccctcaaataatgcacaattaagaagacagtaaaagcatacactgacccagtggagcctgagagagggagtttaaaggggaatatacaaaggactatggaaattcagaggtggttgtgagagagttgaggagaagcaaagggaattttatgaaaaagcacatcttttcatgtacatcctaatctattagaagggtttcactaagtgaataagaataatacatttgaacatttaccatgataagtgagttgtggaaccttaaaaaacatctatgtttgcattcaggcaaaagaaggggtagaaaaagaaaaggtagagtatgagatattttgagaaaacccagcaaacaacacagatataaaagccaattgacaagaaagttcaatggaggaggagatgtctagcaatatcgaatgttctaggtgatcaacaaggatttaaatggaagatttagtatttaatgtggtaacaaagaatattgagtttttcagtttgggaggtagagttaggaggattgcttgaacccaggagtttgagaccagcctgggcaagataatgagactccatctctacattaaaaaaaaattagccaggcatggtggtatgcatttctattttcagccactcagaaagctgagacaggaggatcacttgagcctgggaggtagagggtgcagtgagccatcatcatgtcactgtactccagtatgggcaacagacagagaccctatctcaaaaaaaatcaaaaaagactgttgcagtacattgagagagcaaatgtggtaatgggagggctaaggaacacagagaatttaggtacatattttttattttaatatttaaataaccatatttatattcatagctacaacttatttgtgcattcaacatctattgagcacctactatgttccaggtactcttataagcatacaacaagaagcagaaactgaggtacaaagattttaagtaacttgctcagctggtaagctgaagatgccaagattaggagccaggcagtctcacttcaaaatccgtgtccctagtctcaaaaaaatagcctctttctctgttctaggcactctgatgctttcaatacattacttcatttagtacccactacagtcctgtgacatattgctatgctgatcattgtttaggtaaagaaactgaggcatagcaaagttaagtaactttcccaagctcacacagctagaaaaaggcggattggaattttagtctaaggaagcctgatcccaaggcccaggctcttatttagtataatactatgcaaatattttatttagagacattttggaaaaagtttggaaaatggtaaaatataacaaagaaaataactctacctagcaataactactaccaaatttttaatatatttctttacaatattattgtgcatttttacataactgaaaattttaaatatatacaattatatatgattattatcaagatttaaattatgtgcaaaacactgacgctgcatctagtacatagtaggcattcaaagaaggtatgtacaattatatttctacttttatcattttaattaaattaacatacagttgacccttgaacaacatgggtttgaactatgtgggtccacttatatgtcaactttttttcaaccaaacagggatcgaaaatagagtatttgcaggatgtgaaacctgataggattcgatagggagggctaattttttgaatatacaggttctgcagagccaactgtgggacttgagtgtgcatagattttggtaaacatgggggtcctggaaccaatcccccatgtatactgagggacaaatgtatttatatagtgcttcatacattaaaaggtatattcacatatgctatctcctttgttcttcaatgcatttccaataggagcatgaactttgttacattttcatttaacaaatgaaaaattcaacccgtgaatttaagtgatttgcttaaagttacacacacaagcagtagtaatgcttggcctagaacaccatgtcagataaaatatatgtaaatgataatcaatgtgtcattgcctcagatattgagaaagaaggtacaagatttcattttcaccatgagctaatcatataccaatttcaattccttggggtagaagctacatgatatcttattttgccccaacaatgaccctatgtggcaactgctatgtcggccccacagaatcaacacacacatgcacacacacacacactcacaaccctcagctaaagccatgacaggttaactgacttgctcatatccatgctccttctagatcttgcaaggagtgtatatatctcttttcttctacaactgagggaatagaataagcagagtacaataagaaagatacagactatgaatagaataggtatagaagtagaatgtgcaacttccgttactataaaataccatttcagagaaaatagagtcgagtcaacaccagtggatgcagtgtagggatatgcatttaaaagacagggatatcaccaaacactgaccaggtagagctgggtaaacagtggtgtgggtacctccaaaaagtcagggtgaaggactgcttttgaggcagttaacacaaataacaaaagggtaggagcttgagacatttggtggaaacaccagctattggtgagaggagggtattgtcaatggacaagattttctgcttaactcaccagtcacaatggagactatatggttactgtcagctaatctttctgcagattaatttcccttccaggtgctggcctttagactgatgctaacactcaggattcattaaccatatttatttaaagaaccacaaaaatgccattattcagaaatttcttatgaaagtgcctcataacaaaagaattatcatgggttaaacttatgctgatgctgacccaatgaaaaacatgcttacaaaattatctgcgctgacaactctacaatagtctaacacagggataagctcaagaattctttggagttccattcagcttttataattaggtaatttttctatcacagtcagctggagattaatcataaaatgtgaacagttttattttctgtatttcaggaaacgtaattggtgataatcattataattgtaaagaaatctgcagagccctttcattgtggccatagcaccggctttaaaacaagttcagttgatgtctgtgtgcatgtgtgcacacacatacgtgtgcgcacatgtatttgtgaaagagtataattatacaattaaatgaagaagtaaaaagattcttaagagaatgtgacagttgatggtctgaaagtaaagaaaaggagaaaggataatgcttctgaaaaccatcatttagacacgcaaatggaggcttacataaacctgttctgaccttatgtatttgaaatatttttaaattactgaagtctttggaaactgcaaatagtttcttatgaaaaaagatgctcttacataaaaggaactattaaacttagagaattgaacaatggagagatcagatagtaacttactattctttaaaagtcttaaatatatgtaaaattcacaaaaattcacaaaaagcagaggaatatttgtgtccccctaaaattcatatgttaaaatcctaccccacaagatgacagtattagaagttgagggctttgagagttgattaggtcatgagggattagtgcccttataaaagaggccccagagagctagctaccatgtaaggacacagccaggaagtgtcatctatgaaccagaaagtagaacctcactagacaccaaatatgccttgattttggacttcccagccttcagaactgtgagaaataaatttctgttgtttataagctacacggtttatggcattttgttacagcagcccaaacagactaaggcagaggcttacataaaccctgttctgacctcatgattgtgaaatatttttaaatcactgaagtcttaggaaactgcaaatagtttcttaagggaaaaaaaaaagtgttcttacttaaaaggaactcttgaacttagagaactaagcgaaggagggatcagacggtaacataattctctaaaggcttaaatccgtgtaacactcacaatgcagaataaacatgcacccacgcacaacctaaatctaaccagttactgctgaaaacctgaatgttttggggaagtgtgccagaaagctctaaagatttttaagcttttcctgacctctttattttcactgaaatgcaaatatacatttaaaaatctgtttacataaactgaagaaaaagaaatcaatataaaattttccaaatttcctggattttaaggttagaagcaaaaatgagagaagatattttcataaaaagtaagaaaataatcagttttgattcactaggtccaaaaaatgagtagaaacatacatctaaatgcaccagatttttaaaaattttgttctttatttcaagaacaacactgcatttttggagggatctatttttttcagggaagaaaatatcacaattttgaaaaaaaagagaccaatataatctccctttttgaattctagacgaacgataaaaagcgattttgttaatgattttttaaaaatgagctttgcaacatattggcagccctagactgaagaattttaccgttctaattacaaacagtagcagttattttatactaaacataccaaaacgtaagtgagcattttatatgaatatgaattatttctactgggtacctatatacatgttttaaatattctgtgatttacccagaatctagtcagaagtaggccattttgataaaaagtgcctttagaacatcgatgggtaactaaaaaatctatgcataatgtaaacattccaactatttgttaaataagaaacatttttgattattacttttttaaactatattcaatttggttattggtaaaatttagtttaaggcaggcatatttcttttcataattttgttttcttttttcatgaacatttatcatgtccagaaggcaggcatatttcaatgaagtaatgtttatgcctagctaacattttttatttttaatgatatgatactgggtatattaatgcaaagatcctacaattttattttataaactcttacctgattttgaatccttttttcaacttttccagttatgcatgaagacatcatacttgaaaaactaaatataaattagcttctcttttgtaaaataaaaacaaatttgcaggacttctgctagagagatggattaggtatacattcctctattttttttcttaagtaaaatatacaattaaaaaccttgaaatgaaagtgtatatgtatgtgtatatattacagacacatatatatgtgtatacacatatatagggatatagtttattaagtacaacatacaactacaaaccttgaaagtgtatatatatatatatatatatatatatatatatatatatatatacacacacagatatagaaagagagaggtacatacacagacacacacacacatacacacaccccttaagagttcttaaacttgacagcagaaatatataccataaaaggaaaaattgataaactggatttcatccaaattagattatattactctgtgaagaactctgttaagaggattcaaaaaacaagctacagagttggagcacatatttaaaaaccacaacatcaacaaaggactagtatcaagaatacataaagacctctcaacacttaacattaaaaaaatccagttggaaaatggataaaatacatgagcagataatttataggagaatatatgaatagtaagcacacaaaaatttgctcaccatctttagccattaggaagttataaattaaagccacatgaaatatcattacatacctatcagaatggctaaaataaataataatgacaacacccaatgttagtgatgacacagaaactgtgtcactcatacatggctaattggaatgtaaaatgacacaaccaccctggaaaagagtttggcactttattacaaaaactaaccatgcaactattacataatcagcaattgcctttctgggaatttatcccagagaaaataaaagctatgttcaccacaaaaacctgtatattaatgtttataatagcttaattcataatagccccaaactggaagacatcctgatatgctttaatgagtgaatgattaaacagactacagtatagccatatcatggaatctcgcttagcaattaaaaaaacgaacctactaacgtatgcaagaatctggatgaatctccagacttacgttgagtgaaaaaaagtcaatccaaaaaggctatatactgtatgaaaaattgtagagagaatactttaatggttgacactggttgaggaagggttgggagttggagggaagtatatgtggctataaagggtcaataggagcaatctttatggtgatgaaaatcgcctgtatcttaattgtatcaatatcagcaccctggttggaatactgtactatcgctttgcaaggtgttatttattgttgggtctctccatattatttcttataaatgcctataaatctatagttatctcaaaataaatagatctacttaaagataaatggctaaataaataatttgcaagctctgaaaggatctccataaaggcaatcacaaaggaaagctcttctaggtttttgagattttttttccatttttcatttaaatttttaagtttttctacgggaaacttatactgctgtggtaataagaaagacaaaatataatatgcttgtaatctaaaatatttttaagatacagtttcattcctgtgttcacatcaatacaatgttctatatatgagaggcaacttctaaattcaccatctgtctattatgaaaaattttatcctgtggtcagggtattttatagctagagtataaacttgtaatttgaataaagagtatgggttgaatagtagatgtgccagctttgctttttttctatcttagaaatttataaaaaattaagtttgcttttaaaacttaaaagtgttagttctgaaccctagagatgctgacctaatggcggcatattatggctgtatgctgccaattagataaaagcagcatcaggaatcatttcatatcgctttgcttggctggaagtgtgtgtgcacacagatacataaacacacttctaatttctgcaaaagatcactgttagttctttagaaaactgctggcctattttcaaaagccgaaaatgagctggagcccagtgctgaacatcagaaatcaagaggcaatctaagtgatggtgacagtaggttttagtgaatacaaaagatgaaatggtaggaagctggataaagataattctgctccaaaatccaaagggcaagagaacataaagatgtcagaggtcagtatcattgaggagggaagagttttgtagctctaattgattctccgggctcctagagggattgaacttcttttggaaacataaaggtagagggcataagcagaaaatatatatcagatacaaaaccaatttctcccagaatacatctcaaaaagtaatgtcattaaattctggagccctgaagcaaaattcttcaaagttgtctccttgcagttttcacaagaaataacctttgccatacgccctgggaaactcatgttttcatccgcaatatggcagtgcttatcagtctgaaaagattattctgagaagttacataaacttgtaaactattaaaccttaagtgaatgtaaaaatgttacgtcatcttcattagcatgcctccctaaaacaatagagagtgcttagcctgagaatctgagctaagcttgaagtgaaacactactctgctgtgtaattcattacttgaagaatttacttccggcctaaattctgtttagtggtaggtctgccatctagtggccacttacataaatacaagttgtgatcataaattaaagaccatatgaaaatactaggtcatccaaatggaccatttctagtccaagtataaaaaggcaaagaggatttgactgatggtaagaaaatttatattcagggatcacttagaggtaagtgtgctgactcaaaacactatgagtacaaaagcaaagtaaaaagtcatttagacttatgtggacttcaaaatgagaaatttatattcataaactttcactaaatttaaaagaaagtaaccgttgtgttaacttatttatgttttctcctcattatcttttagttcaatcacatttatattttctacttaatgtaaaccatgaaataaaattttcttcagtacttggatttgtgctgccaatttgcagaattgtcagttattaaataaaatgtaacacagtttcagaacttaaactctaaaatacaaaaacataacattgttcaccttcaaataatacaataacttttggggctctattattattattgctttctttgttaatagaaatgacaggtaatgctaggcctttgatgctcattctcttggcataatttttagttatttgtccaaagctacacactcccaccctcagttccttccagagtgctaacctgaaagcttatatttgtaaaagccccattattattaaaaagctcattaacatacctgcaaatggtatttgcacagtggctaagtacactgaacacaccctgagaagtatttactaagctaaattcatcagacaagtgtacaatattcacatttcagtgttacaattgttatttttatttatttggtttttgagttggtatgcttaagaagagattaaatctacctccaaattatagttctttgacatactaatcagttacattaaagccatttaaataaataatattttaaaaatccccaaaccattaggcatgttttcattattgttgtatccagttactttccccttaggcttattattattgcttgaaataacaggatgatatcatattgttcaaactggaaatatagataattttgcaattgctaatgttgtgtaaaaatgtcctatgataatccacaaaccaataatctgtattgttgatatcctaacaagtatttgtaaaacacaggccaaataataaaacaattcccattccatacttaatccttgattttatggggtcccatttatttgtaatttgtaaatataatctcttacaatcaagtatgggagcctcaaagtcatgaatgatctccaatttaaggtaagaatgctcatacatttgcttgtggatacatttctttttttttttttttttgagacggagtctcgctctatcgcccaggctggagtgcagtggcgcgatcttggctcactgcgagctccgcctcccgggttcacgccattctcctgcctcagcctcccaagtagctgggactacaggcgcccgccaccacgcctagctattttttaatatttttagtagagacggggtttcaccatgttagccaggatggtctcgatctcctgatctcgtgatccgcccgcctcggcctcccaaagtgctgggattacaggcgtgagccaccgcgcccggccggatacatttatttctaaataagaacatctcatgtggttcctaagactgattatgccaagacccatgtacttcaaaatacggcattccaatgtgtggaattttctttttccactcaatctgtctactttttaacaacatggccaaactcccaggatcttaatgccaaaaaaagatgatttttttttaaaagaaataatttaagatcctaaaatgaaagcaaaatgtccatcctcgtgaacaacaaagtcagtcacaagactgaaaccatggtctataataatttaaatttatttattacttactctattatgtgtcaaacttaccctgagtcaaaatcgtgaaggtgaacgtaacattaaatgtgcgttttctttaaaccacactgtgatgaaatggactctcactcgggagtctggctccagaggcctcacccagcagagtgttcactatcacagaggacttttcacacatttcctcggagaggagggaagaaatccatcaagaaaggggatttatattccaaaatcacaaaatggctactatatcaactggagaaaaactactcacaggaagaaaaacagcacagaacaaacctttagacagtccatgccctagcacaggatttggacagacataagccaagggccaaatctggctctctatctcttttgtaaataaagttttattgtaaataaagttcagtggacacaccatgcccatgtgttcccatattgtatatatgtatataacttctgtctccttttattcattgccttctctgtatgagatatgcatttctcttacctcaatcaataaaatccaacctatcgtgaaggtataactttgtataatggaattaaattgaatatatcatttggagccttgtttttacatttaatattttttctgagatttatggatactgctgaatataagtgtagcttatcaatttccactttttaagtgctatggactattcaattatacaaatcaataaaaattaacctatactatgccaatgggcattgggttggggttaacactttggcttttctcagtaatgtttctatgaatgtttttgtacatatttcttgatttacaaatgcagcagttttcgagagtttttacctaaatgttgatttatttttgacatagttggtaaacacttgacattgtgactttttttctttttggttagtagtaaaaggaatcttttgtgggttttattgataccaattatataccaattatctttttatcattgattgccatttgtgtttcatcttctatgaaaagcctattcaattttttggctttttccaatcctcctctcagtttgcttgtctttttaccttattgaattgaaggtgtttttttaatatattctagatactacctctttatcaattatatgttgcaaatatcttctcactttataacttgtattttgtgtatgaggtttttataaaagaaaattttacggctcacgcctgtaatcccaacactttgtgttgggcagatcacctgaggtcaggagttcgaaaccagcctggctaacatggcaaaaccctgtctctattaaaaaatacaaaaattagctgggcgcgggggtgggcgcctgtaatcccagctactcaggaggctgaggcaggaaaatcacttgaacctgggaggcagaggttgcagtgagccaagattgcaccactgatctccagcttgggtggcagagcaagactctgtctcaaaaacaaaaaaagagaaaattttaactttaatgtagttaaacttacctaaattttatttttatggtatacaattttatattttgtttagtaaaactttctctgcctctgaggtaatataggtattgttccatattataacctaaaaatgttaaataatctagaatctactgttgtacagttctaagaaagagataaatccctttattatacaaataaccaatttttttcagcatcatttattaagaagtctatctttcgtcattgttttgcaacgttaactctatactataaatcacgtttccatagatatgaaagtcttttcctggactctattatttcagactgttctcattggaacaacgtgacaatgcttaatcttttaattctgtatttcctttgtatacttttagccaatgttgtgcttatcagtacagatataaaattgttatatcatcctgtcaaatcaaacctcttatcattatgtattgactctcttcattcatactctttattcctactaatgcattttgtcctaactacataagtattattatgggtagtgttcaccagatacacctttatttatctctttacttttaatatttgtattcagagaaatctgatgtgcagaacaacactgttatgccatgaattagactgttgttgaatattcactggaagagtatttttgtacggccttgctctaaactttctaaatgaagtaattattgtcatgtcccatgcaactgtgtgcatagcactcaccactagcatagctattgactgggtataacatataagacctctcctatctttcctactgaatcttctaaattagttgattactaagttagaaacaatgtactaaacaatgaggtttttatttacaatagcaataacaatttcggtaaataaatagagaaaaacatcacttttgaataacacaattagtagatagagttggaggatggtaaataccagagacaacagtaatctagagcaatattaaataaaagttctgaagattattcagatataaccttacccccacttaatagttaggataccttttaaaaatgcttcaaagagcattatttgtacctccataagtaacaaaatattgaaatgagctattaaaagttataaatgaattcatgaaaacaatgcatttgaaaaaaatctatataataatactgcacgaaaaatgacagaaagacataaaactttacatcaggaatctgtctgaaaatatcaagatttcagtaatgtattttattcacagagaagcttgctctcctacgcaaaatttgtctaaaatgttaccacattagtgaatctaatgaattccaaagtcccaggttcctgtaggttttcagctttacagaaatgatcaaaattgagtgtctcaatgtattatttaattaaaaaaagtttgtctgaagtttacaagccaaaaagtaaaaattatatatgggtaatactttacagatttttttgaagggtagttgtggattttttaaaatgtcttatctaatatttagataagaacccaaataaagtatattgtcaatgtgaatatgtatacttatatatatgtatacacaaacatctctctctcatcacacactctctctctctatatatatatacacatacacatatatatacacggatatgtacacacatacacacatataaaaatatatatgttcaatggatacaaagttatagttaggaggaataagttctagtgtttaactgcacagtaaggtaactatagtctgaactaatgtgtatttcaaaatagctagaagagagattttgaatgttctcatcatagagaactgacaagtgtttgaggcaatggatatgctaattacactgatttgatcattacacaatgtatataggtaccaaaacatcacactgtaccaaatatgtacagttattatgtgtcaattaaaaacaaaataaaatgtgagtgtgtgtgtgtgtgtgtgtgtgagagatagagagagagagatgagtgtgtgttggaaagcttacaattttaaagtaaaaattcaactttggaaaaattcactagtgatgtcagtgttataatttaagtcttaaggagagattaagaagataagtatgcttaaaatgtgtatgcttaaagaaaatcttcatcattttcttaaatacttgatgcttcacattgataattccaactgaattaaattagaaattcatctgcattatcataagatatatcaacatttcatatgttaataagagatttaaagaattctcactctgaaatataatttaaagaaataaaattatctgaactcaggttattgtcaagactggttttatggttttatccagtcaagaaaaggcattcaggacatttgttattaactacttgtgcaaacaatgttaaacatcaatgaagactatcaagaatttggtgtcgttgtgggcagcagtaatcccaatattacttccaaaaatcttcttctccataaaagcaacaagaacactgcaaaaaaaaggtgaacttcaacttttttaggactctggagattaagcaaaaggtttcaattatataggtaatgtttattagaaaaataatcgctgaatcttggtaaaacatgaagttttgtgatgttttaacttgccccaatattgtctccctctctccaagcctgtgattgccttgaaaaccagcagttcaacgatcatagtaaaaaccagaagtgtagcaatgcctggagggagcagaatagatttagagctcctccaaaatctaattcccaagcaactgtcattatttgacttgcttctggaaaatcctatgtgcaaaaatatttggcttgttccctggaaaatcccacgtgcaaaacttgttacttgagctaagtcagagcttatccagtgcagaaagctgtttccctgtaggcagttactacaaagaattagcagcaattgttaaatattgtggttagctgaactggtgacagcagttaggaaaaaacaacaaggcaaccacaaaaaaggaaaagctaggaatgagttattcataggtggattagaaaagttctgtgataatcctgggaatctagaatgccacacttaacgcttacaagtttgtgtatgcccaagaaaaactagagaaggccctatgctgtcatgctgtcatctctagatgatgttgagcttctgtgcaagcaggaagtgaggcctaaagtggtgttgcaagcagcctgactgggaattgaaggtgtaccacaacgtgcaccctgagctcctcagcaaaagctgggagacttattggttccagcctgtaagaaaatctctatcaattttttagctaactaataagttaaccaataagaaagtttagtgtccacccataaaaagaatgctaattttacagaactaattcaggaaagtcattaaacaaataaacaacagcaacagcaacaacaaaaaccaatcataggaaaaggaggcagagagagttagcaaattatattatttaagatgtctagttttcaataaggaattatgagaaaaacaaataaagggccattcacagggagaaaaaaagcagtgaatagaaactgtccctaaggaagctcatacattggacttactaaataaagactttaagcaattttgaatatgttcaaagaaaattatggaagtaagtctcacaaaacaaagacttagaaataaagagacagaaaatatagaaaatcaccaactagaaattttggagttgagaaatactatcactaagcttgaaaattaactagaggtgccccaaaccagatttaaatggagagaaaaaagaatcagcaaacatgaagacagatcaattgaggttatttaacctgacaacagaagtaaaaagaataaaggaaaatgaacagagtgccccagaaacctaaaagataccatcaagtgtactagcatacttaccttttattaactatctatagtcctcatgttgtacatttgattcctagacttatttatcctgcatcattgcaattttgtaccctttgacctgcatcttcccatttccccaccctcacccctggtaaccaccatactactctgtttctttgtagtctttcttgtttttttttttaagattccatatataagtgagatcaggtgatatttgtctttttgcatttggcttatttcacttagcataatgtgctctaggtgattttcttatttttaaaagctgaataatattccattttctgtgtgtgtgtggggggagggggggtctctgtgtgtgtgtgtgtgtgtgtgtgtgtgtgtgtgtgccacaatttattttcccacttatccaatgggtaacaatactttgcttccatatcatggctattgtaaataatgctgcaataagcaggagagtgtaggtatcattatgaagtaatgactcccagattgctcggtcatattgtagttctatttttagtttcttaaggaacagctatactgttttccacaatggctacattaatctaaattcccaccaagagtatatcaggtttcccttttctccacatcctcaccaacacttatctcttgatatttttataagggccatcctaacaagtgtgaggtaatatctcgttgtggtgttgacttgcatttccctgatcattagtgatcttgagcaccttttcatatacctactagccattttacatctttggagaaatgtctattcaagtcctttgctcactttttaaattaggtttttcatttttattgctatcaagttggataattcccatatatattggatactaacacccaattagatatatggttcacaaatattttctcctaatccgtatgctgcttttacattttgttgactatttgctgtgcagaagctttttagtttgatttactcccacttgtttgcttctcttgcctacacttttggagttctatcaaaaaaaaaaaaaaaaacattgttaagaccaatgtcaaggagcatttcctcttttctctaggagtttttcagtttcaggtcttatgtttgggtctttaatttattttgagttgattttgtgtatagtatgagtccaatttcattcttttgcatatggatattcagttttccaaacaccatttatttccccattgtgtcttcttggctccactgttgaaaatgagttggctacatatgcttagttttatttctgggctttctattatgttctgttgctctatgttcctgttttcaagccagtaccatactgttttagttactatagatttatatatatatatatatacacacatacacacacatatacatatatatatacacacacacatatatatatattgtttcttcatttttcttttaaattacatagtaggaaaaataattacaagtaaaaataaatttatactgtatttttatatttaggtatatgttacctttattttccgtatgaatttgtgttactgccaagtattctttccttttcagcccacagaacttcctttaatatttttatgacaaggtctacaaatgagtaattctctaattttttatctggtattgtcttaaattttcctttcatttttatggcctatttttttctgaatagagtgcaccaatatacttaaaatggcagtcccacaaagagaggagaaagagaaaaaggaaaataatttttaaagatatactggccaaagactttccaaatttgaagaaacatgtgaaactacagagccaagaagctcaacaacttccagttaagataaatttaaaaagacacacagtaacacattgtaatcaaactgttgaaagccaaaacaaagaaagaatcttgaaatcagtagcaaagaagtgatttatcatatatgaaggatcttcaataacagtaataggcaatttctcatcaaaaaccatagaggcaggaatacaatgagatgacaaggtcaaagtcctggggcagagaaataaaaacaaacctgtcaaacaagaattcttcatccaggggaacagtattgaatcttagttgacatataattcaactgatggaaacgaaagtgtgtgtctgttggaagagtagtcttttagacctgagaatgctctgctactctgagatatagagtgccattgacatcagtctggaagccttatggtctgagtggactagataattaatctatttagtagattaattatgctttcctcacaaaccactactcagttaatgtctcctggacatggttcataagaaatctttgaggagtcatttgcctatatgcaagtcagcaaaatgtgagtttgaatctgttctgtctttccttgtcccttatgcatgtttcgtttgtagcattctacctctcctcatctttctacgtcttctcatcctgtaacctcttacacaggatttgattctgagcaggataacacactcaagtaactggcccatcattgtctctcagtggttcaaaagaaaaagaattgagtgaataaatcaagttcaccttcccaaaagatgttgcctacctttctgaaggaccaggaccctccactttcatagcttgagtgtaaatagcaatgaccccctagcggatgaccttcagaaagtatatcccacaagactgctgggaattgtatgcctgaggaagatgatcattaatccagaattattcatgttatattgaatgcaaaaagtgagatttctggatcaagtcagaatattatactttctagtgtgatgtgacaagaggcaggtggacaggactttacattcaaaagagcattttgacactaacaaagaaggacccagaggttctaaatctaagaacttatatacatatttttgagaaaggtagaaaaacctttgctctgtaggataaataaattctcttgagaagagagattctaggttcttggcttcttaacactttggaacagaaataagggtctccaggaataaaataagacaatccttctggatttacaacccttaaaatgtctccatggtcctgtgtttcatccctccatgtaatgtaaacacatacctcagggaggtgaatctctccagaatagcctgtcactatcttaccatcctttaacttccaaggtgattcctttaacccaattaccaggtttctttcttcaaaaaggcctaatcatgcagaaactttaaaatctgttttctacagtcccataggtgtacttccgtcattactagcagcctctgctgtgcagtgctgttcaaagattggcactgcccacatttgtatttcaatgtgaactgtatgacttgaaaaaaaaaaaaaaactcctgtagcacccatgtatatctctattcctgacttagcctagacactcagattctgagacattctttcatgatcatggatctatggctcattttctggctattgaaaatgactcttctttggggacagactatccataatggcccttgctatggtttcaatgtttctcccaaagttcatgttttggaaaattaatccccaatgcaacagtgttgagaggtaggacctttaagaggtgattaggtcttgagggctctgccctcatgaatgaattaatgtcattatcacaggagtgggttctttcttgtgggaatgggtttatcctaagtgagtttcagtcccctggccatccactctgttgccttctgccatgagatgacacatcaaaaaggccttcaccagatgacagcctcttgatattagattttccagcctccagaactctgagaaataaattttatttctttataaattacagtctttggtattctgttatagaccacaaaacaaaccaagatagatctgaacagtaaaaaccccagagtggtaaaattctgagatggctcttccttctagcaataccttcacacactcccccgccagcagaactacaccctacacatacatgcatacaaatttactcccaagaattaaatattttctataggttgagtgcacatagaaaacactttacaacaaagaaatgtgttttgtgcaaatatgtgcacattcagcaaatatttgagtgctacagaataagaagagccttgagaaaaatcactccaaagttttaatctgtgttgatattcccgtcattttaatttggtaagaaagaagctgataagtgaactccacaagttcataatggtctcagaagttatagagaataagcaagcatatgtataaattaaaaattatttttcctgtacttttaagataagtacttgagtgcttaacatgtgttacaaaaaccttggatggtctgacctttgctcccatttctagtttcactaccctgtgctttaaactccagccaaaccagcctgcctttatttattcaaggataacactctttcttctactttatgatgtttgcaatttctttacccctttcccaaaacatttttttacatttccccagcttggtataaataaatttctttgcatatattttgccttacacttaagttctatttacttaaaattgttaatcctgattgaaattatgcttggtttgtgtgactacttgattaattgtatctcctccaccagacatttgttccctgagaacagggaccatatgtttatgtcacctattttattcccagtatataggataacgtctgacatgtagggccttaataattttggaaaatagagtttgtaaataagtcagaaaagtatttacttagaaaaaacaaagttgtgagtccctgtttatcagcattcacgaaagccatttacaaggtctattgggagaaggtacaatgaaaagagggactgagaataaactatgatatttattctcaagaaaccaatgtctagtagaagagatacaattaatcaaataatcacacaaaccaagtacaatttcaatcagagagtaaaccttcaggttttttctggtcagagaaagatcctggccagagaagtatgctgctgcaaaggagtccgacaataaatacaattgctgggacaaaaaccataagactgtggtgttgtggagcaagtggatagtctgtttcaacagggatggagggcctaaggaaagatcaagcaaggcaaatactgaaaattatgcattggatttagcaaccagtggtcactagcagctatagtgaaagttgaaatgacagctaaaggagaagaagccatatataatcagcaaagctcagacccaatgctgaactacagactctaaaagaattttcacctcagaaattatcacttaaaataagcaattttgtctaatatcatttttagacaatatagcacagtatagatgtgaaccttatagaggcttcccaaaataattacctattagtaatccattcagttatctttattcctgttgcttggctttatttcatacttcctagtatgaaagcacaacacatagcagatttctttctaaaaagcatggcaacatatcctgggctatactctgtttgctaataatccatctcatagctcttgtgagtgcataatactcattgaaatcaataagaattacgggcacagaagtgctgcaaggctaagtttttaaactcaagaatatattgtccatacacagccaaatagcacttggatagtctgtgaatataattataatataacccattatgtcttctttcagagagaaagaaaaaaatgatgtaaatttaaacatagcatattctggaaacagtatgcttatggaacagccagagagattttcaaaacttgatcatctaaatgcagagaacagtttcaaggtatgagcaatgcattaagaggccacagatttgggccacatgaatgacctgggagacactttttaaaacagcacaaaaatagcacaaaagtagcacatttttctttgtaaaatatttcagtaaaataattatgcctacatttctcactaaacatttgctgtgcccaaatggatagatttcaaatagaaacaggctgggtgtggtggcttacaggtgtaatcccagcactttgggcggccgaggcagccagatcacctgaggtcaggagttcaaaaccagcctggccaacatggcaaaagcccgtctctactaaaaatacaaaaattagccatgcatggtggcaggcacctgtaatcctagctacttgggaggctgaggcatgagaatcgcttgaacactggaggtggaggttgcagtgagccgagatcatgccactatactccagcctggtgacagagagagagactccatctcaaaaaataattaaataaataaaaactaaacaaacttaccattgagtgaaatttacacattacaagaatttaaaacagacatatggaaaaggacaatatcgactgtgtcttttttctcagatttatggtgtacatacattctattctctgtcctcatacagtggtccatgagacatgggtcctcacagcacctcattattcaccagctgaagcctagtttttctagaccagcactggaagaaccaggttaaatacatttatgttgaaaatcaggctctatcctgccttttccccaccacaaaggtgaagagaatccctcagtatattttatgttatgcaatcaatgcaaaggaatgaactttgttctaggcataaaaataacttaatttgctgtatgaagtacaaccgaggatgcctcacttcatgctgtatctgcatgcatactttcaaaatgacattaaataatttaggtagacttgggcatatacatgtttagtttagatggaatatctaataaaactaaaaggagcttgatcatattggccactgataaatggagcctacagatgtcactgcaactagatatcactgggatttagagaacagatcaagagcttccctgtatcttttttgtttaaaaaaagatgaccctttattttctctatatataacactactgaaaagaggttcattgagactttctcatcaatcagaactatctaaaatgcaatcttacagctgctatatgatataccaccagtgtgaaataaataggaaaggaaagattaaaaaggcaatatttacatttagctaagattatgagtactctctgatatcatggataatgtaaataatattaaaatgaatattattgcagactaattcatttgtattgttatgatcaaatagtttttggagatacatacataatagccctgtctcagttagcagtgtagtgacatttattcaataccaataataaaccaggtgctgcaacagaagcagaccagatggtccaggagtttccacatgagagagcaaacttgggcaagtctttgaatgcattttatttcaatctttcctttattgcaatggaaagctgtcaacaggagtaagtctctatgctgcttaaggtagaatgagattaatggagcattatcaatatctccactaatttttattgcatatgttgccttgggcacaagttctatttttatggtaagaggaacatatatacagaatgttaacagattctgaaaaagcaacatcctgctgggtgaacacatgttagccattgccacagtagtgaactataaattaatattttaaagaactgccatttgtgtgtaaaaatatcgatctataattgtttcttagctacacacacatacacacacaaagcaattggatgttcttagcaagaatattcatatcagaagaattctaaatgcttcaaacgaggaaattattaaaagaaaataatataatgtttacataaaaattctatgtagttattaaaagaatggggtttataataagattccaaattggaaagatatacagagtgtattgtaaaatgacaaaaaatagtgaaagaaagtttaagagaatataaagcaaaggttaaacatttggaaatctataaagtctagcaagataacattaatgagaaaagtaggaatccaagctgattttccctagaaaagaatcttagacaaagcttacgtgctaatactttatttagagctgcaatcccgaaccagcaagcacagggaaaggaaagagaggcataaaaagtgaggcaaagtcaaggtttatctggccacaacttcaggaaaagacccaactggttgcttggccatagaggacatcacgtctttagggaagccaaccagaaactccatgcctctgtatatcagaggaagtaaaggaatggaatttatttgctaactctagatgtcttcttccctcccttactgattcacattaggattaactcaggaactaactccctcactttcaggttacatcacctggccccttaggtggcttctgagaaaaccaaatctcatgtcctgttgaaggacactttacatgagtaaagtaagaatagaatggagagcctctttaaatctgactaggttgatggccagagctattatggctcctggcaggcagaacggagcaatggaggccataccaggaagcccattactcaccccagtagcagccaagacacacagaagtgttagaatctgaggtagattcagctgcagtggtgacaccagcaaccaggatcctccatgagctagtgaatgggggcccagtagacagatgaagctgagtaaatcagagcaggctcatgaattgaacctggtatgttaggcaggacaaattacagctaacacatatccagtgatcatgaggagtgtggaaagtgtgaagaacataagacagcatgctgctacccagctctaggaaactactaccatgcaaggatattggtctatgtcacctgactttccaatttttcaaaaagactataccttcattttcccagtgagaataatcacctacaaactggatctctagagtttttttacataaaagagaatttctaaatattggcttatcaaaaaaacaaaacagagtgtagactaaaaagagatctgtttatgagttatactcaacccataggttactgttttacaaactctgatgtataaaacaaatgcgtttaagaactcaatccaaatctctatctatctatctatctatctatctatctatctatctatctatcatctatctatccacgttgctctccaggttcatacatgcaaaagaaatgatcagctactttgatctcataaacctagacaaacacataactctatcacataactttatcataactaacctctaattattcaattataccttcatttatccaacaagaataatcacctgcaaaaaaagtatactctattaatgtataaaatgttcccattaattagtaatataaatcaatatgtggacaagatatcagatttctgtcttcctagagaccaagaggccagtgaaagccaagaagaatgtccttaagtagaaattctcaaaaacatgtcacaaagaattttagtttcatttgaggtccagggattatggaaataaaagcaagactagtaaaggccagctgttttatggtgcgctgttcttcctaagacaaacaccagcttcatgtaagcctccaggcttaaggtgatacagaaagacctatgcttaccaacttgaaaaaataaaaatttcaattcagagatgataggaagaagtaacatacgagagaaatatacaggaaaataactctaaggaggcaaaggtgaataaaaatcattagtaagtgactcattttttgtaggaggagaaaaatagggttgaaaataaaggcttcatcttttgttcctcagatagagactaactgtacatctgattcttctgaggattgagaaagcaaattttactatctccctttttgtttccctgtgtaaagacaattaaatttcagtttatttctctctgtgtggggattgctcaaacattttttcaatattccaaattgtattgacatctctcatccaaggaaagcttttttccttaattctattctcttgtgttgatatattttttcaaagcgtttttaatgagatctgaagaaagagccaagtttaatctgcatataatctgtcatctgaaactatcggaaggacaacccttagttttgcaaattctttcatggaagattaattataagaggaatctacctgattaatttggtgaattggtgtagtccttgtagcaaaaccagacaagaagaaaacaagaaaataaaaacatagatgagtatcacttaggtacacagcagaaatattaaataaaatgctactagcaaattgaatctgctagactgtgaataataataatgatctcagaaatacaagattatttaacatcagataatctataaaaaatttaccatatttataaagaaaaacacatcttcccaatagttttcaattaaattctacattcattaataattaaagacttagcaaatatgaaacaaagagaaacctcctcagccaaataaaaattatctatccaaaaatgtatagcatatataattatatacaatgtactttatgtaatatattttccaaaagtcctatgagcgaacattgtaacttcatgattattgcattgtcttcatcattttagtgagaacacataatattgctggatcttattcttccttttgaaggttttgaagaaatatgttttcattcagctggacttctagataattaagatgatagagtagtttttcaactgctttaggaataagtgtgagtagccagcacttgaaaatcaaatctgccttttatcctgcccaagacaagttttccttttttgctgaagagttgtttccatcacgggaataatgttccttgatgctaacatgactccctactttgttttccagcctgaatttctaaattggcactagatccttggcttaccttctcggaggaggctggattcaaaggtgatcctaggtgctcttactaaatcagttagcatagagctagtggaaacatcaatggttttacataaaaaatttcaaagattgactgtattaaaagcattataatataacatagtacattgttttcaacctactctcacgaaataccagctgcccaaattaatatacttcctttctggtagttgactcttgtgtttttgtttgtttgtttttaagcacacaaagggaatgcatttgtgtatattctttaaagtgtcatactaacacacattttaacaagcaaaaaaaaaagaacaacaaaacttcagtgctatgtatgtatggtctttacattttatcctacgttcattttatgacataaaaactatcagacatattatctcactacacttcagaccaaatagtttgtttgtttgtttgtttgtttttttgtttttaaggcgaagtcttgctctgccgtcccggctggagtgcaatggggtgatctcggctcactgcaaccttcgcctcccgggttcaagtgattctcctgcctcagcctcctgattagctgggattacaggcgtgtgccaccacgcctggctatatatatatatatatatatatatatatatatatatatattttttttttttttttttttttttttttagtagagatggggtttcactgtgttggctgggatggtctcgatctcctgacctcatgatctgcccaccttggtctcccgaagtgctgggattacaggtgtgagccaccgcgcccagccaatagttatctttttaactaaattcctatgggcatcaaatgaacaggaagtagcgttcagataaatggcatattattgattgattttaaacacctttctacaaattttaagtgacaaagaagcacatgtatgtacacacatgtatgtatgcacgcatacacacgcacacatacacacacacactcatatattgtcttgaagagaatcaggcctgggttgtttccaagaaatcgcctgaaagtggtttcatggagaagaggagagaagggaagggaaggtaagggaagggaggggaggggaggagagggaagggaaggcttaagcaccaggggaacagtgtttcatataaactccagtgagaaatggcagaaaggcaagaatacaattagaagaaaaaagaccaccaaggtcaacagaatgaacagtttctgaagcatgaacaaaagtaaaataacctgtagtgattacctgaccgccagttcttgcaagggttctggacattttgagataggactggagctactaaatgtactgaagcggtttgaataaatactgaactagccagttttggaatgatgacttaagttctatgatgaagttcagtataaaatatggatgagagtgtcacaatgactggacttctcttcagaattgcactgcgaatgtatccgataaaatttccttgatgtaatttctaatttatgaccacgggcagtccttttatatttctgttcaatcctcctatttctgaaacatgcatatgaatcacatccctgtggttatagcattttactgaaatctggttgtattaaacattacccagcatataaaatataatttaatagctaaagcttaggcaatattttgctataaggcaaattgctttaggttgcactttgtagaaaacatttcacctacaaataatgatttaagaaatccaaatcagcctatcttctcatgaccccagcatttagattagtatttttcttattatccattgttactgacaccatgaaaccagtgttgccgacccatgtgacaccctgaaactcagtttctttagcttgcttactacactgcctgacttcataacagcacttatcactcagtatttctccatctccaaaatctataaacttatgtgattttaatcccattctcattacctaatacatttctactttatccacataaatatctatatatccttacttatctagcttaattctgactgttctttactcactacccagacaaatattcagtttagttgcatcattattaccttcactaactgtctgccttcctaaggatttttttccctctcttatcaccatcatcattcccaatgtttgctgggttgctaatagttgatcctgaatctttcctaccacctttttcggttggtgttaatgttactggcaaaaggcagaagaactgccctgctgtaaatttcgacatctaatttcaaccagagtttcattagcaattggtattcctttattcacttttgtattgcttttctgatgaattctccaataggcctatatctaatccttctcctccaacagccaaaatcccacttttattttctcaaaagcagaagttatcagaagacatcagccacgtgatgttacttcttttatctactctctccgtatttcaaaatatttgttacggtaatacccttatttctctctattagaatatgtatatcctatatttccaaagcttgcctgctgtttcttttagacttgctatagaacacacagttataacaactcttttggttgtttatactcatttgattgttgctgtctttttactttttcttttttttttttttttttttttgagatagagtttcactcttgttgcccaggctagagtgcagtggtgtgatctcggctccctgtgatctccacctcctgggttcaagtgattctctcgcctcagcctcctgagtagctgggattacaggtgcctggcaccatgcctggctaacttgtatttttagtagagacggggtttcactgtgttgcccaagttggtcttgaactcctgacctcaggtgatccagccaccctggcctcccaaagtgctgggattatggtgcgagccaccacacctggccttgccatctatttttaaccaaagaaagctattgcacctactgcaaaagtttaaacaaatcattgtttaacatttatgtactctcttttatttcaaacatcctacattgcttttatttcacagttccatacaatctcccctcaacactgttaaatcaagttcaggctaaaggtttctcagtacaccgtgaactaaaacctaaatggaattgtaaacagacggtagcctcctcttgtgtcaatcaccaagttttggctaaataaatgtggccaactgttgttagaatcatgttcaaataaggcaaatgccaaggtacaaccaatctggctgtttctgtaccaaacttccaatttctgtgttttacttttcctttttctgtccataaatcttctaccatgtgactgcgctggagtctctgagcctactctggttcggtaggctgcctgatttgtaaatcgttctttgctcaattaaacgcttctgaatgtagttttgctccggtttttcttttaacagcacctataacataaatttttacttctaccagactgggtaatcaaacttttcttcacttttagttaaaccattgattttttaaaaatcttatttgactattttgtgctgtttgtctggcaatattttcattttctttccttgaaactctgactcttctaccatactacttctctttcctctcatcatcttttgtgagcactccctgaggcacatctgctagtcttacgggtgagattttaaactcttttaaggtgatatcaattaattactcattaatcatgtactaaatgtatattagttcatagattttctcagatgaatctaatttagcaaggtttcctccttttagtgtggggttcttttcacactgtatggactagaaatgtaaatataaggaaataaagtctctactggtctccactgctgaggtctaagctacgcttcatgggacaaaccattaaaaattacaaacaaaactttagtgtttggaccaggatcaaccatatagatctatgtccatcactgttttctgatagaagatccaaccattaatgagaaacaagcattatggccacacttgaaaaggtcaataagatgcttcagaacacaaaggggaaatcattaatgacgttagatgaatcagtaaagaatccaagtcaatccccatttagagaacaatataaagactaaatgaatttcattataaaatgagcaagattgtaagtataaactaacagccataaataatacttcaaaatgcggctatgcttcaaagtatattacaaaatatatttctgaatagtgataagcccagattttctgaaaggatttttctgagttttcaaaaagtcctgggtaatgcagggagcgttctcactcccatgtaaacagaggagtaattatggaaatattatagagtaatcttagtggacaaaaaaaaagataacaagggccataattataacataggcttaacctcaaatattgaaacatcaccaaagaaagatgctctggctttgaacattgtttttataattaatttttttctttaataaaggagaaaattttattaaaaatcatgtctacaattacctaattttgttaacccatctgaaaaattatgaacacctagggttaccaagcaaaatacttttattatgtttttagcataatttattcattaactgaaattcaaatgtaaatcaaggttttgtatttttatttgctaactctatcttctctgtagagacctaatgatgaatgttattttatattcatattactgcttgttcacctttacacacccccatgaagaatataaattctagtagagaccacgtatttcacatttactactctatcttcagcatctaaaaaccacaaattctaggcccaaatttggaggtaggactatgatcaattttacagacacattgtcatctttatttttaataaagctaccaagcgtgaataaaaagtaaataccatcatcacactccaaaagctcaataagagctctttcacagagagtagattcttctaaaatagttgttttaaataaaagaatgaaaatgaactactcacattacttcatctcttcacttctaggctactccacatagcagtgaagtgttctttggttgacaatgttacctggtagctgacttaaccagtcaacacatctaaatttctcattcagtctctcccctctcccttactgttcaaaagaataatgacccaatgtgactgagaaatcacaaaattttggaacaaaaagggacagaaaatatcaggttaacctcctttattttacagattaaagaactaaagctcacatacctgcaagagtgtttccctgatccaaacctttcaatggttctgggtcacttataagataaaccttctaaagttttggcatgctacaaatgtcctccaagattctgccccagccttcagctccagacgtgtatctcctcataggaattaatactatctcctggcacctataaatgacgagtatccctgtgctcttagtgacccaaaggtgaccacttcctcccttgtacttacatccattcatacttctattatagcacttttaagattatggaatgtagaatggaatttatcagtttaaatgtctgtctcctcttactagtctgagtacaggaactacagcttattcctgctggaattactaatgtctattcaagtgcctggcatgtgccagggcacctggtggaagcccaatatgcatttgacaaatgaagaaacacatacataactaatggcacatattattatataattaatggcagaaatgaagactgtgctttattaccaatccacagaattaagctaagaatctatcaatatcaataaaaaagaaagtaataaattttgagataaaatttgtcttaaaaatcagtgtcagcaatatgtcaagcttacaaacatgctgagaaagcctgctctacaatgttcaaaaaaatgttgtttttcacttttctgtccactaattaagcttgattttttttccaggcatagttttgaacatgaatatctatttcttattcctttatgtttaatttctatagtacagtaagtccttatttaaattcttccatagttcttggaaactgtgactttaattgaaacaatgtatgatgacacccatttttttaaaatcatcaacattgtaagaaaacaatgttgaataaaacaacattatttgagggccactaaagtcacagtttccaagaacttgctgaaaacattagtgagaacttgctgtactatattttgtaatttttcattatacacaccactattttgataataatgtggattgagcagattatggaagagaataccttcaatcattttgcttctataacttaagttctcaactcctaacttaagaatggatttctagaatctaacttgtgtgaaaactaagacccaccattgtgtatgcaaggtaggaatagaaaaaaacccatacacaaaatgtaaaccaaaatttaaaaacagttataggtacaatttccatttataaacacatttgaaataaaactttaaaatttggtaaatgtatgttaattgatgcataccagcgtcatcattttttaattttttaaattcattgcgatctgacttataataatataaaatgatccatttatccataaagcctgtcattatgtgtagctgagttatttatgtgtacatcttttaacagaacttttaagaatagtaaagaaaaaacaatataaaattggtgattctttttataaatacaaacgtcaccatttatttgctatgttcaagtcctaattatgtacaaggcactgaactaaccacattatgtcaatttaaaccttgttacactccagaaaaatcagcaatatcattaccctctaatttgaccaaaaatttagtggatatactcaattataagagaagtacttttgttacataaatattacttagaagtgagaagtgagaaatttagtccttttactaggtgtgctctaaattattttattttgatcaccatacttagggaagaatccatcaatcatagcttggggtaattgtagcgataacctatatgcatttaaaagaaaaagtcaaggaaatataacaccaacttagtcactatttctgggatattatctaataattgttaactattggacataatttcaaataaacctttcaaagactgccttatcagagtaagcagctatcttgtagagatcatgtatatgtgtctacagaataaatgagtgaacgggaatggcctaatttcgtgggacaacactcatgaaataaattttccagtgataatatcacccatagattcatacacttgagtatttcagagtgttatcctctagaaaactgtttaagaggactcagagaagatgaagctactgatatctcaagataccagtgaagaacacaagggaatgaaattcatgaaatgtgatcagaaaccacttcataggttttatataattttaacataaacatatataacccatatattaattaatttgcagagatttggccatatcatctacactcttagaagattttgtcattaaactggccaattaagagaagattttctttgtaaaatgaaagattggcttatattttctggtgtttcttattcatgggcatgtatcacaacctaactactcttttgtaagctttaaggggtagaatcagactgaccagcatctgcctacctcaacagcctgccttttaattactgtctattaaaaatgtatattcactctccctcctctaaacttttcaatataattagtaaaacaaaattataccttggtagtgtctaatgctttctaatggcagtctcttggcagataagaggatgtgcatgtatattcagttgccatgtagcatctcagaactgggtatgattcagtgagtgcaaatgaatattatctaacacaattcactttaaaagagaaagattataagactaactaaggaagaaaaagaataagcttttctaatatatcatttatttaatatatagatatatatctaatgatctatctaatgatatctacctatctatatatagatatacttctaaaaggtatgtattttgatccttaaaagtcatgctgcaattgggtaacattcttaaaacttatctatcatattttataaaacaaaacatgtgtctaggtccgtcatagaagagatatttactgtatgggattggtacccttcctttatataatatgcaaccaaagaaagaagtgtttctttttgccaaagaaaaacagtatttaaaatacacaatatatttttcacccatgtttgagatatccgcaataaccataaaacagctggagtgttttcccaagcattatccatgtcttagccatattctttgctctcatgttattcctagcccccaaataaacccatcttctagacatgtcatcaatttaagtatctatcttgccaaataacaattccaacatttttaaaaactgttgcgttttacattgtgaagctaattatggcagaagtgagaaaaggagtaggcaaaattttactgatagcttataaatataataatcgctttctaaatatataaatttgagtttcagaaggactagggcttgtaatgattatgtggtcttgttgttctattgtgctaatttgaattgaaatggtgctgcaatgccaaaaccactgcttttaaagtaattttctacctgatttatttactcacattaataaaaaaaatattgtgctgtagtcattcacagaagctgaaacagcaaaatacaaactagtccaccatgatctaatttgtacttgccaccacaatatttcttccaggcacaatcaactactctgtcagcatcagtgaacttctctataatgtttaatgagaaaatgtgaagaaagaatatcaaaaacatttttatcagggctcaattttccaacccacttatagtttcaagattcctaggcaatagatgaggctcaggaaaaggtgaagaacgactaatgatcttggtttctcatctgcggggtaagaattaagtagacagagagagagggagattgtacaggacttagtaattttgtagctactcaaacaagggaaagagaaacgaaaagaattctaaacctgccaatgccactccctttacatattaacaggaaatagattacaaagagaaaggacaacctcagatgattttagcatcattttagcagcattcctaggctgataatatactagaaacaacatggtaaaacttaactaaaccataatacaattgtcactaaatagtaatagctaaaataaatagcatttatatagtactgtgcagtttccacacatatatcgccatgggtgcttctatcatcttcagtgaatagattttaaaaaaataaacctttccaaaatagtttgagaaagaaaatcaagaacacgcttgaaaggaacttaaaaagaagagatttatataaaagtttataaatgggtagaaagtaaagtcagtatacattttgaaaagtgacattttatggccttctgttacatttacagtgcatgtaaacattgtttcaaatatataattaaacatgacgaccaccaccagccctcagccctcagccgcagatatacttcacccactccacattctcacataagtaccactgttttaataacatgaggatttcttccatcctagtcaccaaagggcccaggggacactggagtggatagctttagtctcctccacttcaatgtaccccattgcatcccaccaaaaccatcctaagaatactcaatccaagtaaaatgagtatatattttatggtatatttatagtaaaatataccatgtataaatacaatatagtatatttttatgcaaatgcatattttttaaaagtcctccaatactatccccatcttctaatgagctggctatatctaacctgccatttagaagctctggatatatcaatacattaaataattttccagttaaagtaataacatcatttctgccatgagtcacacatttattcattgaacaaatatgtaaagggcctactttatgtcatgactcttctaagatttggtgatacatcagtggaaaaaagacaaaattcttaatctcttgaagcttacactctagtgaggacaaagacaaacaaataaattagtaaatgatatagaattatagcaaggtaagaagtatggagagaacaagatgggagtcagttacaattttaaatagggaacctaaggtacatctcaatgataaggtgacatttggaaaagagttgaaggtgagagagaggtcatgtcatgcatacatctggagtatggaaagagaaaagctagttccaaagccccgaggcaggatcatagccagcgtgttaagggaacagtaaggaaggtcaatgtgaggaagttaatggaataaacaaaatagagtagaaaacgcagtcagagattacaaggatcttagaagacatgttttgaagagcatgaaaaaaatagaggagtcagggataagccaattttttcatattgccatattttatagtaataagctagtttctgcttataaagaaatctgggacataggacagtaaaccatgtgtcctccggaaaactttagcatgtgtttctcacattaggttaaaacatgtatgtgtagtagctcgtatttatgcctttcctatagtgtttaacataaacatttaagtctatcctacaagcaacttatatgcaaaagtaagagagacagagatagaggcagagacagagagagcactaagaagaaatgtagtggctaagaaggctttactctgacttggtgctcccttctggctctcggatcttaaaatcacagtaaatatattgctgaacaatgaatgataagaaaatgcatcgaacacacataatacccagggtgggttaatttttaattgaccatttaaaataacaatattgcacaaaccagctggagtaaaataagggtaagtatgataaggaatctttaggcattaaaaataaactgtatcatatatgggaagaaatggcttaggtatgccaagaagcaggacctcaacacacagctgatatggggaaaaaatggcaatgatagtggaaccacttcctataatttactaaggcaaacgagataacaaaagcatctgatttagagtctttgcttactctaaataattgcacatcaattgagtccagggttcttgcattgagaaataagggagtactactttttaatcctgacaggaaaattaaaaggcccaagttattacataatgtaaataatgtattagagttagcaatgagaaagacttcctttatagcaaggcttatttcataattccagggtaaatctattgtttcgataagattttttttcaattgatacataaataaatgtatacatttaggtacactcttacttttacagaaatttaaatttatgttaacgtaccacttaaaattgcattaaataaaatagcataatatgtgtttttgtaatgtaagaaagatatcagtgtatgctaaaatatataaaatccgatgctaagcaaatggagtaaacaacaaaaaacaacatagccatataaagtttacaaaataattcacatgtagtttacaattgtgtttagaacgtgatctactgaaaatgatagaattatttatagcatctctttggggcctaggccaccttgtacatatagaaagccacagttcttgggtggctgacatactctgaaatgttctcagattttaaattgtagaaacaacacttcccataaacagagagctctctgggggcatctataggactaagtggtaattctcagggaagcaacgttttgggaacattccatcatactgtaccattaatgaattgcctgatttatgaccaatgtaaatttggagctagctaccttcccagaatgcttccaaacggcagcacagttgcaacagtaacaccatcaacacaggaaaagacagcagcctgaggaattcacaaatggacattttggccaaggcgtgaacatataatggatgcagagttccaaaggaggtgctagacttcaagcagcacataaaaactgaaatactacatatgagtaatgttacacttcaacctttgtcacacaaaagctctaaagggctccagatatggggacagcagatatgggcagcatccttgaagcaattattttagagagagctctgctgtgagtataacaaaaaaggaagactgggaagcagttccctaaccctgaactaagatttctctgcaagtacaaaaaaagcttgaatgagctacctgcagttgggggatgctttggcctggagcctaattcacatctgaaaaagctaaagaggccagtgagtaccgagtacaagcctgtgtttgagtttaaaagcaaccccttcacctagatattgaaaggggatgaattccagaagccaaccctaatatctgcagtagaatcttcagtgtggagccatttaaaaacaggctggcccaagagggcaacatgcccggataagagttcctggtagtaagaggtggagtttactgtgggagtccacgatgatggggaacaccaaacaccagccaattccacaacagagttgcaatcggagggacccaacaggcaagtttttcttcaaaaatccttctctcatgtctactgtccctctctatggatgtgattatgtggttcaagaattgttgaaccaatttcagattataacttttgtgcatgtctaacatttcctttgcagtcatagcaactattgtttttgggttttttttttttttttttttttttgagacagagtctcactcttttctccagactggaatgcagtggcgcgatctcagctcgttgcaacctctgcatcccaagttcaggcaattctcctgtctcagcctcctgagtagctagggttgtaggcacccgccaccacgcctggctaatttttgtatttttagtacagacggggtttcaccatattggtcaggctgatctcaaactcctgaccttacgtgatccacccacctcggcctcccaaagtgctgggtttacaggcttgagccaatgcgcccagccagcaactattgtttcttaatgcctcagcctaataatacttatagtaatctgttatacatgtgtgctttaaggattttaaaacctctccatttcttagccagaacctaaatattcaggttactttgctgttgttaattttttaaacatttcttattagcatccctagaagttttatttctattttaactttcttattattttggctaataaatataattacttttatatttcggagttgtgtttctgcttaatcttttttttgatgcttttgaagagggtgcaacaaagtaattgagggcaaatgctttcagtagtgtgctgttgtaaaagatttttaatttagtatttgaattatgtattaatatcatttcagtgtagctttctttcaggaaaatattaagagatagctaaaaataagaaatgtccttttttgggcaagcatggtggctcacacctataatcccagcactttgggaggccaaggtgggcagattacttgaggccaggagtttgagaccagcctggccaacatggcgaaaccccatctctactaaaactacaaaaattagtagttttagtagcacatgcctgtaatcccagctatgcgggaggctgaggcatgagaatcctttgaacctgggaggcagaggttggaggcggaggttgcagtgagccaagatcatgccactgcactagagcctaggtggtagagagactcttgtctccaaaaagaaagaaagaaatgtcctttttgccccatgttacacaaatttgttgtattaagacatattaatgtattacatttattacaatatcatttactatattctctctccaaagttttacagttaaagtagttttgctttaatttaaaggtattttctttttactgaattttctacttataacttcataggatattgagattacatttaaatgggcaaaatattttattataatatcatgtatcctcatatttgaagatgagtgtagaaaaaaaaatccccactacatcatgtcccatttagtgttccaaatttctttatttgctttgatacatctgactatagcattatagatttaaatattttaaaagcaaatagtggttaatttatatatcatactagctagatgaattactgactacgctacattttttcctatgtcagggaaaagttagaacattgtactagtacttaaaatagatataagcagatgatctccagtatattttcattatatccagtatatttcattattatcttataatacagtatgagctaagctaatgagaagaaatattgaaaccaccttgccaatatcagtaacattgacctaccttggcctcctaaatcagttttggactcaaccatcacatactatgaactaatttgagactctcaaaccttttatttcacagtatttcctagtgcctacgattgtaagacatatttaagggggaaatgggtgcctaaattctcaattcacattaatgcgtttaatgtgtaagaaagggtagtaggctactgctttgcaaagcagatttttatgctttggcccctagccatacctgaatttcttagaaggaaaatgtttcctcccttagaagtgcttcaagaaagtggaattcaggaaattgttttaaaagagtcacttaaaatatgaaatcagcagaaattggggatttagttgatagtagccaaaaacattgtaaagagcactggaggctgtgtaattttgaaaggattgtgtttgtaggcattgtgttcagcagtcaacatgagcaaaaacgataagaaaaaaagattcagcagaggctccattgccagggatgctagcagcctgccaaacacacagaggtagcaaccattctacctctttggctgtcttcagggtaacattacccttccctgctaaacaaaggaaaaggtgcccattgaaatctgcagcatgcagtcacacctgcttaagttgtgcttgcttttccttcatacaaaatatttgtgtaactgcaagcagagggttacatctccacctagcatataaaatggagaaacagcatatattataatttttcacaagacagacaataaggacaaaaaattttagttaagtatattttactatgttatttgtgattgtatattgaatcgtattgtcatattaaatttatttttacttcattatatatagataggctgcctggacaattcaaggaaatgtattcctcttgttcctagaagtacaggttgtctcctgtcttataagacagctatttggttagagcagcttctgattttctacataaggcttataatttaaatatttcaggaaagagagggagaaaaaatatatattatatttaattagtggattttctgaacacaaaatgagaagagaaagaaaatgactcttccttctggtttcgtaaagggacatactaactttgccgttttagtctattagctagaggaactgagcagcttcctaggatattctaagtaaaaaagaagtgatgggcataatccccattgaaaaatgccaggtggctgcctgagggtagaggagactctcagtatatataaagaatttccctcaaactagctctcaacccaattccctatggactcatgactcatgagtaagtcttaggaaaaaaagacactcactgaaaaaacttccaaggttgatgactagatagatagatagatgcatagatagatagatatgcagaaatttctgttattgtgaaatataaactaatacttgaaaaaaaaggaagacttgatttcagtcctcattggaatctcatgtgcacagagtaaggaacaagaaataacagggatgatggtttccaatgagaggtgaaaatattcaaaagatgtggctcaactgtggacactggatgccaccaggaggcggtgtaggaagcaacacgtgcatgatccaatctgaagggaacatcagcaggggaagaaatagatgctgggatattgagttactattttttcagtgtttgagccaacccaagcaacgtgctatgccctttacatcagttacctcaggtgatccctataattaaattagatattataattcccaatttacatatgatgaaactgatgatttaagagcaagtatttgaggaaactacccacttctggtatcactgtcctgtcacacatgaaaatatacaatgactccatctctgggaattctggaaatcaaaacattacattgcaaatcaatattagaagaccaagagcaggaaggagtgtcattactcaaaatttataaatagaacaatatatagtaactgttaatacacaaagctaagatggtggtagggagattgttagctattcatgatttaaaagaaaactataaggtttaagataagacacaatgaaattattaatagcactaaataagaaccatggaaggaggagtggagtttaggtatcataggcttatgtcatgattacacccaagaaagaaaataaagatttcaagaatgctgcccaaggtggaaggcacaagtcatgtcttgacattgtcaattggcattaacaattacattctggaggaatttcactgtctccctctgcttctctcacactacctctccattccctttttgtacagatttcagaagtagaaagcaaaggaaggcaaactctcaagcctcctgtgcttttactttcagttattttattactggcctcattgtatgtggaggctaatgcaaatccatcttggatgctaatctgccgtgttgactcttgattaacccctgttcagggaaagcctctcagagttctaccttgtctgttgttagggtaaatcctgcccttaggccaaacatccttgaccataaatcctgtccttaggcaaatttacatagcattcttgcttttcccttggaaatctgtcaacttcaatccgatctttgtatgttggttatgcgggaagagacaacttatatctttagtttacaggtctacaaatcaagatcaacagtactgtggtatataagacctggatctggcaggtaattgtgtggggatccaccatcatgtctcactgtcacccatgactagggcttctctttggaaatccatagtaaatgtttctttctgaggaactggatatgtcagcctcttcctttggcctcttagcctccttagactttggggataaatttgcacatatctagctattgcagaacagcataaaaggtttttgttttgttttgtttttactaccaagcatcataacaaattaactggatttttaaaaaactaacataaaatggttaagcaatgcatccacagctacacagttaataggtaacagagttgggatgtaaacacagtctgtctgacttgaggagccattttttaatgctttttattttaaaataattaaatattatattcacaagaatttgcaagatagtacagagaggaacctacacccttcacccagtttcttccaatggttctgtggtacataactacattacaatataaataccaggaagttgtcattggtgcaataaatgtgtatagcttcatgccattttatcttgtgtatagattcttgtaactaccatcaccacagctaaaatacagacctattccttatcacgaagatctccctcatattacccttctacagtcacaactacactctcctccaaccatttctaaaccctgataaccacttacttgttctctattctatagttttatttcaagaatcctatataaatggagtcatacagccgggcgcgttggctcacgcctgtaatcccagcactttgggaggccaaggagggtggatcacgaggtcaggagttcaagaccagcctggccaagatggtgaaacgccatctctactaaaaatacaaaaattagctgggcgtggtggtgggtgcttgtagtcccagctacttgggaggctgaggcagagaattgcttgaacccgagaggcagaggttgcagtgagccgagatcacgccactgcactctagcctgggcgacagagcgagactctatctcaaaaaaaaaaaaaaaagaaaggagtcatacaatatataacttcctgatattaactttttttaactttgtgtaatacctttgatccatccaaattgttgcatgtatcaagtttgttcctttttattgatgaatagtattgtatgggatggatattccagttcgtttaaccattcatttgttgaaggacattttgattgtttccagttttcactattacaaatacacttgctatgaacaatcatgtaaatgttttcatctggacatacattttcattgttctgtggtaaatatctagaattatgactgctgggtcatatggtaaatgtatatttagtttatttttgtttgtttttaagaaactgccattttctccccccaaaaggattaatgtttaaccactgtattttagttattttagtacttactatatttggataaacagtatccatgatggctgtggtagggatagagacaggagatagcgggaggtccagcgaaactccaccttcaagcctagggcagcctgaagactgaaaaaccagactgcgggtaccagatgaagtctgtcacctcctaactgattctgaataatgcccacctgcgcactaggggaaggagctggagccaggagaagcttaaactgttttcagaggggaggagccaggcctctccagctcctgtgtggtggcctgggattcaatctgtgaggcaggagacctgccaacaggagtctctcactttgctgaaagttcctctttccttttttcttttcacctaataagcctgtcctactcaccctgcaatgtgtccgcatgcctaaattttctgggccatatgacaagaacctgtttttttctagaacagtagccagcttgcaatattttcaatatggtccccaatgatccctgcctcctcccaatattcacagccttgtgtaatcccctcccacatttttctaggtttagaatgtgtggtcaatagtttaaaacagaagtgatggtagacttccaagattaggttgtaaaagactgtggtttcatctctctctctctctttctctctgtctgtctctcttcatatggcctgaaggaagtcatgttggaaggaaccctataggcgagctcagttctaaagaactgaagccttctgcaaaaaccacatgagcaaacttgaaagtgaatcgttcagccccagttaagccttcagagactacaactctagcaaacacttcaactgtaaccttttaagagaccctaagccaaactcaactagctaagacactgccagattccttaagaagctaagttttgtgttatttgttactcaagcatacacagcaaatatatattttgacacaaaagtgcagtgatgccaaaataaaaacttaaaatgtaagagtggctttggaaccacctaatgaatggagctgaataaactctaaagattttgagaagactgctagtgatatcttaaagagccttttacacactgttcatagaattttgactttgatgaataactcctgggcagatacaggacagagtcctaatcaagaaacttccaaatttttcctgactgaatttaaaacttcctaggaacaaagactcctttgtaacttccattgttctcctttcttattagaaatacctatagtggttattcatatgcttgtcccaccttcgtatgttggttatgtgggaacagataacttatctcttgagtttacaggtctataaatcaagataaacgtactggagctttacctacagaactgcacccaagaaaacttatcataactggtcctgattcatatagtgaaattctagattatgagctgatgctgtaataggatgaggctttgtggggtatcgggggtgggtggcgaggggccttgggaaagggtgagtgtgttttcagtgtgggagggatatgaatcatcagcagatagaggaaaaactgtagcatccaggccccaaaatggctcccagtgattgctgaatcctggtttcacactcttctcatggtccctcctatattgtattaggatcagtctatgtgaccaatagaatatgactgaagtaatagtatagtgtgtcactgctgagattcagttatagaaaattgtggcttccgttttgttccctctctctctcatcatttgctttaaagaaagacatgatgtaagtagcccacatggtgaaaaactgaatcctcctcttaacagccacatgagaaaccttagagtcagatccctagtcccaattaagtcttttttttttcttttttgaaactgcacctctagccaacacctcgattgaaacctcatgagacaactgagataaaatcattcagctaagccactccagcattcttgatccacagaaacttttggataataaatgtcctattttcaagccactatgatttggggtaatttgttatgcagcaataggaaactactactgtgattaataagacttaagaataaaggctgggtgcagtggctcacacctgtaatcccaggactttgggaggctgaggcgggcggctcctttgaggtcaggagtttgagacaagcctggtcaacatggagaaacctcatctctactaaaatacaaaaattagctgggcatggtggtgcgcacctctaatcccagctgctcaggaggctgaggcaggagaatcacttgaacccgggaggcagaggttgcagtgagccgagatcacgccactgcactccagcctgggcaacagagtgagactcggtctcaaaaaataataataagaagaagaataaagatatccacaaacacagaaacatgggtaagatttatctgacacagaaataactggagtttttcccaaaaaatgtggttttaagcacagtttagatgctcagaattattgtttcagaaaggcataagtgaactgtgattataatttgtagaacatatctctaacatattgaagtgtatccttttgaaacaggaaattttctctgacttgtttactcagccggtagttctcaacccctgagagggtgcaggggctgggatgagtgcttctgggcgccagcaggggcagaactctgtgtggccccgtggcagagttttggagggtacctgcgacccctggagctgaagagggtgtgtgatacagtgtggtctgttagctttgctgtctacggacggcttaagtatttaacagctcattgtgacagccctctgtatttcgagctcttgttcagcatccaagaagaatcaggccgcacaaacgaattgaagacggtaaatgtgggggattttattgccgatggaagtggctctcagcaggatgggaagctggaaagggaggggagtgggaaggtggtcttcccctggagttcagggcagccaaactcttctccacagtcccaccatcaagccgtccctctgaagtcaagctgcttctcaccaacatcaagctgcttctcttctctccttctctgccacatgctgccagtggagcctgggatttttataggtacaggatggggggtgaggtgggccagagtggttttgaaaaagacaacattcaagccagaaaacagggatgtaaagttctcactttgggccgtgggtccaggcttgatggtagggccctcgccagggatcgcccgcttctacccagtatttccctgccctctgtccatatcacttttggaggaaaatagcaaacaaaagaagctgtaagtgtgtctcctatactattcaggagagcacatattctgaccaggtaatatgaattcatttggccagtgtctaatcttatcaaggattgcatagaactgatgacattaaataattacaccagctcatctggttgtgataccacattcacaaagacaccatctaattataacctggcttaactcataaattttcctagagaaggcccagttcactagctacctgttatttgtttctaagctagctggtatttgtgacctgtatcataaacaagcattctgatttttatgtaagtgatatgtggtcatgttagcagaagccagttacggtaactcagatcaattctggatgccctgcagaaaaaaataagcttcttaatttttaagtcaaaagagcatgggaactgcactgagatcttaacaactagtgctctttcctctgtcccttcaacagcagtgagctggcctcaattccatctctgattttactcactttaaattcaatactactattactaaatctcactgtgttacccattcaaccaaatataacttagtaatagttttcaggcaattgagaacatacttccatttaacaatgacaagaacaacaaaatgctagatgaatgaatgaatgataggtcagttaacttttagaagctgtagttaaaagcaagtattttgaatgtattaacaaggcaatgtaacatgctgggagcgggggaatctcatgtcatgtttagtgtgtgtatttgctacaatttgtcagtcaagtataattttacaaagaccttgtatttagaatcaaatcgcaatgcttggaagtaattgagttgcattttgggatttgccttaagggagatagaaggtgagaggcttctagcttaagtacaattacagaaaagggccttgcatttttatgacttaggttattggccaatcaatgggtcattggatctttattattttaattaaaattggttcactttgatgacataaaacatattgattatgggtattctcctcagagtcttgaaagatttggtagaaaatagcagtctctacctttctcatgtacccatcaattctgttaactctcttagtctgatttctcttttcttctttgattttacttctacatcactttttgtttttattcatattttgcagtaatcttatggaaatgacacccacccctacacagcgtataaccaggagtcattactactctgtatttgataagtgtagaaagggccattgctcatgcaaatgtctacacattctctgcatagctacttactattagcttcaatattgtttaactcaaacactgtaattttgaccatagacccaaaattattctgttattttctttttcactcatgtgtttatgcatttattaaaaaatatttcagtacttactgtgtattaagttgggaaggaaggaaagaagggagagaaagaagaaaataaagaaagagagaaagaaggaaagaaagaaggaaagaaaaagaaagaacgaaagaaagaaagaaagaaagaaaaagaaagaaagaaagaaagaaaagagaggaagagagtaaggaagggagggatggaggaaggaagggagggaggaaggaaagggaagggaagaagggagaagggggagagagaaaaaaatgaaagaaaaggaaaagaaaagaaaagagaaaaggaaagaaaagtaaagagaaagaaaagaaaggtaggcactaaaacgttgcaggtattcataaagcagctgcttaaaaataaaactaattcttttctataaggttattctcttctagacaaagttcaactggtcaaatactcttgttttttaaagttgctttgtaataattgtcctaagcttgttttatttatataatttagtgtatttagagtgtggatacttagatatttgggtttcaaagttcacgtgctcaaattatcatctaagctctaagatacaaaaaccaaaaacaaacaaacaaacagaaaaccttaacaaaatgtttataatttccttaagctgacctttaagaacatccctgaaatgcatcttttggacaatattttgtttgtaatgtttctggacattaggaaaagttaatatagacgagggaaaataagtaaggaataaaactctacatgtctaaagaataatgccaagcaggagaaaggaagtttagcatttttaaactacctaagtatgttaggtaatgggttacttatgaaaattaagtatttgtacatttgtacatttttatagcagcccttcagaccaaaacatgttattgaatttatattccttcagattttagaaaactaattcatgtgtttctttttctactacgttcatcgttcaaaggcaaaagttatgattattcacactaaataggatttttaaaagactatcaataacttcttatttgcacaagatttaccaccaaatgatttacaagattcgtttctatttttcagaggtatttgtttgttttgaattttgaaaatggtaataagcactgataagacatcataagaaaagtgaggtttacaagtataagttacccagcctgtcaattattggcttggtatacatgcccaagatcaccacattaatatttagtggtatgaccattaattttatgtatcaactttattgaccacagggtgccagataaaatattctttctggttgtgtctttcagcctgtttctggatgagattagcatttgaattggtggattcagttacgtagcttacccttcacaatgtggttgggcatcatccaagtctttaatggtctgagttgaacaaaaagcaacaaaaggctgggtgcagtggctcaagcctgtaatctcagcattttgggaggctgagatgggaggatcacttgagcccaggagttcaggactagcttgtgcaacacagtgaggccctgtctctaaaaaaataaaaataaataaaaatgtaaaaagcaagaaaggggaaattcactacagttttcctacctcactgtttgagctgaggcatctcatatcttctcagacactgggagtaggatttactccattgactcccctggttctcaggtcctcaaactccaactgatttacaccaccagctcccatgtaagccaatttctcttaataaatcttcatatatataaacaatctcctactggttctctttctctggagaactctgactaatacaagtaggaagcgttcaacaaagatttatccagtggagattcaaactaatgcctgacacattttatactccacgcttttccaccacaccaggtagtgccaatttatagaaaatactttctccagaaggcttggtatttagaaatgtcatataatattatattgcttgtcatggtaacaacgtgaaatacaagaatatgatactaaaatatttgctttaaggtagaaattttctcttacaatttttcctcctacaagaagggcgtagatgagtcagacactgatccaattctcactggcccagttaacttgtctaatgtaattgagaagatgaaatgaaggaattcatctatacattaactaataggcttccttaagtactaagaaatgtctactccaaaaggaaggatgtggctttcttaaaatacgaaccaaacatagaaatctcagaaggtcctttataagataacttatatagcaattaaatggcattatacactaaaattcatagtccttacagttttttgaaagcagtctcaatttagtttgtaactgtgattttctttattttctaagtccaatctcatttttttctttggttttcatttttaattgacacataataattctacatatttatgtcgtacaaaataatatttcaatacatatatacaaagcataatgatgaaatcagaataattatatttatgacctcaaaaatttatcatttctttgcgctaggaacatttaaaatcctttcttctagctatttgaaaatatacattgacttattcttaactatagtcaccccacaatgctatagaaccctataacctattcctcctttattgcatctagctgtaattttgtatccattaaccaacgtctctatcctttcctccctcctaccaatcccagcttctaataatcacagttttcacggtttacttctataaggtcaagtttttagctcccacatgagtgagaatatgtgatattaatctttctgtgctagacttattttgcataacataatcccctccagactcacccatgtttccaagaatgacaggatttcattcattttattcaaatatatatatatatatatatatatatatatatgaatgaatagtattccatcgtgtatatatactatattatctttatccattaatctggtgataagcaattaggctgattccatatcttgactatagagaatagtgttataataaatatggggatacatatatctttctgatacacttactttatttcctttgggtaaatatcaagtaatgggattgctggatcatatggtattcaaatttttaatttttggaggaaacattatactatttttcaaaatagatgtcctaatttacattctcatcaacagtgtataagagctcccttttctccacatcctcaccaacatttctgatttttttttaataacagccattctaattggggaaaaattatacctctctggatttaatttgcattcccctgatgattagtgatattgaacatttttaaatatacttattagccactcgtatgtcttattttgagaaatgtctattcagatattttgctcattttaaaaatgaggttatttggatattttgctgttgacttctttgagttcttaatattaatcccttgtcaaatgagtagtatgcaaatattttctcccattctacaggttacttcttcattcttcactctgttgtttcctttgctgcacaggagctctttagctttatataatccattggtctatttttgcttttatagcctatgtttttgaactcttaaccacaaaaactttgcccaggccaatatctctagttttcttctagtagtgttatagacttgggtcttacatttaagttttcacccattttgagttgatttctgtatatagtgagagatagagatctagtttcattcttccacctacagatatctaggtttgtcagcaccatttattgaaaaggctgccattttcccaatgcctattctttgcacttttgtgaaaaatcaattggctatacatacgtggatttatttctgggttctctattctgttccatttgtctatgtgtctgtttttatatcagtatcacactgctttgattactatagatttgtagtatattttggagacaagcagtattatgcctctagctttattcatttttctcagaactgatttagttatttgaggtctttcgtggttccatacaaattttaggattttttttcctttttttttttttgaagcatgtcctaagtttggatggaaattgcattaaacctgtaggctactttgggtagtatggtcatttttataatattaattcttccagtccatgaacatgggatgtctttccattttatttgtgtccactctaatgtatttcatcaatattttataattttcattgtagagaattttcaactccttggttgaatttattcttaggtatttttttattatttttacagctattataaacataattgctttcttaatttatttttcactaagtttattattggtgtatagagagactaattatttttgctcatttattgtgtatcctgcaaatttaccaaatttatcaggtctaagattttttttggtggagtctagattttcctatatataagatcatgtcatctccatatagggataatttgacttcctcttttttgagttggatatacttttttaaagagatagggtctcactgtgtagcccaggctggtttcaaactcctgagctcaagtgatcctctcattctagcctcctgagtagctgggactacacaaatatgccactgcacccagctgcactttattcctttctcttgcctaattattctggctaggacttccagtgctatgttaaataagagtggtgaaagtgggcatcattgtcctatcccagtttttcaaggaaaagctttcagttttctccattcagtatattagctgtggttttgtcatatgtggcctttactgtgttgaggtacacttctatacttaatttgttaagaggtgtttttttttttttcatgaggtaatgttgaattttatcaaatgctttttctgccactattgaggtgatcattcaattgttgctgtgatgtatcacatttattgacttgcatatgttaaactatccttgcattcctagaaaaataatcccacgtaattgcaatgtataatccttctgatatgctgttggatttcatttgttagttttttgttgaggatatttgcgtctatgttcattcaaaatattggtctgtagatttcttttattgttgtgtccttgtctggttttggtatcagggtaatgcttcccttataaaatgagtaagaaagtttgtactcctttttacttttttgcaaaattgtgagaactgattttagttctttaaaaatttggtagaatttagcagtgaagtcatctggtcctaggctttgtgctgttgttattgggagattttttatttctgatttaacatccttactcattattggtctggttagattttcaaattcttcctggttcagtcttcgaaggtggatgtatccaaaaatttattcatttcctctaggttttccaatttattggcatatagttgttcacaatattctcttgtgatcctttatatttccgtggtatctgttgtaatgcctgcattatgatttttgatttatgtgggtcatctctcttttttctttgtttgtctcactaacaactgttcaattttgattatctttccaaaacactatcattatattgtttttattttattgatcttttgtattttttgtgcctgttttgtttatttttgctctgaattttattatttctttctatctactaagttgggtttggtttgttcttgcttttctaatttctcagaatgcatcattaggttgtttatttgaaatctttcttttttgatgtgtttttgccataaatttctatattactactgcttttgctgtatctcacaggttttggtatgctgtctttcaattttcatttctttgaagaaatttcttcatgttcttcttaattttttattaactaattgaccattcaggggcacgttgtttgatttgaatgcatttgtacagtttctgaagttcctcttgttattaatttctatgtttatttcattgttattttttaaaaatacctcacatgacttcgattatttttaaatttattaggatttgttttgtgacctaactttgtgctgatgagaacaatgtgtacttgtagttgttgcatcaaatcttctctacttgtatattaggtctatttggtctatattgcagttgaagtttgatgtttctttgattttttgtctaaatctgtccactctctgttcaatgttgagagtgggttgctgaagtccccgactatttgtaatggagtatatttcttctattcgttctaatagtatttgcttcatatatctgtgtgctctggtgttgggtgcatatatacttataattgtgatatcttcttgctgaatttatttatcattatataataactttgtctcttttaatgttttttgacttaaagtattttatctgatataagtatagctacttctgctcatttttggtttccattcacaaggaataactttttccattctttgactttcagtctgcatgtgtatttccaggtaaagtgagcttcttgtatgcagcatatagttaggtcaattttttaaatctatatagcccagtcagcaaaacttttaatttgataatttaaaccatttaccaaagattttattgaatgttgagaatttactcctgttcttttgttaattgtttactggttgtgttgtaaaccctttgttttcttctctgcctcttattgtttaacattgcagtatggaggtattctgtagtgagatcattttacttctttctctttcttacttgtgcatctgctgtaccagtgagttttatacttttgtgttttttcataatggcagatatcatcctttcacatccacgtgtcaggctctcttatgcaattcacgtggggctggtctcgtggtgatgaattttcttagtttttgcttgtctaaaaaagatcctatttcttttttatttctgaaggatagctttcctgagtataatattctcgtctcacaggttttttttatttctttcaactctttgaatatatcatcctattctctcttggcctgtaaggtttctgctgagaaatcttctgttagtctgatagggatttccttgtatgtgacttgttgcttttcccttgctgtttttagattctccccttgtctttggacaatttcagtatagtttgcctcagagggcacctgtttgggttgaatttatttgtaatttttttagcttcttaatctggatatccatatctcttctaagacttaggacatttttagctattatttcattaaataggtttctgccttttagcatcttttctcttgctgtaacttctataatgtaactatgtatttgcttaataatgtctcttatatcctatagagtttcttcattctttttcattctgtttttcttttcttttctcctcttttttgtctcattgggtaatttctctattcaccttcagaaattttttttctgcttaattcagttctactattgaagtttttctattgtattttttatttcacttattgaatttttcaatttcaagatttcaggttggatctttttaaacaatatctatctctttgctaaatgtctctttcagatcataagctattattttttcttggattgtctatttgtgttctcatgtctcactgagtttacttaagatcattattttaaatttgggtctgttactggagaattatgatgttgctttgaaaatgccatgtttctttgctctttcatgtttttcctgttcttaaattgatatttaagatcttgtaggacagtcccttcttccaattttatgtaatagttttaatagggaaagactttttcctgtagatattttcaataatgtgggttggatagagtgctttggttaaggttctaggtgggcactgttgtatattatccatatgatttctaaagctgtaatcaatgtcatcagtgtctgagagtgcatcagcggtctaggctgcaattatttgtgaaatctgtggcagagctttactggggacagggatgccaggttggttggtccttggtctccaggagagcccacagaggtgcacagtcacgttgcctgtggaggggtcaagattgcctgtggcggtgacaggctcctcatgggacagtcctcaagtttatggagagcgtgcacagtcttgtgatggccccattttggatgaagcagggtccctgatggtgatggaaagccctgggcaggtggctcttggattctggggaatgagtgtgtcaggtcactatgtcctgagggctgccttcccagtgtgctggatcatttatgccctgatgtatagagctctgcctgggctctggtaacaaagttacagctgcaccactatgttcatcttttgtcatgatgctgcagctttcctggtagatgaggtggaaggtcagcaagccccagggatatggaggtgcaggggctattgggccccagggaagaataaactcaggtggtggctcttctctaaaaatggggccatgctgtggcagcttgggtctttggaggtgaagaggacccaatgtgaattttctttctgggacaatgcagttgcatggactccaggcagctctctatacttgactcagctcctgcaatggctgtgaagctctcctgttagtaggagtgtgagtattcatcgtgggaatgtggactactgaggatctcttgcttttcttttttctgcagtggaaagctcctcttggcttgcagacaatcctggccagacacttcattttctctatatgcatatatgatactatataaccctagtatctatgcctcagagggtttttgatatttcgtaatagaaaaaaaaatcataagatttactgaatcgtaaagtgcttttttttcctttgatgaagtcatttgaaatattctaatatctagcagttgtccctctgaaacatttcatggggaagggggaatccttccagaatatggaggtttaagattgtaacctgatccaagtggagcttgacttcttggctcctgattttgatgctgttttccctcattatacactaagatagctttatacaatgtaattagtggttttagtcagcacattcatttcagggtaaagggaaaacaaaataaaatatctgggaatgggtatatattttaaattaataaagttactttattttatcctccctctttactagagaagctaaatgcaaaactaaatagactagcaattattatccaattatccacagacatgtgtatgctttagctgtatttttaagaataccaacaatgagaaagctgacagtttcacaattagctgacaaacaaagcccccattctctctctactcctcctccttactctctgattttacaagatcaaattagtattactgaataaactatctcaatgctatactgctactgctaaggattaaattctgtttcaccatctaaacagaaatttaatttcccagtctaaacagaagatacagatccaagaatatctaatgaaatacaacccacagtgtgttctaattacatacagttgaggttttcagagttaatcctaaagagagtaataacttcccccaaaatcagacactgtccaatgccttgatttcagtctagttcgactttgagcaggaaccccagacaatatgcacctaaactatggacccacaaaatctatgagataataaatttatgttgttttaagctgataaatttgtggtaacttgctatacatctatagaaaactaatacagtttagttcaatattgtaaggatttcagttctcttaagttaatcaacagagtcaatgcaatgtacataaaaatcccaggacctttctgtgcaaattttaaaaataattttaaaatttaagtaatttaaaactaataaatttaaaatttaagtaaattaaaactaatacaattttgattcaatattttaaagatttcagttctcttcaagttagtcaatagattcaatgcaatgtacataaaaatcccaggacttttctgtgcaaatttaaaaaataattttaaaatttaagtagaaaagatccagaaatgaccaagttaatactgaataggaagaacaaaggaggaagatatatactgatactagtgcaaggacaaacattacatggaatttaaaaatatatccaggagcagaaatagtgtaacatttatacaatcacttgatttattacaaagttgaccttgaagtaaaaagagaaaagatgattgatttgataattgttactaggtctataggatatccacatggggaaaattgtatcttaacttttaccttctgcaacatctgtcaacaatcaatttcaggccaggcgcggtggctcacgcctgtaatcccagcattttgggaggccgaggcgggcggctcacgaggtcaggagatcgagaccatcctggctagcatggtgaaaccccatctctactaaaaaatacaacaaaaattagccgggcgtggtggtgtgcgcctgtagtcccagctactggggaggctgaggcaggagaatggcgtgaacccgggaggcggagcttgtagtgagccgagatcgcgccactgcactccagcctgggtgacagagcaagactccacctcaaaaaaaaaaaaaaaaaaaaaaaaaaaaaaaatttcaggtgtatgatacatttaaatatgaaaggaaaaacaataaagtttctacacagtatcttcatgaccttaaagtttagcaattatattttaagcaggacacaaaaatcactaaccataaagggaacatctaattgatgtactagttttattaaaataaaaattatttttctaaaataagctaccaagtgaacagtaagccacagagtagaagaagatattcacattacactcatcagaccaatgaataacatttagaatatgtaaaagtcttataaatcaattttaaaaatcagataacttatttatgagtgtcttaaataggtactttacaaaatagaaatttacatgatcaataaacacataaaatggttctcaacttccatatttatcaagaaaatgcatattacagtgctccagcactgcatatagactagaatagttaaaattaaaaggactgatatcattgagtgttggccaaaatgtggaccaacttaaaaagcaatactatttcacttctggtggattaaacatatatataaaactttggaacttgccgtatcttctaaagctaaatatgttatacttgatgatgatctaagaactcttctcccaggtggaattgaaaatgtacttaaatgtgtgttaaagcacatgtataagaatgttcatagcagcattattaataattgttaaaaacttagaatgcttttccagtaaggaaaatggatgaatctttactaaacaaaatgtcatagttgaatttcacaaactattttgaataaaataaacctgttgtaaaaatgtacatatgttctctgttccatttatataaaactaaaaaataacaggcaaaattaatttgtggtgatagggaaaaatgactcctttttaaaaggttaatgactgggtaggcacacaaagtatatttcttgtggtactgataatattcaacttcttaatccatgaatgctttcatgggtgttttcactttatataaagtcatttatattttttattttacacttctttttacatatgttacacttcaacaacatgtttaccaaataaataatccaaaaatatatatatttggtcataaatcaggtatggttcttcaacaagaatctgtctccccctactaaacagcaggactcctgtgctccttagagttgaagatacacacatacacacagacaaacacattcacatacagccaaacacacacatgcctggaaaatattgctggattcaagatatgtgtgtgaaggatgattgaacattgatctttgagaaacttttacggttgttatgcaccccacatacataatatatgatttgtagttgcgtgtctgatataaaagatctaatttttataaaattgtgttacaagtatttgattgagactgacaacatgaagtaggaaatccttaaatggtgacctacatccctaaggcaggtgaaaagtatcatgagaatcaactgttattttgcaaggtgtagtaactcaattttaaaatggcccccacagatcccttcctcttattatttacaactatgcaaaactcccttctcttgagtataggcttgaactattaacttgtttcttatgaacagaatgaagcaaaagtgagaggtatttccgagattaccttccaaaagactgtgactttaatctccttcacaggctctttctcactttctcatttgattcctgcaattgaagccatctgctatgctgtgtcctgttctttggatcagcacatatgacaaggaagtgaaagtagtctctgtccaacaatcagtctaacagcctgagaagaactgaattctgtcaatgaccacgtaagcttcgaagcagacctttcgcttgttgagccttcagatagacagcagccctagctgacatcttaactgcagtcttgtgacaggtcctcagacaggataagccaaattatacccagactgctgatccacagaaaatgagaggtaataaatatcgttgttttaaaccactaaatttggtagtaatgttacatagtaaaaaataagaagtatacaatatatcaaattgtgctgcttctttatttcatgctttaaaattttatttccaatttttagtttttaaaggtattatctatggtattaaaaataactataaatttattattaaatgtattttattatagttttattaatattctattacatataagatataataccaacttatggatttataaaattatttatcctgatatataaaataaattgacatataaaataattattttattaatcatcattgttatttaaaataaccacatataatcatagcctaattatatctcaaagctacctaatgccttctttaagtgactagtttcacattccaaagaagagtcaactaattttaagtatatttgtagaattttcgtggatagttctaagtagtttggtcacatatttagttaaattggaagcaagtaaataagaaaatagatccgccatgaacatatccgatattggagtgtgaaaggcaaatacccagatagttatgataaaaatgaacaaagctattaatctgacaattaatagggccagatttagcaagatttcagattatgttttattttaatgtccatttatcattgtctataagatccaaagaatgctcatatacattgaataaattgtccatctgtcctattttttaaggatgatttgactaaaaacattttttctcacgtctattttctcatagtagcacttttgacacatccatttcccatttttggttttggaaaatgaggtcactctacctatggaaaagacaaaggaaattttaagtctctccccttgggttgtttgtagtctcattgagaagaagacaaagatgtgtatctttatcttcccttaatacctgtaaattaggaaaagtaagaatggaaaaacaaaggaacaaacggagacaatgagatacagaaaagctcaaagaaagataagtcagaactaaacacaagttttcttatgaataaagtatctcttctttatttacttttatcttgtttcctagatcagttgtcttacagaattagaccaaccaattacaaaaatgacaagatacaaacatatagcaagcatacaaattctcaggaaagctacacttgaaactagttatgtggcaatgaaatagacagattgaatatattttgaagctgccacaattatctaaatatttagtaatatttaatctgtaagatattttggtaggtttccttgaggaagcacaatttcttctttttagagggaatgtcacctgtcagtttttataaaatatattgcatttgggaaatctaaagtcagaactatccataatttttaaggaaaatgtaaaatcatcaaatcagtagcaattttatattttgtttctgaaattgttttcccaccctcttcaactttatgataatttatcgggttttcagagaaaaaatacacaggagatacaaagaaaaaatatttttccaggtttatctttccaacatgcttttgttcatttaggatttgtttagctgttgattttgaaagtttattttttcatacatactagctgcatatagttgataaaagcctcaaatacagccaggcatggtggctcacacctacaatcccaacactttaggaggtcaaggagagaggacggtttgagcccaagagttcgagaccagcctaggcaatgtagtgaggccatgtctccactaaaaattaaaaaaaaaacttaaaaagattagctgggcatggtgatccacacctgtattcttagctactcaggaagctaaggcaagaggatcacttcagcccaggagttcaagcctgccatgagcttatgatcacaccactgcaacagagcaaggtcatgtctgaaaaactaatgatcataataataacccaaaaaaagaatatgaaatatctaaatctatatccacaattataaaaaaggaaagagattttatattcaaccactgaatatgtatatggaaggcaggatggcttcctctctacccaccaatagaaaagtaatgtacaatattagcaaaggtttgtgccttcccaattttcttatagcattctgtggcttgctacttgaaacatcaggggaattgttgtatttgaaagaaataaaatcataattgttaagatcaagcaatggctttacatgatgacgtgtatattttgttattcgatcctccttggcccgaaatgctgactatttaatacaagagatatttctaagcaatttgaagcatgattggcttcaacatttgctttgtacttttctcagaacaccaagtacataatagagttttgtgatttttttttttaaaaggggtgtgaatatgtagtattacaattgcaataatgacctacaatagtggtgattcagaagttgccttttagggctacgtaagactgagttccaaccataaaaatggcagcaaataaaccaatcatttaaaagtgtcttataaccatttttttcaaagtatcagtaatttacaaaattgcacagcacattagtcaagtcttgtattaactaaatttaaaattctaaataatcatacaaagtccatatcaatgctttgatacttgacattatggtacagtgggtttatcatttattacaatgagttattttcccaaattcttgcatctgtggtttcttctaagaaaataaatttattctatgcattttcaaatcaaatcatttgctataaatgataaattttttttctaaattgtcatagaaactatgcttatttcaacatataaaataatcaaattcatgctacttgaaggaaaagacaagtccatatttaaaagatagatttatctattaattaattacattttatttcaaatccaaaatataaagcaggttcaccctatagtttttgctttttattcttttaattggggaagcaaaagtgatgaaatttaaatatccaactcctgcttccttggatcttactgaggcggggagaggggtacatcaggttataaatattaaataactcaagtctgaaagaagggatctttaatgagcaggaacccactgtacaagctgaaggtgatagtaattattttataatgttatagtgtcatcttacagataagttttagacacgtttattttatgagaaatctagaatttcagtataatagttatttgaaattatcaggttgtcacaaaaaaaattattgtaaactcaaatttcttgtcttaccagattccagaaatagttgtatagacagccaataaaagatttgccttcataatatttgtgaaatacacagtaaaaatagcatgcgatgactaacttagagagcaataatgagggtatgggtggcagacttaaatgggagtaaaaacagattggagaataatttgtataatctgatcccattttggaatactaataaatgtccaaatatatatatatatataatttttttcaaatatcttcacagaaaacacttgaaatagttatctctgggtgataagactacaaatgattttattcttacatttttaaaatataatttctaatgtttcaattataaacatgcattactggataatttttaagaaaaataattgttttatgtgaccatgaagtaagcatcctttgttttccaatgtgaaaaatactgtcagtaataccttggtaagatgaatatggtttgtatttatgaggaggttatagttaatggagaatcaacaaagaaactctaatgccattcagtaaatgaaatgacaaatgaaatacagggttatatatgacagcatctatcagaagtatataatatggtccaagagttaagcaatggcaaaggaaaagaaataagaactataatatatttataagagtattggaaacatggtagttttcaataatcaattaatcaattaattacaattttattttataattaattgattaagtacatttaattagtcaattgattttacaaataattacattttattttaatgctaaaatataattaattaattaaatttaattacattttattttaattctaaaatataatgtatgctagtcttctgcttttattcttttaactttggagattgaaaaaagctaaggtatgattatgcccaatcttctgctccccagtctggggtatattacccttaaaatcagtgggtagactgttcacttttgcaatggactagtactacaattgtctttcgatagcctctttcagaaactgtgttgaaaaagcctaatagattaggcactctcaacaacaacaacatcaacaaaaacaaaagcactttatcatcattcagaaataaaatgaggctataattacaacactagcagcatttcacagtttactttgaaattatcctttgaggtggacatatttcatatatgttttacatggaacattttaagcatttcccttatgagtttcaggtggcattgatactggtttgttgtttttttcgtattctctttcaactatgcgcattgtttgggacaagacatgttgctgtggcatatgttactaggctacttaactgttaaattgggcatttttccttgacacaaaatcctatacattatctttgcccaatgtgtttagtttaaattcctctgcccactattctaaaaaaaagaaactataaacactaaagtagaaaactctggccaatttattttatctataccatatagatggatctacatggtatagatatctatggtatagatataataatctagagctatatagattaatctatatctatagttatagatatccataagtgttaacaaatacattgcctacattgtgtaacttatatttttgtatttttattataatggtaattgatatatcagcatattttagcatttatagctgcttagtaggaatgtgggctataattgccactttctacctttctattttcttaggaaactccaggattctaaaagtaaagccctatggaaataaatcaataacatttcaaatgaagaaccaaaatcgggaaatgcaaatcacaactctaacatcaacattaacttatgtaaacggctcatttgaaattatcacactttttttctgtttataaaacacagttatcttaaccttaagcattgtatcatccacatgttttcatctttgggcttctgaatatgtactagccggacaaaacaaataatagtctttataatacctacagatccctgtaagaaacaaatagcctactgggttaccagatgcgctatagtactacaaaattaaaggaacagactacaaaattaaaggaacagatgctctttgttaaccttttttctaacaaaaaataaataaagttttaaaaatagagattgggagcaaactcagaaacctcacatctctaaatattggaaagtttgaaaaacagggataactgaaaatgttgcttaaaaacatcaagctaaaaatgaagagaaaatctttgataacaaagaagagagacatcaagaaccaaaggatgaattttgagtaaataaatatattgaatgatgtaaacaaagaacagtggtaagagtaatctaagcaacctcaaaagttttttaagtaatggaaaaacattgtttagtattatataaaatttgtcaatgctgtgatttacaaaagaaaagaaaccgtttagtcaaggagaaaataacaagtttttaggaaatagaaatataaggatttcaaataaaaataaggacaaaaacaatgttttgcatgtagtgacccatggattgccttacacataagaatgagaaactcaggtagagaagaagaaaaatgagcccttcaaactcattcatactgaaccagaacaaccacaaacaaacaaaaccttaaatattaattgtcttcttaaaagggttaaaaaaaaacaaaataaatgctcatacacaattgggtaaatgtaaaactggcaaaattgagtaaggtcaatgaaatgtatcactgttgattttctgattgtgatattgtgctatagttatgccagatgttacagttgaatgatacacagtatgtttctatattttttctaacaactctttgtgaatctcaaagtaactcaaaatagaaagttaaaaaattaaggaaaataaaggttgaccttttcaatcatctcagctattgttccaattacaaagttaagtaaatcttacaaatttccttcaaatggtcttacaacatatctttgaggatattaagaccttaggagaatataatcggaaatcatttaaaatcagaaaactgagaaattgagaaataatcaaaagccattagattcacaaacacagtgagactattatgtgactgtggccagaaaagaacaattaaacatccccccacccccagcccccccacctcctcacgtgagctacttaactgggcaatgatatggctatagaaagaaaccatgaatttgaataccagaggttgccaaataaaacgaaaaggggtaagacctaaataattgtcttaaatattaacctaagcaaaaaacctatgtaaaatcaaattaaaatattaaaataacgttagaaaactccaaatacatgggaatactaaaaatctaatataaccaaatataaatctaagaccattccactcctaaaacaaaatacaggagaatactttcaaaaccttggagctgccagtttttctgttttaattattattatttttaatttaggacaagactgctatgatttgaatatctgtctcctccaaaactcaagttgaaatttaatccccaatgtggcagcagtaagaggtggggccttaagatgatgagtatgctcagcccccctgccatgtgattccctgtgccacttcagaactctgcagaaagccctcatctgcaagaagacccttaccagatgtggacctttgaccttggacttagcctccataactgtaaaaaataaatttcttttctttataaattacccagtttgaggtatcctgttacctgaaacaacagaaaatagattaatacaaagagagaaaaaaacagcattaaccgttaaaaataaaactaaactggatttcaccaaaatcagcttttcacttattaaaagacaccattaagaaaatggagaagcaagccactgacacagattggagacgaaaatgatatattgacagtacgcatattcagcaaaggactgctatcaagaacatacgaagaactgccaaaagtaaaaatatgaaaaattattgataaaaaaataagcaatgaaaaaatgctcaacatcctatatgaccaggaatatgcatattaaaaccataaggagatactattttacacttataagagtgagtaaaatcaaaaggactgataacactaaatgttgacatgtggaccagtcagaacccttatgtattgctcatgggagtgtaaaatcgtgcaaatattttggagaggagtttcttaaattaagcatatatttagccctcaccctggcaattcattactaacaataaaatttaagcaggagaaataaaaattcccttgaattccatgaaataatatgtgtaagtaggtacatagcattgttattcataatagtccataaaatgagaaaagtctaaacatcctttaatagaagaatggataaatattcttgaggcatgttaatacaattgaacagtgtaaacttaaaataaaattctaagccccctaactgatagaatggatctccctttcagccaatgatgttctaaagtaaatgtgaaaaactagttcaggccatcatgggaaggaggggtcagacatatctcattatgccctcctccctttggaattcaggcacaattgatcagtgttaacattaaaaaagagatcttaagactgaccaaacagactctttgtggcaatcagatacatcacaaaatgacatataccaggccctgtaagaaattgaagtattttaccctgaaatatatttcttcgatatatctttaaacagccctgtaaagctgcctcttgtggggaaaatcaacattctgtagagaattctcttccctttccaggtcttttcctgatccaggagagattagctaagtctggtacctttttaagtctgataacaaacatttgccctctattctatctgaagcctgctacctggaaacttcatatgcataataagaaatttggtctcccaaaccccttatcttaacccagacattcctttttttctattgattctaggtctttagataaattctttcaaccaattgccgaacagaaaatacttgaatccatctatgatctggaagccccggctttgagttgtcctgcctctcaggaccaaaccaatgtacatcttacatgtattgattgatgttttacatctccctaaaatgtataaaaccaagttatagtctgaccaccttgggtacatgttttcagagtctcctgaggctgagtcatgatcgtgtccttaaccttggcaaaataaacttgtaaattgattgagactcgctcccttgaagggaagaacccagtaaccacctgttgaccaaagagcccttgggtcctgaataaccagcagcaatacccaggtagtatgccatggaccttgggtgagactttgagacatgctggcttcaggtactagctcagtcacagtggattaaagcaccaagtgtgctctcgaggtccccaatacaagcctacactcttggacagcatttctggacctgccctggaccagaggggagcccactgccctaaagggtgagtcccagaccttgtagcatttaccacaagctgactaaagagcccttgggtcttaaatgaacattggcagtggcctggcagaactctccacaagctgatggtggtgatggacctggggagaggctcctctgcctatggaaagaggtagggaagaatgggaaggactttgtcttgtggtttgagtgccagcttagccacagtagaatagaacatcaggtagatttctaacgttttttacttcaatccctggcttccagacagcatctccatctgggcctgcgcagaactttccacccggaagggaaggacataaacatggctgcctttgccactggctgactgtagagccctaggtccttgagggaacataggcagtagccaggtagtagttacagtgggctttgagcaagacccagtgctgtgctgatttcaggtctagcctagggcagttccagtgatgtggccacagtggggccctgtgtcatcccacttccagctccaagtggctcagctcagagagaaacaacatttgagagaaagtaagaaaagagaaaaacaatctgcctggtaattcggagaattcttctggatcttatccaagacaacaaaggcggcacatttatgaggctgcaataaccctagtgtaactgggcttagggtccccgttaaagcagatacagcttaaatcacaatgtcgaagtcatttttaatatctgaaaagccttcccaagaaagatgggtacacacaaggcagactgtgaagactaaaacaaatacctaactcttaaatgcccagctacagatgaacatttacaagcattgagaccagccaagaaaacttcaccaaacacagtaaataagacaccagagaccaatcctggagaaagagagatatgtgaccttttgttacgggatctttggggtgttgcttttctggcctgaaacctctgcctggtggcgcctttgcccaagttttgcttgggcgcactgggctcattcttcccaccctgcctggcaggctgtgctcagctcacgctaccagcctagatcccatgcctgccaagggtgagtcagcaatagagcaatgaggggtgggtgagtgagtgtggggtccggccactgctcagtcagacatgccagctgctgcagtggggcagacagctacaggtgctggctctctgcaaggcatagttgaaccaggcacactgcaagcagcttccctggctggccctggaagcacattggtgcccagaagctcagagacacaaggaactacagaaacccaaagagggagtcacagccctgactctgggagctcccaggtctgggatccctgaggggccacagctcttcttctcttctcctgcaacatggcaaacaagggacatgtttcagccctgtttgtgttagctcttttagttctgccattcagtggctcccaagttcttgtcctgcaacaggaggaaatgaggtaggcagacaagtggagggtaagcaagatgaaggggaattttattgagcaatataacagctcacagaagtcccacagagggtagctcctttctgcaggcagggtatcctgatgagtgttcagctccgagcacagaagagaccaaggagtgggaagctcctctccaggcaggtcatgccatcattttgtacctctcagcaaagagaaggccctggagtgggttgctgttctctacagctgatagtcctgacttctctgcaagtttctgaagctctcagcaaagaggaggccataaagtgggcagctcctctcaggttctggtcatactgacatctcccactctcagcagagaaggtaactactctctgcagctggtcatcccattgtctgctcacctctggctgagactttggcttttatgggcctcaaatgggaggaagtgtgcactgatttggctcatgggcaaccattggtgggcccagaaaaggcaccacaagttcccactctagtctgtgggactggcagcccaggccccagctttcaggccctctatggcccaaaggtggggcctcaccagggatgtacccccttccacccagcaatctgtccacctcctgctgtcattcatggtgcctgggcttggccctgactttcctccaagatcagagtgggcaccacactgagagcagggaaaagccaggcagcaggagcaggcacttctgatcctgagagggcaggggggccttcctgggaccccaagagtgcagggatgtctaagtctgcagccatgatttgggcagccacaactgcgcccagggttggggggtggggctcctgctggctccatggagctggaggttggagtctgcagccacagtttggctggctgcagcagtaccctgggagctcctgccccatcttgcaagggccagggctcctgcttgtccccagctcccagctgctccatggagaatgcagccctggccatgcctccttgctgcagctggcatgatggcaacagcaggcaatctggagcagccactgccattactttcagaaaattaaaaatagctattttgagaaagttcaatgaatttcaagatgatagagaaggaatccagaattctatcagatgattttaacagagactgaaattaaaaaaaaaagcagaaattctagagttgaaaaaatgcaattgacatactgaacaatgcatcatagtctcctaatagcagaattgatcaagcagaagaattagtgagttttgggatgggagcagtggctcatgtctgcaatcccagcactttgggaggccaaggcaggtggatcacgaggtcaagagatcaagaccatcctggctaacacggtgaaaccccgtctctactaaaaaacacaaaaaattagccagatgtagtggtgggtgcctgtagtcccagttactcgggaggctgaagcaggagaatcacttgaacccgggaggaggttgcagtgagccaagactgtgccagtgcactccagcctggtgacacagcaagactccatctcaaaaaaaaaaaaaaaaaaaaaattactgagcttgaagataggctgtttgaaaatacacaaccagaggagataaatgaaaaaaatgtattaaaaattgaagcatacctattaggcctagaaagtagcctccaaaggccaaatctaagagttatcgagctaaaagaagaagtagagaatggaaggaactttgtcttgtggtttgagtgccagcttagccacagtaaaatagaacatgtggtagatttctaagggttttgactctaatccctggttcacagctagcattgctggacctgcctggggtttaggggaatttgctatcctgaagagaaggacacaaacatgactggcttcactactttctataggattagaaagttaattcaaaaggataatttcagagaacttccaaaatctacgatatcaatatttaagtacaatagggttatagaacaccatgcagctgcaactgaaagtggaatacctcaacacatttaataatcaaactcccaaaggttgaaaataaaaaaaggatcataaatgcagcaagagaaaagaaataaataacatataagagagctacattacatctggcagcaggcttttcagtggaaaccttatgggcagggcaaagtggcatgacatatttaaagtgttgaaggaaaaaatcttttaccctacaatagtattactggtgaaaatatcctcaagcctaaaggagaaataaatactttcacagacaaacaaaagctgaggaatttcatcaacaccagacccatcctgcaagaaattctacagggagttcttcaatctaaaaggaaaggacattaatgagcaataagaaatcatcttaagatacaaaactcaccagtaatagtaagcacacagaaaaacacagaatattataacactgtaatttgagggtataaactcctattttatgtattaggtaatagaaaaactcaatgatgaaccaatcaaaaataataaaggattacatcttttcaagacatagtacaagaatacataaaaacataaaaagttaaaaggcagtgagataaagtgtagcatttctattagtttttttctcatttgtttgtttatgccatcaactttaagttgtcattagtttaaaataatagattataagatagtatttgcatgcttcatagtaacctcaaatcaaaatatacaacagatacacaaaacataaaaagcaataaattcatcacaccactaatgaaaattgccttcactaaaaggaagacaggaaggaagaaaagaagaaagagaaaatcataaaaaaaaaacagaaaaaaaatagcaggagtaagtccttatttatcaataataacattacatgtaaatggattaaactctccaataaaaaagacatggagtagaagaatagattttaaaaaacccacaatgatctgttgcctataaaaaacatacttcccctataaagataaacacagacagaaataagaaataaaaaaagatacttcatgccaatggaaaccaaaaaaaagagtaagagttgctatacttatatgagacaaagtagacttcaagatgaaaactgtaagaagaaacaaagaaagtgattatataatgataaagaggtcaattcagcaagaggatatagcaattgtaagtttatatgtaccaaacactggagcactgagatataaattgcaaatattcttagccctaaagagagagacagacctcaatacaataatagctggacacttcaacacctcacttttagtattggacagatcttccaggcagaaaatcaacaaagaaaactggaggactcacattatctgatttcaaattatattaacactacaaagctatagtaaccaaaatagcaaggtgctggcattaaaacagacacatagaccaatggaacataatagagaacccagaaacaaatccataaaactatagtgaactcattttcaagaaagttgccaagaatatacactggggaaaagacagtctcttcaataaatggtgctgagaaaactgtatctctacatgcagaagaataaaactagacccctatctctcaccatatacaaaaatctaagactagaaactataaaactactaaaagaaaacatcggggaaactctccagaacatgagtgtgggcaaagatttcttgagtagtaccctacaagcacaagaaaccaaagcaaaaaagaacaaatgagatcagatcaagttaaaaaatcttctgcacagcaaagaaactatccacaaagtgaagagacaaccacagaatgcgataaaatatttgcaaactacccccctgagaaaggattaataaccagaatatataagtagctcaaacaactctataggaaaaaatctaatcatctgatcaaaaagtgggcaaaagatctgaataaacatttctcaaaagaagacatacaaatgtcaatggcaaacaggaatatgaaaaggtgctgaacatcatcaatcatcagagaactgcaaatcaaaactataatgagataacatctcaccccagttaaaatggcttttatctaaaagacaagcaataacaaatgctaatgaggatgtggagaaaagggaacttttgtacactgttggtggggatgtaaattagtacaaccaccatgaaaaatagtttggagtttcctcaaacctcaaaatactaaaaataaggcggagcttgcagtgagccgagatagcaccactgcactccagcttgggggacagagcgagactccatctcaaaacaaacaaagaaacaaacaaacaaaaactaaaaatagaactaacatacaatccagcaatcccactgcaaggtatatacccaaaggaatggaaatcaggatgttaaagtgttaacttcactttatagtaggcagcattatttatagtaggcaagatttggaagcaacttcagtgtccatcatcaaatgagtggataaagaaaatgtagtacatatacacaatggagtactattcagtcataaaaatgaataagatcctgtcatttgcaacaacatggatggaactgggaggtcattatgttaagtgaaatgagtcagaaatagaaagaaatgagtcaggaatagaaagataaacttcacatgttctcacttatttatgagagctaaaaattaaatcaattgaattcgtggagatagagggtagaagaatagttaccagaagctgggaagggtagttggggacttagggggaagtgaggatagttaatgggtacaaaaaatagaaagaatgagtgaataagacctagtatttgatagcatgacagagtaactataatcaataataatgtacttgtccattttaaaataactacaagagtacacaatttgtttatgacaccaaggataaatgcttgagaaggcagatatcccatttactatgatgtggttattaggcattacatgcctatatcaaagtatctcatgtgccctatatataatcacacctactatgtactctctacaattaaaaataataatttttttgaacggcaggagcaaaatttcttatagcatctggatacactgcagctatagtaaccttgttgttttatcattatcagtggtgtcttttgctacccaattcaatattctatagctactcaactactctttgtctatgcttctattgtttcttctcttgacatgacaaatgcttctggaattaatttatgcttcttcctagctttttctgtctaataatgtcaccgtactactgctttttctctatcttttagcttctgtacttctcaaatattactgctatttatatgtggccattttctagagggtaacatagaccatcaaaggatctgattgaattgactagttaccatatgaagtggagaatgttagtactgtatgttctatacctctcatattgccctgccttgtagaccattgattattccagatgattgactgaatgagaggtgattcctgctccaataatccctggctctgcttgcagaaccacatggaactaaacacagtgatccatgcaccaggaacctcttagaaggaaactgaaaatgtcatgcacatagaggctctccagaaagagtattgtagtaagcagccatcttgtgtggcctgccctaaaacattcatttattagtgtctcttccatggacatctcttttcttacactgatcagtctttgtattcatgaagcaataccaaatgattaagattatacctttgaaattaaaaaaaaaaatctgatacttgacaatgcctctcatattcttttactttctgatttttcttagacgtttggtgattttgctttgttaggatggaattttagtcattttatcagtttccaaaaattcccccttgaaaattagattggagttacatttttataagttattcatggctaaattggcatcaaaatattgaatatttctaccaaggcaattatagtagagtaaaatccactgagccaacctcttgtaatccagaaattccaatatttccacaagaccaaattgaaacataatagaaaatatcaatagtaatatggctcatataataatattacagctatataataaatgtttcatggtatttcattatatcaaaatatttttagaatataagaagtgctaattactctatttaacatgatagctcagaaattagaaatatcaacattgttcaaataataagataataactattaagtatttaatttgtgccagggttccaagagcttaacttgcattggagcatttaatcctcagtgggagatttatcatccccattttgcaaatgaggaaacacttacagagagtttaagcaacttgcctaacataatacaactactaagtggtggaaccaggatttaaactccaggcagtttgatctagagaccatactcttaaccattattaagatcagtctatgaaatatgaaaaccatcaatttaatctcacagagtcacttctttgagacatatgtcaagttttaatatatattaagggcaactttgaaaagaaggcagtgttgatgagagtaaaaaagacaatgatatatatattatttacattgcccaaatgtttctatgatggttaaacaaagtatcagatacagccttttagcttgacaacgtatgttttgttttctttttctttttttcttttagctgactcttgctcctctcaggaagagaacatattttcaagtttatttgcctaggcatcaaatgtttaaatattttagtcaatttctaattaaaataattacttttaatcaacattttcttatatttctttctcatttttaatttcagagccagacaattatgcatttctttagtcaacaactagctgctaattatttactatgtgtcaagtcttataatgctgaagtgaagaaaagagatttaaagtcatggatgtggtttcctttggaccttaaattctagcacaaaatatgataaacattgtaatcaatgctatcatgtacaggtatgtggtgttatgtgaatatatgggaatacctaattcgtaaactgggtttagaaaattcttgcagaagaaagtggcatccaaacaaagaaccaagaacgaataaaaattattatagataaagtgaagcgggtctagtggaatgacaaaattactgagtgtcaagaggtggaaggacttggtgaataatttgaaaaggaaccatcggaggatgatggccacatttctggctccagccatcaggtaaatattaacattcctttaaatctgcatttttgttttaaatcgttttcatatttattatctttatttaatctgagaacaactttttgggagatagagaggtatgcattttctagctgaaaatacaaactgtttacataatttgcctaaagtctcagttgaagagggtaagggagggtagttagtggattgcacacagaatgaagttgttttcaccataatttctactcatttagaacatactttttattctgctgtctaaagagcaacatgtcttctttcagacaagattattatctggattcaaatcaatgatacatttttccctttgtcatctgatgtagacatttctaactggctctcctgacaggagcaatccatcatcatagctggtggaacaattttgatcaactatgtcaacacccctatcattaccaccaagtgcaaatgcacattaatattctatgtaatggccaagcagatgcagaaagacaatacatctcttcaaaaggctcctgcaggcctcttctttgttttctcaccctccctctttttttcaagctttgatcatatgttctaattagatctcaaggttcattttactataccacaagcttctgtatggccactggaatccttctaactccatttacctacactatccaattataaacttagatggaagttaaacagcctgtgagaactcagaaggatatctcattgaaatggtagaagagttcactgctgtatctcagtagcaggcaggcacctcaaactggttaaactgtgtgcaccacagtactggtgctatgaaggtttctttcacaatagttttgcattttttaggtgttcaagatatgtctttgtggtgtatgcatgtgtgtttctgtgtgtgtgcacgttgtgtgtctgtgtgtttcttttgctttttggatgggtgggaagttaataagtgtcatgaattattaaaaaggaacttgaccttatagtgattccaacagaaaggaacaaaatctggagatatcagagagtcccttgtgcatattccagggactatgcgggcaactatctctgatggttgcaagaggaaaaaagaaggatttcagcatagatgacaaattatcactcaaatgatgatagtctgtggttataggccttgcctcccacttggattttggtattacccactaaaagtgctcatcttggaagaggatgtggagcctcagatgccttctctgctttccctatatggtccaggaaagcctattccctgagacttttctcaacaatcttacctcccaagacagacaacactactaaatacactccctgaaggatgaaggcatcttgttcgaggaaaattacctagtgaccatcaagcaggccatccagaggcaaaactccttatctgaggaatttagaagtaatttgacttccctattatcaaaagcatgcatctggtaccaagctcttttcccaaaactttgtaagtaactagaatttctatagatctctggaatgtatgcatattgaaactcattgtgcaacccttgctgacatcaaggcaccaaaatatctataaatgtaatcattcctcatgacctacatggctaatacggttcaaaatacccttaagctcccactttaaagtccataaaaacccctaaggaaaatccaccgcttcacactcagtcctcccttgctgaggtgcctcgctgtactcttctgcagcatgctttctatctaataaaaccttccttttcaaacctatactgttgtcaataaattcttcttgccaacctgagagtcaaccactttctgatgctggggctctgacaccctgccgggcatctttttgactcatcctgggactttactgggatttctcccttcttttttctctctgcttccctcaacagtctggtactttactcttagaaaccaatgatctttggctgaggccactcttcagtgggatcctgaagccctagagaaggagtgtctgtctgtctctgcccttggggccgagaaactggccagggttcttttccatttttgaattaccagtgaaccagcttaagtactctttggcaattgagggtttctggctgagtgcactccttggtattatccaaaggccaagacaaaaaagcaaatttactattgcccccttccaagggtggcaagtccaccttcactttaacactgtaaaccgtgccttggaaatgagcagcagcaaaatcaactctgcacagacacaatctgctggttgtggaccccattttgaattgaactttgtcacagacatcacatcgcaagtcacggacaagttctccttcacattaggtttgagctgatcactcaaacaagggcaggcctagactgctcatccaggcaagggtaggccctctatccatggtaggcacccccagatagagtgagcaaagggaaaagggaggtcaaaatccctcgcaggcacttcaggaatcttatagtgccgtatctaaacccaacatgggttcaactcattcttcagttctatcctatttgcccttgggttgcattcttataaagtggtcccattttgacccacaaactctttaaacttttatattcagagaccccatatgttcaggtcttttgggctttatctgatacgtaaaattacataaaaattgcataatcttccaaagaacttcttctctacccgattctgatgtcttagatgatccttccatttgcctctcacactctcctcatcctgctcccactttacctacaccctttccatctgcttcatcccccaatcatcaccctctccccataaacagatactttatcctcctcatatacttgcacaggagttacataagccactagtacagagtcctcagaaaacctccaaaatgttttccttgtccataaggtggcaaatgaagatttgggaaaaattcgaattcatgcacatttccaatattggatcttttgcaaattccatcccagttgcgttcatttagccaggagcactctaagttaattcaagaatttcaggccttaactatttcctttgttttaacgtggcaagatatatttgtggtattaactagttgatgttcccgcgaagaaaaatcttgcctttagtttgagcttaggtggatgaaactcatgctcgtaatcctaatgataatatagccagggaagaagctgtccctgacacagaacccaactggcaacaccaggccaccaatgttggcccagacagaggcaggggcaggtgagattatataataacttgtttgttggaaggaatgaaaaagaccgtaagaaaacctgttaatttttctaaattatgagaagtcagttaggagccatctgagaatcctgcccttttacaagctagactgctggacactatgcaaaaatatgcaaatttagacccccaaagccctgcaggccaatccattctggctgtacactttctaagtcaggcatccaaagacgtcagacaaaaactccaaaaattagaggaagacccacaaactccttttcctactttattaaatgcagcctttccagttttcaataattggaaggaaatatcaaaaataaaaaaggtgcttggggcgcggtggctcatgcctgtaatcccagcactttgggaggccgaggcgggtggataacctgagtttgggagttcgagaccagcctggccaacatggagaaaccccgtctctactaaaaaatacaaaaattagccggtcatggtggcacatgcctgtaatcccagctactcaggaggctgaggcaggagaattgcttgaacccgggaggcagaggttgtagtgagctgaaattgtgccatagcattccagcctgggcaacaagagtgagacattgtctcaaaaaaaaaaagcgtaaattggaggagaaaaaatgccgtcgccaactaattacatggcgacagcactggcacattctttttcattaactaataaacccagggctcatccctatgctactaacagaatggggacctgttattgctgcagaaatccaggacactagagtagaaaaggttcctaacctccaggttacaagccaaccctggaagcctgtcctcactagaaataagagggtcatcggaagagcgagtgaccctctctccctcatgaggtggggcacctcttccttctgggctgtcacagctacagccttatcaatctacctaacaagggagtcctgcagaatggggacgagggcaatgccaaggacaagctcttctaactctattcctggattataatcaagcctctgaaattcatcctctagatgactgatggggccttgaggccatccagcccctatcttttccatctctatggataagtctagagtaaatctgattgtggctaaacaagagataatgttcttcatagatacaggggccagttattcatctttaaacatttactatggcccaatgtgccagtcctccatttttctcacaggtattgatggaaaaccccaaggaggctgttttacactgccactcccttgtaaaatggaaggctattcctttcctcattccttttagtcgtgccaagctgccttgttccattattaggccatgacttaacacaaaattacatgctaatttacaacgaagccctcaccttccagctgtattaactcacacttcactaaaagagcaactgcagtctacagaaactcaaactctaaaacaagtgccatttgaagttggaatacttctcttcctggtcaatcaatatcagctgctcttgtattcattcagcttcagattcccaataagttcttcagactccctgatgcctcttgaaaccagaagcatgaaaagagttacagcccctaataacaaaatttttaacccatggattattgcacccatgcaactgaccttgcaactctcattttagctgtaaaggaatcagatggctcctatcagctagcacaaaccttagaattattaatgaagctgttattctgattcatcctattgtcccaaacacttataccctttttggacagactctctccaccacagcttagtttactgtacttgatcttaaggatgactttttctgcattcctgtacaatcagatagccaatttttgtttgcttttgaatggcaaataacttaacttgaacaattctgccccagggaatggcaaaacacttaacttgaacaattctgccccagggaatcagagatagcctccaccttttcggacaggccctagctagaaacctgtctaccctgcagcttctccaagacagcaatctactcccttatgtggatgaccctactaatctgtagtcctaacaaggctgttttagacaaaaatacagtgttagtatcaaacaaacttgctgactgtggatacaaagtatctccttctaaggtacaaatattcacagaaagcgttcacttttggggccttattttaacccttggtacaaagagcctctctagcgctcctgaagatcttatcttaaacatgacaactccaggaactaaacaacagcttctgtcctttttgggtatggctgtgttttacagaatatgtattccttcctttggattaaaaggaaaacctttatatgaagccctccagggaagtgaggaacaacctctatcgtggactaataatgtgaagcatgctctaaacactttaaaaacaggctgtaatctcagtcccagccttagccctacctgatctgactaagcctttctttttttacgtacacaaatgaagggggatagttttgagagtgagcctaagatctatggccctctaagcaccccacagcatatttttcaaaagctttagacctagtatcctaggaatccctccccacctcccagcttaagagccttagcagtggtagccctcttagtctaagaaaccttaaaaatatattaaccctcctgggatcttatggctttgcttcactgctaattaccccctagctaaaaaaggagtctgtgcgttcatcaataaaacatgttccacttctcttttctgtacaggaatgcggaaaaagagaagtgaaaactaatgtccaaaaaaattttcaaacaagccacatggctatacacactttcctaaagtaaccactactgggccaaaacctctactgattggtttctaaaaatcacatggcttctcctattacttggacctttattccttgttactcttcttttaatctttggtctctgcctttttaatgctctcattaagtttatatcatccaggttacgattccacctacagatgactatgcaatcccaatatcggcctgcaacagcaacttccatttacatggggcctcttaatggaatcgtttcttctccccatgaacaagtttttcatgatcctcattcccttcatgacaacagagagaaaaggaaaaatacaacttatccactcactatcccctttcagcaggaagtaaccagacagacctggggcccctcttcactgtgctattttctgtttcttgagactgtaataggcagcaggtagacatgagcatgggggaacacaaagggtcaaagatttgaccaagatattttcaggaagaaaataaggagaggaaagatcacctggagactatcaagcaggccatccagaggcaaaacttcttatctgaggaatttagaagtaattcaacctccctattatcaaaagtacataacttcaccctgcactcttcaactactcagtgattcccacacctcagtctacttcaaaccctagatacctagctccagattctttagagaagaggatttgaggtttcctctcatctcctcctgtggctatcttaagattattaaacactttctctgctgcaatctccagtgcctcactatattgactattacataactgactgcaaagcatgtctgtatttgtgtaaaatattatcagaattgtgggaaaatagacaagttctatgatagagtctatttctaacccatgttgactccaagtctctatattgggcccacctgcaaaatcagagtgtaaacgaaagagttgagctgcaattagaaaccttaatgaaaagcaacttttcaggctttgcttttttccttggctattgttggggcttaggaactgataccccaaaatacatgcttcgatatgcagaactgaagaaacctcaaggtctctctgacctctcacttccccattgtctctcccaaagcacaggatgagttgttgcctgaagtccctttatctgcctaaagtactgatccaccaggagaacaactgtttattcttctccttactattatctcattatctattacagaaaagaaggccaaaaatgtaaccacacttgaatagaccctttcacaagataatgtctgtctctcaggctcattcaaattccatggagaaatatcttaaagttaatcatctctgccctccaatccattcattctccctagttgtcatttattgcctgtcaacagaattcctcttttcctccctcctataacctgttttgccaagacctaagttcccattctttctgtacccacaaaagatgatatataagcttctaaaccctatttgggggataggtaatcactccgtgattctcactgtgtacacattaataaatctgtatgccctttctccaattaatttgccatttgtcagttgatttttcagtaaaccttcagaggacaaaagggaagttttccctttggtccctacactattaattcctatgtcttacctactcaaatttcttcaagctttaaacagagtcaaagcaggaaaaagcagaacaggtaaatgacaggaagtttctacttacagaacacttgtaaaagtgtatgcaatgtcctataaaccatcatttttttcttaatcgtatctttataattggatttaattatattttcaaaattttaaggatagctcatatatattgaaattaatctctcacacttccatattcagaaactctagatctgacatagagatcatttcaccttcctgattaatataggcagtacgtggtgcacaatgaagacagactttgcggccaagacaaaagtacctgagtcttcaccctgttggaacagtgtatatcagagtgactttgggagagtaattttaagttatttgttttctttcctatccataaaatggttttccaagtcccttcctcaagggttgctttaaggtaaaatgagagaatgtatgtgaagttcctgtcaggtagtgatctctcaacaaaacttccttccctcaggctagatttcattattagcagctcaagggtataacttttacctttacttgatcttctcagcttctgttgggaattttattttaaactgaagggcattttctctttgcttcacttcttaagtaaattcagtacatttaaattatttcccttgatcttcctacctcatcttcttttacagagaaactaatttgaccttccctccaagctacttgtcacttgtctctttttctagtccttatgttatattcctattcttagccaatgatttcaaatgcaattctttaagtaatatttttcaaattgcctttaattaataaaatatgttgtattaaacacattgtattacaattgtatttaattaatataacgtgttttgcttgtctttctgttagtatgaacttatggttgaaggcattctcaggggttaacaagaattctggacagaaatatggctataagtaagtattaatcaggctgcactttgacccacttccttgtaactgaaagtcactagatcctgaatatttgtatccccattcccactgttcttatagatagaatctctgacatcagaatcataaggcttttctttaagaattgcttaaagatgttcttcggatccccaattccagtgaaacagctgatgacaaccattttgaagacccccacagaggaacagaatcaacatgagatggtttcttcctctccccatcctatgacttccccctgtactcttccaccaattaacaatctccacactttgacccactccaaaacccttaaaaacccagccccaaactacctggggagatggatttgaggttccttcccatcttctccttcgatggcccaaccattaaacctctttctctgctgtaacctcgtgtctcagcatattgactttttgcacatattgggcaaaaaaaacctattatggttacttgattgtgataacatcaaaagtacactgaatttggagtcaggagacctgaattctaatcctagctttgacattaattagctacgtggatataggtaactcacttcacttctgaaggcctcaaagccctccaaggattttgagataggcaatttttccctcaacttagcattatcatttcatggttttatgatgcaacttttacagcatcacaatgttccattaataaaattatattggtttttccatatttttaaatctaaaccttcaaataactatttgttttcatttttttctggtgtgttgcctttgtctttcccctttattctttcatgttttgcttacctaaggaaaagcttacaagaaggagctgtgtcaacagtagttggtatggatccacactaacttttatttggggttttaactaagagaacttaatgtatgacttattgtaaaattataaaaatcaaatcaagttttataacaacagccatagaatggtctttttttttgcaaaaccaaagatacatatacataaatgaatatgatttatgtagaaaatgatattaaaggatacatacaaaattattgagaagcaattagccctggaagagaaaaatctgagctagaggggtagtgaggctaaaatttgtactataaactgtcctatattatttaatttggtataacaagagtgtattattcttataataggaatattactttaaacatttttattaactgatatttattttatgtatataaggttttttttcaatgtggctttgtaatctaccacatactggacttaaagttataaacaggagagatgactgaagtggaggaaggttcattagcctcacacaggaaatgccttgaagtagaccgtgggtgaatctgtttaagctgtgacccaagcagaaatactttcttctcaaagtgatttgaaactattattctcattgaatctatgataagaaaactaattatgataacagacatacggttggaagaggaaacacaggtagagctgtctttacattagagaaagaactgagagagctaggcaaaagccatcattgggggtaacagaacacagcagggggaagcattctgcagagcatattggaacaaagcaagtctctccaaaaaaatctaaagaaaatattttcagaaagtgcacaaggcaaagactaatggctccctgcagatattcataaggatataagaaagaagaggctttccaagaaaatataacatatttcaacaacaacaaaagactgggctagatttgagacacactaagagtcattaacaactagaagttcttatcataacactatctatactgtttacaattgtgtcactttatgcttatataaagtataaagagaccactttacagaatatgggttcagtcattgtcagggtatcagagtatcttttgttttcctttattatattgtaaggacaacataaagtaacccaaagagaaaggagagaacagcttaacctctctaaacactgcacattttggaagtctaatcccctctccctgtcccaaatcctctcattatatctaagcccagtggaagtatgctggtcctcacaggctggcagttttctcaacctgcaattagagtgtttagctctttttgccagctacagctttagtcatcaattccaggaaaccctgacaccaattcactgaatatctaaacatacattacctacttgatcatctatattcccagatgcaatgaacatattttcttgttatctttttaagtcttctaagttatattgtgcacaatttaaatacacttgccttagtttctgagacagccgtttctcggttttctatctttcccagttatttcttgccaatctcctttgttagctcctcctcttcaacatgaattctaaatgtgtttgcttctatatcatattttctgctctaatataccctgtctatatgttattacatcctaagaaaaaaacaattcctatcataggtcaaacttatgctctaaattccaaaatcatatacccaatggctgatataatataactatgaaatgagcaaattcaatatctaaaggccactaaattggaatgagacttctacccgaaacagattcctccaagtcttccttaaatccataagttactttcacacacacacaatgccccaaaacaagaaaccccaaagccacatttgtttcccaatttccttcaatcccacattcattcccagcaatttcagtcaattttacctctaaaatatgttttgaatttgtttacctcttctgcaattctctagtgcattactaatataaatacaatgcaagcaacatatgtaatttttaacttgctagtagtcatattaaaaataatttgtgtaagtcaaagtgataatattttggatatatttggttaaaatatattattgacattaatttgacatgtaaaatataaatatatttgagatattttatatcatttttccttgataaatgttcaaaatttgttgtgtgtcgtacatttacatggcacatctcatttcacatagccgaagttcaagtgcttgataagtcacatgtaactactatatcggacagtgcagctctagtatatggcaacattacctgttgcctggagaaatacaacagactcatatctggtatcctcacatctattcttgcccatcctccatttccaataacatacttcctatggattggtgagaactgaaaacgacataatcctctgtcccacagggacaggaactgggcagaccttcctgctcctgtgttaataatactaagagcaagcaaaacaatacttagctgctttctccaggaaatacctgctcctagaagagaaaactgaaacagttaaactgaccaattatcaagactagtaagctcattaagatttactaccaaaccttcaattcattttgtccactcatccaaatctacttatcaccacaatccaaccagttctctctcttgcaagatacactttaaaatcactcagcacaggctttaaaatgcttctctaattttcccaccttgagttatccacatattggccaacaaacctattatggttacttggttgtgataacaccaaaagtacactgaatttggagtcaggagacctgaattctaatcccagctttgacattaattagctacatggatgtaggtaactcacttcaaggtggtattctcctttatcacactaagtcttagtggtagtactgcttgattaacatacttttggaaagtcaacattcaacaaaatcaagaggaaacttcttaaaatgcaaattggatcatgcccctcccctgttaaagctattacaatagttatcaatgctttggaacaaaattcaaacagcctagcatgtatgaaaatgtcaaaataacttattgtctgtcttcctttctaaactcttaccactctactcctccattcagtaacttttagaaacagtgcctccttcctgttctttaggtataacaagcaattccaaattttagcatctttgcaattactcttctctgcctgaaacattccttcagtgttttaaaattgctgccacactcttatccttactaactaactaaaattcgatctcctcagagtgtaaaagactgctttgactgaaagtgatttatctcttaggccaattttcttttcatcatatcatcctgcttccttcctatcactcatcataactactttatccatatctttctttactccctgtctctttctacaaaaatgtaaactccatgaaaatggaaatcttatctgtcttatctatctccatatggctaagtgttcgatagatttattggcccgtagtacgtactcaataaaacaacaaaataagtgaataaaaagacaataaatggataaaagaaaaagaaagaaaggaaggagggagagagggagggagggaggaaaagaagggaaaagagagagaggaagggggggagagaaagagagggaggaaggaaggaaggaaggaaagaaggaaggaaggaaagaaggaaggaaggaaagaaggaaggaaggaaggggctctgaaaacgtgccataagtaaggcaagtgtgataatcccctcccttgtatattagaacaccatgtaacaatgcatcaaagggagaaacccaggactccagagctactataacacgtagctgagaccaggatcaaggtcttctgatttctaatcctgtgctcaccacagcctaacacactgtctttcagccttctctgattgatgtggttcttttgaagctaaatgtaaggcttcagatttaataaataaggcatttgaaggagaaaattattctctatgcattaattggtgagttcatatgtttttgcatttacatctcctacttgcattttgattagcaattacttctgtcaatttaacaccaacattttccgtaatcagagacatgttataccttggaacagactcaatgagtccctgaaactggtgagacagcacttcaatcccttcaccttggctgctctagtagtgaacatgcctgactaccagtctgatttcctaaatctcctctgagattttagatggttagaaatacttttgacatatgcttggcttcagctcattgcaaatacaaaaacgcttgttccaaatacaagcctcatttttttctattattattgttagtatcattattagtattacctgtatcactcttctgaagtcacttttaaagagattccatatcctgagaaagagaaatccctgaaaattacatttgatcagtaaatttagtgaggcataaatggtataattagtatttgattgaaatttctatcctcctttagtagtaaatatattgtaagagattgtttgtcatctattcgataatttcttatcccttctctcttgcttaaagaatctcaatttttaaatattaggcggcttaaggcaggtgactgaggaactgaaagggatgactatgctgccatcccaaccatacaggatgaattttgaacactctatactaagcctagtaattccgttcctctcgccatttagcaaggtcatgtttctttgacatgcatgaagactcttaaaaattttaactctgcttatgtttctactcctcctccacctgtacactggcgtccaggtacccttcacctaattgtagttctttctcctgtcttgacctccgtatccttgcaaatgtgctgagccataattccaactatccaactcttgactcattcatcaaagcccaactggaatgtcaacaaatggctacatctttgcataattttctccatggcagaatttaaagtctctgtattttaaaacatgattccatgtgcttccattatattacttatcacaatgtattcctgtcatttgcttatgtacctctttattctatgagaatgccaattacttgatagcaaagatcatgactcaaccatgtttgcgttcttaaaacctagcacagtgattaaaagatagaaaatactcagccatttttcaagtgattgactgtatcctgtacaggatagaaaattacttctcaatatgatgtcttcttcattgtatgtttcccatgttcatgataatctcacattccacataccctcctcaagacttttttctgttttatactttctagctattattatttcaaagggttttatttagaagagggtatcaaaaagattatgtatagcttaatatcttaaattggcagcagctatatttataaaagacattaaagtatggcaatttaatattctattcactaaaatatttgactaattatacctctaaatctttacctgtcattaaacaaatgattatctgaagtgatttaagactctttggattggtttattttactaattaataagcaaaagactgtttaaattgacttatggtcacataattgttaaaaaataactgttattgttgaaaatgatgatgatgatgatgataataatgatgatgatgactatgataataagagcacgatgacagaagtgggtcactttgtattttctaaagatggatacaatattattcctcatctcacatgctccttttgacctttacactctttccattgaaagatggggttcgtgtctcctctcctttgaatccgggaggcttttaacttgcttgtaaccaagactatgacagaagtgacactctatgatttccaaagttaggatacaaaaggcaatatggcgtgtgctttgttaactgtaacttattcttggatccctgaaatgtcacacaaaaagcccgactatccagtggctaccatgctgtgagaaagccaagccccataagaggctaaatgtcaccttcctcagtcttctactccttagtccagatgtcagacatgcacaagaaggagtctgtaccctttctaaattcctgacccatagaatgtgagagcatgatacattgatggttgttttataccattatgtgtggagtaatttgttatgcagcaataataactggaacaaagagtgtgacaaggaatgtttatgtgttcatcagtcctatttcttcttaggcacagaggaagagggcattcaccagctcctttgcagtttattcaggtccttttgatggattttgtccaatgagatgtagaggaaagtacattgcattgaggtctggccaccaaacttcctattcaattatctactctctctcccatttctgcagtgacatggaggccagcttatacagatggcaaaatcacaagattgaaagatactgaatcattgagtcactaccttgtagagacctattcaggaaaacaggctggcatcagaccaacgtaaggttgataaataaaccatcattgcaataagctactgagatctgggggttgtattacagcaagtagtatttgttattctaactactacaaaaactaatactcactaagcagttacaatgccctagaaattttactaaatggcttgcatacattaacccttttaaactctgatgaaccatccttacgtaggtatctttgttatccccattttacaaatgcaaatctgaagttaaaagactacatgacttacatagggttacaaagatattccaaagaatgggaatttccttgaagacggaggcaaacctaaaataagtttgtactctaagagttaaataagcaaaatccactggaagagattagctatttgtaaatgcattgtcaatgtgagtttttggtaaatgggagtcgtgaatttaatcccaaaccattaattttagagacaaaagaagatatataaaaatccctggttttattttaattttatattttttagtaaacagaccactatggaattgttaaaatgtattttacagccatttttaaggttacaaataatttttgttatgggatctttctatattttatgactttaattaaatttctgatttctgttccaaacattgcaatataagacagtataaaacacactttaatcattaaatttatagataattttgtgactttttagagcttataacaccaagggactgataatagaggataatgtgcataaaatacactccggcacattccacaaactctatccttaggatctttttttcccataacccagccactaatacatacactaagaaagtctcatccgggctgttctacaattgccatcatctttaaagagtaatcttgtcacctgaactaggtgaaatgaagaacttttaaaacaaccacacggatccgactttgcagaagcttctacgaagacaaatagcatcaaacagacatgtactgtgcattcataattacattagtggccacaaaatacaatgcttagtacacatccttggaactcttaaaaccatcttaaataagagatcaagcaaatttaattctttgtgaaaatatatctcaaggtagtttctactgtccttaatttttgtagtataaaatttaacaaagtaacatcgcatgttcttgtccttaattccttggggtctaatgattacattttgaacaaatgtccaatttggaaaccaaatcaaccactttatttaatgcagaacactataacattttttgggggggggggcagggtctcactttgtcacccaggctgcagtgcagtggcagaaactgtagcctcgatcccccagggtcaagccatcctcctgcctcagccccacaagtagatgggagtataggcatgcaccaccatgcccggataatttttctgttttttacagagacgggggtttcaccatgttgcccaggcttgtctcaaactcctgagctcaaccattccacctgcctcagccttccaaagtgctgggattatagatataagccactgtacccagacagactttgttttaaaggtctgaatcttccttatttcatatagcctacattcttttgtgggaacaaagaaaacagataaataaatgaataaatatgtaatacgtcaatcatcatgacaaacgctacgcaagcataaaattgagcaagaagatgaagagtagctgcggtgggagatgctatttttagatgtggctctatataggatctgtgtagggtgttggataaggcaaggatgaagctgacctgaagaggcctcctgtgcagagtcttggaagagagcatcacagttagagagcacagtaagtggacagatgccagaagcatgggcctgtctgaggaattaggggaacagccagcaggccaatgtgtctgaatctcagggagcagggaagagtagtagtaggataagtgctctttaacaaattgcccaaaaagtgattcttgagatttatgtgtttataactgttccatcaacaaagggaagtctatggagtctaaaggctcccatggtataaaaacattgagctgttgtattctcctatggtaagagaaaatgttcttcaggcattcaggtgcctgaagaccctgaatctcttgctgtgactttccctaccagtataggacctcaagtgcctctattcacttagagaacttttgctatcagactccagaatatttttcccgttgaaactccattatttagtttacagatactggagttataaaattcccagtctccctccattagctacatcaaagtctgttttctaaaattcatcattttataagttgtattcccatattattttctccagaaggctgattcaactctccaaaagttgtttttgaaatgtagatatgcagagaaactttatgtttgaagaggttagcattccttaagagtttttaggataaaaacaagtttttgtaccaaaataataaaacttactagattgaatacttaatataaatctaacttatttaatacttatacaagtttataatagtatgacatttaataattcacttaacaaaaagcaaaccaaaaactctaagattctgcaagtaaccgtcttccccatattacccttccattcacaatgttagccatttcccctgaacacctggagatgttttcaaagggagatgcttggctccttatattcagctactttgagtcaaaagctctgagctgcacttgtgtagagctctctgagtgcaggactagactgcatcaaagtcctattggaccatggactcccctgccagtccagtggtgttgaccctttggtgaaagagcacttcccagaacgacttcaagctgaacatctttctctcagaatgagcaactgagatcactaactagcgcggcttttgtagcttaacacgtttcctgaatatctttttcttactctagtcacctctgctcccttagtcaaaagtttcttcaaatgggatacacaagaggagggccattaaatgtgctgagagcataagacttcttgctgaccagtgccagcaggcgttccaaggtttccctaccttatactctgttttcagaagaagcagcaagagtactgttacagacttctttccactaaggtttgatttaaatttgcatataaaactaaggttactttgctattggccttttacgaagttcccttaggaatccccctggtaggtggtttctttacaaactggtcctgacactagaaaagagtcatattacttccagaagggacaaagtgttttaactggcattccatgagtcctgtgaggttgaagagcagagtaacttagatgaacttaggaaatctgcctaacactgaaaaatgaaaagctatgaagtctttgtacattaaataaattggaaatggtgcctgaataaattctccacagtcaacaaagtatcagaaaagcatgaaggggagaagcgcacatttgatagccgttaggactatggagagaaagtgttccctggggttagaaaaactggcttgacagggaactatgatcattagtgccaagcaccgggaactgtcgccctgtgggtggagacaatgcaccacagggcctcaagcagtaccatcaggacccagaaactagtgagcttaccaatttattctccaaattgggcacttaaaaggcagtataatccagtactgtcctgtgcaagccaagccatacatatatatactcatcctgtcactatattttaaactcacttagcatatacttattttatgtaaactcatttgtaatcccaataatcttcagacacaattaatactacactgcccccaacccccttatccacaggggttatgttctaatacctccagtgaatgccagaaacctcggatagtaatgaatctgattgccatcagtccgaacacatttccatttctgtcttccacccacaaatttaatgccttttccatcttaactaagcacttatcataccctgtggctgtgacttttgagtctgaagagtgatagcaaaactaataccagtttctttttccttctttacaaccctacagatagaagattcattcttactgtagatcttagtaaccttggcatatgattttttttctttccttaataagtcaagaactttcaccttttcacttaaaggaagcactttacagcttctttggcatatcaggattgcctgcatcactacgtgcactttggggtcatcatgaagtaaaataagggttacttgaacacaagaactgcaatactatatgactaatgggaggggagcacagacaacatggatctgatggacaaagggatgatttacatcccaggcaggacagaatggaacagcatgaggtttcatcacactactcagaagagtgcacgatttaaaacttataaattgtttaactctggaatttcttatttaatattatcagacagtggttgaccacagataagtgaaaccatgaaaatcaaaaccatgaataaggggatgtctacttctctataacatgaaacaacaacaacaaaatgacatgacagaatacagctgatgaatttcaacattctataaaccttaaaaattgagtttcaaaacataccataatcaaaggcgaggctaaaatttaattttacgtgttgaacaaataatgcaaaaatatcaaaaggaatgtaaaaactcccttgcaacctttggagaagggtgggttctggtaattaaacaactttatttgaaaagcatcagggcatgaatataaaatttggaaattaaaacaaaaaaacaagagtttgatccagaaaagaaagggtgagaaaaagagtacctggatgaatggcaagccatgagggtgaaaagaagagtagaggagggtggagagtacagcctgggaccctagactgtgaatagaaagggttagcagaagtcattctaggtggtcgtgtagctccaggaacctcgaagaaaagacaattctaatattcaaatatttgggatgattagatgtataaaggaaaactaataaaaaggtgagtggattcttggaaaagccaggcaggattttcgtaaaggctaaaacaaaatctctaaggcaaggttagtaaactttttctgtaaagggtcaggtagtaaatattttaagctttgtgagccattatagtctcctcataactcctcaaccttgccattgtagcacagagtcatagatataaaccaatggctgagtcacgtttcaatatgatttatggacagtaaaattagaattttataccattttcatgagtcacaatatcatattcttcttttgaattttttcaaccatttaaaaacattaaaaccattcttaggccacaggccatacaaaacatatagtggatcaaacgtgacccaaaggccaaaatatgccacctgctgatctaaaatagtaaataatgattcacatatatgagaaataaaaaataaaagagaacctccatacattagaaatgtttggcaaacagtcacttataaagtagaaaggtattattaattttataatatttgagatatcagcatttttaatagtccatgcaagtttttctaattagccctaatttgtaatttggtatgattttatctatttaaaattagctattttctgaggtgttggctatggagttgattattttttaatgaactttattaatatctaatttacatgcaactttaaatgcagtttgatgagttttggcaaacgtatcctccaatgtaaccacctcaaatgatcggttttcataaaagagtctgctgagaatttaagacagtgataaatcaatctgtaagtcaatctgggaataactgacatcttaatattgaatctccaacttcaggaatatgatcaatcccttcagatatttaggtgtttttaatttttttaatgttgtattataattttcagagtatagatattatatttgttttgttaaaattattaccgcttattttataattttggatgctgtgatatagtctactttataaataatattttctaattgttagttgctactacattgaaatacatattttgagtttcattgtatcattgtatttctctattgtccatgtcttatttaatttgcattttttttccttctttttggagatggaattttgctctgtcacccagtctggagtgcaatggcatgatctcagctcactgcaacctctgcctcccaggttcaagcaattctcctgcctcaacctcctgagaaactgggactacaggcacgcaccatcatgcccagctaattttttgtattttagtagagatgaggcttcatcatgttggccaggctgttcttgaactcctgagctcaggcaatccgcccaccttggcctcccaaacaggcgtgagccactgaacttggccctaatttgcatttgaagcatggacagtctcatttttttcatcatcttgggaaacactgttcagtcctttacttttacatacaatgatacttaaaagtagaaattcagtagtgttcttccattttcccctgcagggaagaaactgatgacatcatgtaaagtaaaaatataaatggtaacatgtacagctgagacttgaactcaggtcttctgattttacacaatattctttcattattggaccatttccaaacttaattccagagaattgtaattggataagataacattctacattggttagtgactatctgaaactgtaaaagtctttccctttagcagtttgagtatgaaacttcaaatagccagaagctcagcctggaagacacataaagaaaagatgtctacaaggccaccaagaaaaaaaaaatgttaaggaagaaaatgacagaaatttatagaagttgtgacactgcaggtaatctcaattgagaaagttatatttaattccaggaaaagccataaatctgttcattcctgtaggtgaaatagaatcagacccaaagattggattgttatataagctgatattttatattggactgtgtcccaattctagaagccatgtaaatgattcatgtaaaaacaattaatgtaaactgggccatgtaaatttatcttatttttctttgtttcctcaaaaattaaccttcatcaagtcagatatgcaaaatatgttcctattccctgatatatagagttagaaaactgacacagaaaatgcaaacttgagttatggacctgaaaatctacacacttggctttggaaagtatctctatatttttgaagcgcctttgataaggcacatatgaaaattcacaaacaaaacatgtgaaatctacattctgaatgcccgttataggaaaaattttacctgaatcttgtttctttttgtgaggatacttcactgcgggccacttatactaccctctctctcaattcaattatgtactcttttaaaatttcctccatttgtggttaaatgtcttttaccaaaaaaagatgaacattgagagttcagttctcatttatgttttaaggggtctataaaaattatgtgcagaattataatactaccttaaattaatataggttcaaaagcataatttgcatttaacagtctatcatttagatacctgatgttaataagcataagtatcctcttatttaaacattgccttataaaagaagagatttcttgatttaggactttgcccttcatgttgctctacaagcatgcttatgtagttaatattcgtcaagatatgcaaaaatattaattagcttcagtaggtctagtaagtactaactctatgtggtaataatagtagtagtagctatcttcttattatagcctattgtttattaagcatttcatttctattaactcatgtaagcataataatcttttgaagtaggtttaataccatgtctatcttacaaaggatgaaattgaggctaagtaagatttgtttcttgctttagttttaaccattatattatgcactcttaatagttgtataatttacacatgtatattaaatatcaaacagatcaaaatatttaatactgcttattctctgagtgtgctaagtatgatagtctataacctcacttgtctacacactgagtccagtggaaatagcaatactaaatgtcacagtatttagtgacattctaaatatcttagaattttaaacaactgctagcataattattgatcaaaacaaatagtaaagacataatcatatttttataaaaccctataaaatgccaagttctgatcttgagttagtattttattgtttcaaaggcactgaagagtattcataaaaatttagacataaaatgggattctgatacacttacaaatatcctcaatagcatagcctatccctccctgagcttgtataattacacatttattgctttaatgttgacactttttagataccttgaagaaaggatcaaatactttgcagttctaaggccagaatattggccaacattaaatttgaccttgtaaaaagaagattataccagatcaagtttattctcttctgtgaaaaagggacagtctttaagaaaaaaacggatagattttcatttacttgcacctaagtgagaatttatttttatgctataacccagttagcgattaagtccataagtttatggatcattttccaaggaatccctgtagaagtcgtgtagaggttcccctagaggctgcttagggaactgggggtatagagatagagacgatgaccctctgggtattcctccctggtttcaagtacagcagctctgattttatttgctttatctttttgaccataaagtgtacttaaagaaataatatatctgccttaaaactcagaaaacactctttcaaaccatgtacttagagacatgttctcagttgcatggaacatcagatactaaaggttcttaacactaatgctcttaactgaatctctctagcagtgattacagtcagataaaggaccaatataatttaatgttttattagttatttagttgaagaagctaagactctacatttcatgtttctgattgatactaacttgataaattcaacaaccaaaccagaaaacaatctgataaatcatatgaagaatcatatacagtgtaataggattaggacttaaaaacaagaacagaacaaatcaaaataaaggatgcatacataggcatacaagataaaaaaaaggaaaaggaagtcaacctctatccaataaatataatgtttaaatggaaaaaaatataggctaatagcagttggctatattggtagaaataacataagaacaagtcttctaatttatttgacattggacaggcactaatttgaatgtattcttgatagtctcttttgagaagtttgttgaaaattaaataaagactagtgaagaacacaaaatactaaatttttcttatgagaaaaagttaacagaaatggaagtatttatcttgaaaaagagatgactatgggagaaaattactgctctcaaaggctattaataattacaataaattgttctcctgccctacagaggaccactgtatatgaggaatatgtaaaaataatggcaagataatttgatttgctataagtaagctatcttgataatgaggaaatgtaaaaatactggaacatctaactgggagaagctataagatgtttttttccatccctagatagctttagtaagaagaaaaatgcattccgtaccctggttcccctgtgctatctcactggtttatattctcaaatatccactcaggaatagtgaaaatggagaggtttcactctggcaagactatatcctgaagttcatgtgccttctttacacttttaatgtttcttttatggattcatctacctctcagctttgggttattactagtccactaatccacagaggtaaggcctaaaaattttgcaacaagaaaattggtaaagtttcttgctgcccagacatagtcattggtacagggccacattttctaatcacttagaaatagttgtaggttgctcacaagtatttatcctgaggtttctctttgatatggtaattggtttgctttcaggttttcccaagcctcagtgtactagattctttgtcttgacacctttagactttgtcttacaagctcttccacagcatcctgctgccctgccagactccgtaatatttattggcccttttctttacaaggtccacaaatgacttatggactgctcagtatagccagtgacattcaggcctatcagatattaatactactgatgctccactcatatattctcagcacttctatatccatcttacagacttactaacagttaagtccagaggcttaaaaattgaattctattcatacttaaaaattatattcaccagtcccactgaatcttcctacagcaagcacctgctaccctgcctgagaattactttctttggccacaaaagcttgattggccctgaacatgaggttcaggtgacacctctgagggtagcttttcacccaggatgaataggtggctaaatatccagtttgttcatgtcaggtaagataattctgaagtgctgaggtgcattctgcagtactacccagagtttaacagcaggatcaagccccaagccccagttgcctgcagtgacccataattacaccttcttggttttcttcccctctctgcctcactttgtctcactttctcttaaatagactattgataacacaaatccttacttcagagtctgtcttcaggtgaatccacttaaggtatctccatatctttacatatgcattttccaaagaatgtgcattttttggtaacatttaaaagaacattttacattaataattgagggaaaacaatcctggtttctgtatatacagtgtgcctgcaacaaattgtgctctcacgcctgggaaggtggaatatatgtccccaaacagacaactcccagactgggacccttgaagtgtttgttgttgccagcaactccaagtgagatttcttgcagaacactctgtgattttatgatctaggatgagagggtttggccataaaataccacgttttcctatcaattccactacagtgataagaaagattctttcctttttgttcaacaaaaataaaaaagcaaattactttatgtatttttctttggcttctgatcatgctaagagacacctcaacaaatcctgcacccaacaaatcctatcttttctgcacacgcagcagtaaaatgcactcatttgtgtaagttataaccaaatacataagtaaaagtgttgtttgtgacagtagatctgactttggggatacatatgaacttctaaagttttaatagatttcagcattgacattacagcatagaaataaagcatttcttgcagtcatcccaggcattccagatggtgaagaacattgcaataattcaatggaaggaaaagcaaacttacccgaatcatcatgactgaacatctgatatcatgaattgtatcatagatcttctttgagatgtccacaaattgattatcatccaacacattcaatgagcttttgcttaaggcttccaaggcaacattcacttgtgttacaaattcaggaattactgttaaaataaagaataaggagaagattgtcctctttgtatttttggatttatacagtagtttccaggaaatgtagaatttggttttaaacaaatatttgattaatagatctttaattgtattttttaaatatagagatacacaaattttagcaggattatcttgaatctctgaaaagtaaaacgaatcaaagacaattaaaggcattttttttttctaaaccccaggcttctggagagaaaggcattattatataaatgttttaaaagattatctttctcctttatatcatctttgtttttacaaaaccttgggaccatacaatcatttctcatcctattcaatataaaccacaagacattacaaaaaggaattggtgtgtaaaacagttggaattgtaaacacaaagatatttaaagaaagaaagcaattgagttgctaaacagaagaaaatttagctaaaagtagtaattctgccttatagaaataataaaaatattgtaaacttccttttagtaagatgttttctctataataaaaaaaattagtgaaaaggaattggcattctcatatgaaaactatctttaaaataacaaaacactgactgactatagggatgcttctatcagtaagccaatccatggattatctttttaaattaaggcttcaaaatagtttcaaataaaaacgcttcttcaattttacttttaaggttaatgatattaacagttattatctcttcactaggctcaaggtacttttctaagtgttcaatgtgattcaaatcttaaccccagtattaactgagtattaatagtttaacaactaggacacagagaaatcaagactcttccacagattcattctgttaatgtgtaattagagatgtgaactcagagtcccaaaatgcagtttttgggactttacactttacactcaaactaatctactatatcatagtgaggaagcctcttgcccatatgaagatgtcgggtaaaaagattaatttttagaagaaataattataaacctggaagatagaaatattttgactggtataaaaatatcaataaatgttatttttctacatttaagttgtatctgcttgtatggcataccatctcttgcaattctgcctgccatgttattgatatgaggaaattttgatgatatacatgggcactctttttatctggtcctttctttcctctagctgccaaaatgtatcacttataccctacttctgagccaccatatctgctgacattatccactgtgctcctattctctgtctattctctaggcacattgtctaataaaaggtggctactagctgcatatagctattaaaaattaaattcattagcctcaaattttaaattcaattccttagtcatactcatcccatttcaactgcttaacacatacatgtgactagtgattaccattttgaagagtggatatatggctatcatcagggtaacttttgggataacagaaacttctattgggtcataccactttgcactgagaaaccttcaaatcacagtctccctttcagcggacggaataataaagcaagagggagagcaaactcataccactttgcctaggagaaacaatctcaaaccacaattctcttatatatggatgtgactctcaaagtatatctctaatctagacctttctccttaatttcagaactgtatatccaactgacaatggcaaaattctgcctgaatcttttataacatctcaaacatattctatctaaatctaaatacatttctttctacccaggaaacctaattttcctttaccatattctatgttggtgctgagtcattcatgaaaaaaacccaggtgttttatctgacctcctatacttctttattccttacatccaaatacctactaagtgccatctgctctactatgtaaatatatcccaaatccattgagaatttttagccccactgtctctattcatcatcatctactatttccatccacagcatagttcttcccatgtctaaattctgctcattctcaggttcattttaagtataatcttatgaatggcacctgctcttagcattaagtattatagtatctctcaaatgatggacactcaataagttgttttatgaacacatcatgttaatacagtgtttacaagttttcaattgttccttgaagcttttctttgtttatatcctaagtgcataggttggcatgcagtaaataaatgatcgaatgaattaagtgattaaatgaatgaatgaattaattaattaatatgtaaaatcaagcaaagagtaggtacaatgaaacatgtccagcttgcatttaaatgtgattttggttttgttaacaactgaaaagctccaaaaatatatttatgcaggcttataggaacattcaaatctgcttaatgagttaatcattacttttgtagtgttaaaagaggagggaacatctaagaaaatgtgtccagttatttcacatttccttcaggttctggagtagacagcaaaccaaccgtcaaaactactactctaaagaacaggacaaaatggcttctagcctctgtgatatgctctattcactccaaagacatagttaagtaaaaagagatatgtcctcaaaacctgtagggacctgtcggctacataactttattcatagtcatccccactaaaaaatgctttttctcatataccaaacaagtgtgcaatacagtaataatttaattctgtctattaatactttcaatctgctattattgatacagttcccaccatcttcctatgtagattttggcaaaaaaagaaaaatttaaagtcatgtaaagatctgtttttcactgccctgtgaagtaactgcaagaaagatttaaggaatcttacaaaaaaatacaacacagccttttcattagtgcaaaatgatttcattttaactcctctaagggccttttactaataaattaatattagcttcaattaaaataaaatctttcagaagcaaatgtttaatttctgaagtacagatggaaactactactttctcactctaacaacataaatgaactattcaaagctgatatgtaattcatttctcatttcattagcttaaacatcagctgtgggtgtactttacttacactatggacatatggttgcttggatcaaactaggagtaaatttttttaatgctttcaagaaaatacaaaatgagtataaataagtaatcagtttatggtaatttaggaagaatagcaaattgacaagcctgtctttactccataatctacctaggttttcagaaaatgaggtttagacattaatatacaatcatgctatagaattattgatcaaagagagggataccttaaacacatccattctaatcaatggaaatgccaggtaggataagctgttctgaactttggagtgtagatttatcaaacaaaggcggccttttggtcaacaccccggcgacttcaaagtatcttgtctattttacacagccaaattcagaaccagttctgaactcttttgcagcctatactttctctgcctactttattcagaatagacagaataatagctaccattctcactcatcttggcactgtgctaagcattttagatgcatgtctcataatcctcacggaagccctgtaaggcaggaactattactatcctgatttacctatgaggaaactgaggtcacatagttaataagagattggctggtaattgagaatatagagccagctctctgaaccctaaatctgcactgctttcttttgataagtaaagtccatggggtttctgaattgctgctctcctgggggaattcatgataattttctgacaatgcagttaacagacctacacagccaagttctcctaggccttgagcttctgtctggtagtagcccaaaaatatttcatcccttcttaatccttgataaatttattatgtgcatttgaaagtaggtgaggatacattattatggaattaaataggtcagaaaagaattcagactcattacaataatgatctaaaaatgatatcaccaaattgttttctaccattaataaagcccagattaaaatatttctaattataccattacctttgaaaattactggtggtaaagaaatttgcctttgaaagctcacataatgctaagtcatcatttctttaggttatgttaagtaactgggagagaattaataatactagaaagtggcattaagcatataaatgacttctacaaataccactttatactcttctttttttcatttattcaataaatgctaattattgtggttcatatatatttaatatttagggagccaatattatgtatcaagaatatgtttggtacctcatagatcatatatcatacaaatcaatgactagtaaggatttcaccatttttcaaatgatatgtcccaaagtactgacctactctgatcctttatcacacatcacatggttaacaagagcagcacttttgacctctgtgttatactctactctatctttcaagaatatctggaatatcttcaaaaagtaaaaaataaaatactagagagaaaggacttagatatagcttcatgaagctgatacattatgttttccccctctggcagagtaggttttctacatatgaaacgctaatcatttaattagcctgagtgtccacctttgagtctctccagtgacttagaaactcatcttctttccctgtagcttaatttaaaaaatcttcatatgtctacataatgggttaatattaataaataatatttctgatttaattatattaaaagtgtatccaatgaatttttaatatgatgaagattaagctctttcatgcttttcctcacatcattttctaatttgtttacatcacagtaatcatttacacaaatgtgactacttaaatattcaaagttggacctgaaccaagtaatgttctatgatgacctttgttcttttatgtactactttataaattttatttattttaaattgttaataaattttatttttttaaattgcttggttttctttgcatttctcagtaagaattctcaaatgtttaaattatcaatactatttttatttatgttatgttaattaactgggagagaattaatagtagaaagtggcattaagcatatgaataagaagttcgtgcaactgttttggttcatgcaaatagaatcatactgcatatactttttgtatcaactttcactaaacattaaatttttttctatgtaagttgtatatggaattattcattctcattgctgtatagcatgtcattatactaaaatgtatttatccagtctatggttgatgggcatttgcataatgtttagtttgggactataatatatatggtgctatgaatatcctagtagatgttttttggtgaatatatgtgtacatttttagggaatatacatatcagtagacttgctgggccatagtatatccatatatttcacattagtaaacatcaacaatatcctaagtggttggaaaaatttttacccctatcaacaatgcctaaatattctagttgctctgtatcttccctaatatttggcacataccatcttttactttttagctttctgcagagtatattctcttgttcccttttaatatctcttccagggatctggtttctgctagttaagactagggattactttgattttttaaaaaatctactcctgcatcttgagtttagactgttaaatcttcctcttttagaatcactcaccatcctattgctcaagatcaaatcttaatttcttcactttctaccattcagaaaaacagttacaacagggaaaaagttaaagaaaaatagaaaggtaaaagggctccaaggtctgtagtgttagcaaaatgctgctcagtactcagagggtatcctgaactagaggaacagggaaagaagtctagagtaaaaaggtgcagaggtttaaaaggtacagaggtttatagggtgggatcacatctagtaggagaaatgtatcttcctttgaccagtggtgttgaatgaaggtggtccttcacatattgctggggattccttggctgaaaataaatagaattgatcttacctctacaaacttcaactctctttgcacagttgtctataattatgtgtcagagtagaaccatttttccaaccttgtctatctggtatctttctgcccattcttcagattcagattattgtttatttatttacttttataaatttattttttattgatacataatagatgtacatatttgagggtacatatgataacttaataccttcatgtaatttgaaatcagattcagtttaaacataagcttctctgcgaaacttccctcaatcagcacccccacacttgcctccaagtatattaggaaatcctgtctcttggacacgctaatgcctgaaatatacgtttattaaagcacctgtgtcttagccaggcatggtggcatgtgcctgtagtttctactacttggaaggctgaagcaagaggatcacttgagccaaggagttcaaggcttcattgagctatgatcacaccactgcagttcagcctgggtaacagaatgagagccccttgcctctgccctacctttttgtaaagctcctatgtctcttactttactgtatgtgttttcttgtactcagccacttctaaaatcctgacagaaagctctcaaagtataaactctgtcaggtcactttgtttcctcaggaaagtagtaggtagtagagtaagaattcaaaattaggcactcagactcagagcctgtgcccatagccactatgttctattgcttggatgtaagaataaccaccctgagacatacccacaaaacattgcaggacacttaggataaagagaagagctacatctttaagagagaaaagattatcagcaaaatattaaaatcagattggcattagacttttcatgagaaaggctagataccaaaggaaaaaacataaaataatgccttaattctaagaaaaatttattttaaacttgaaattcaatatccaaccaatccatcagttaagtgaatgatggcattatttcagacattcaagtacacagaatatttaatttctattaactgtcaggaagacacttggcacacatactcttaaaacaagaggtgaatccaaaagatcaaaacgtggggctgaggaaatagtggagttggaaaagcagtataaggaatacccagagagtattgagacaatatgtaaacatgtgatatatttgagagccagggttctcactatgtaaacagggaggtactgctaaggaatgacaaactgctgtggtaagacaaagatgaaccccatgggactggactgaactgaagatgttggcttgaactcataattttatatgcagatataaacataaattgtatatacagatatatatgtgtattatttttgtgcaagaatgaaggagaaataagaaaacacatcttaatttgcctatcttcacacacatttttaaaaaagattcacattaaggataaaggaataagaagacttgttatatacaaggaatcttaagagtaaggtagaagggatatgagaagatagatttgtctcagagtagtttttgtacatttttgacttctgtaaactttttaagattctacaataaaaaaaataaaattcaatcaacaagggtagggagttggggagaggaaacctaacaccaaatgcaaatagcaataaattaatgaatgaatatgtttaaaatttttaacgtgtgcaccactgagttgctcatacttcactattttctaaagttgtgttgtttaatacagtggccaccagatatacgctgctatttaaccttatattaaaatactataaatgaatacaattaaacatttatttccttagtcactctagcccaccacatatggctaccatattagatagtgtagatatagctcagttctatcatcacaaaaagttctattggacagcactatttcaaatatttgcaaatcaattatttgtgaagcacctgtcctctgcagggcactggtttaatgttggatgagtgatatcggtatcatctttgattctgtgtatatctcactactatgagttaaaaaaccctaaagaaaccctctctggcacctcaaaatgccctgggctattgcaaaattgtattttagctcctatctaatgatacaattcttagctttattggtcaacatgtatcttccttggtataaatatagatgactacttaacaacaaaaaacatagttttccttgtagtttgagaaattatagattatctctttgccatattaattgtgttaatcccttgaagtttatgggattctacagctgatgaaattgtactaattgcaatatatgttaacagtgtctggaatttcagttccaatttgttactttcattctaacaaaactgttaattaattttaaggagttgtaatactacagtaaaagattatggattcaatctcattgatagttgtgattttattttccgcattagctgtatttcccatggaagcataagagcttcctatatgcaaggggtacaaggttaagatttttaaagaacaggccaggcgtggtggctcatgcctgtaatcccagcactttggaaacaaacaagaaagatttttaaagaataaatttatttttcctgtatttgatattcatttattttgaatcctcctactattacacccaatatattaacttcggggagcccaaattaatacggcttaaacatataagcatgtttaactcatgtaacatacttttctagaaatctgaatagaaattgattgtaaactttttggctgtgagagtttggtgaactgaattattacttttaataatatttgttgaatgaatgaagaaaactcctgttttaaatgcagtaggggagcttactatttaaggcaactgaagtaacttctatcataaatatttacctcctaatttctttttctttttaaagctgaatttccacatgttggtttacagacactattttaaacaagtctatacaagaaaatgaagttttataaccatgctaagcatgtttaaagtagttatagaaatccaaaaactttctgaatctatgtaaactatgattatgaaacatcagaaaacaaaataagctaaagttcccttctataaaatgaaaaagttggtttagttcttctcctctagcatagttactctctgattccataagtttcttcacaatcatacatgcattgtatttattttctctggctatatctggttacaagcagaaattcatttgaaaagaataaatggaagaatgagagggtgggtagatgactggatggctaggtgggtggataaaaggaaagaaggatagtagtaggagaagttgggtggatagatgcatagataatacgatgtgtgaataaagagaagtagagatttatttttataactctcctacatctcccccaaaagtgaattaaaagcagcttttaaaaaagagtcaagtgtgcaataagctttaaaacaaggccaacaggagccacataatcaaagttagggagcagaaatataattacattaaaaatcctagagttaaggtacagcaattaagtataaaattgattgtttgaggtccaggcaaaaatgaagcaatgggttatatggttcatattacctactaaaaggaacctaagcactttgaaattttcaaatgaaaatgataatttctattttcatcaggatatacttgaaaagacttttccttctcaatgctgtatactaagaggaataaatgtatcatgtatttatttatgttattggttattaaataataaaatgaacaatagtctttacaaatgatgttaagaaaatgcaaaagcattcttcataagactatttattttttacaatatcagattatcgtctgcagagagttaaagtactagagttttgatttgcacctacctgatatgacatacagaaataggtcttgatttgaattctagagagaaagtcaatgcataaatgaataaatgatctcaacatggcttttgacagaagtgagtcacaaattattcgaaattgatgtcaacagtgagttacttcttgtaggatggtcattcaggtttatcaggcaaaagaacttccaacacttgttttagaaacaaaaatgctaatgatgtaaattgatattctcttgtgaaaatgaaagtgacttgtatcagctgcattttattcctgagacagaaagcctcagatcaggattacaaaatatgataacctatatgacagtgtccatcataatatctgatcgtttggaaataagagaagacaaacatctgatcacttactaagtaccagttattttgctagtgatttacacgtgtgaaagcagtaatgtgtggtatgttgaggcttgacatcaaacttcctgattgggggtctcttccctgattgcattttctcattgcattttatatgcattgtgttttctctgaagttttacaaggctgtagtcctgtgcaaacagtaaattcattgctcggtaaactttattataacacagtagttttcaaactttaccatgcatcagaatcaccagaaaggcccattaaggccccacccatggagttcctggttcaataggtctaaagtgctgcagaagaatctaaattttaacaagttttcaactgatgtggatactgctagtccagggatcatctttgagaatcacttttagcagatacaattggttggctccccgaatactcactaccaacattgttgctaaaagaaccatgaatttgttcaaacgtccagttacatctgagaagagggaaggtgatgcagttctcggtcagttagagtaggttagtattctctgtgctcttcccatattgtattaaagaaggaattttattgtaatagttgttattgtttgtcaccctatttgatgttccacaaagggaagatacttagaagatatgtgtgcataaattatatatatgtgtatttatatattaatatatatctgtctgtatatatgtatgtgtatgtgtgtgtatttggcatatatatacacaccaaattatatgtgtgaacacataaattatatatatgtgtatgcatatatatgtgtgtctatatatgtgtgtgtttctgtgtgtataccaaacacttttgtgtacatatatgtatatatgtattataatatatctcatattgtatatcaatatattataatatacctcaatatatcatttgatgtggaacacatacagatatatatacacatacacacatgtatacacacaccaaatttggtatataaaacatgcatatacagatacacacacacacacacacatatatatatacatacacatatatatcatttatgtgtaaacacatatgtttcgtatcatcagtttctcccaccaaatttactcttctctctcctcatgtatctcccactctccatgttcaatcaatcaatcactatgtcctgctgattcggcctctcaaatatgtttctggcacatagtagatgctcagtaattatgcactgagtgaatatgcctacctagcacaagttctatcaattcaatgatctaacttctatgcatcataactcacccagttttacaagtaaaacatataatgattgtcttttaattaatgcacctactaactttatcattaaggtcaaaggagttatcattaagttatcattgaatcagttgctgtgaatttcgtgtaggtctctctcaatggaaaagtttgcttctcaaaccttttctgttcctattcactaaagttctgccactgcaattcttggctgtgcctcaatagtgcacacacagtacatttagtatattactgatggacaaagctctgaagttaagaggattaataaggataaaacccaaaatacctaaagctaatatcaattcactgagtcagcaagaatgctctgaaaaccttttattttgaggcatgaaaacctctcacatatcattttattatttctacctctggaattctccaaatcatcatgaggctgcctgcaaatgtagagagaaagtatatataagcaattttgttatttttaattctaataatcttaaatctacctacttctttctcctcaaaagacctcattaccttgcctattatcctcaagatgcctagagatgcctagagagacagatatgagctaagatctcattttttcaggctacctccttctatccttctatgcattgtgtttttcttttactgcaggaagaaatcatttcaatagatatttacttattgatatgtataagttttgatgatcacaaaactaaggttcagtcagattaagtattaatgtctaaaactgcatagctagcaaaaaatgaatcacaaaatacttctaaaaatgaagaattgtcctataaagcttttaaaaggttaacaatctctttgaggtaaaacaagaacataacaaactactggtggctgaaaatgtagattttaattatgtatttataatatgatttcaatatattacctgttatatatttgcctgtgtttcctactaactgtagaatacaaggcagaataacaaaactgccaaaagagaatcatataaagcttcagagacattaaaatgagaaaaagtagagttgagattgtaatatctatcaatgtagtaaaacagggaaaaaaaagctaaaagttagattacaacaagttgtaatttaaactttaagccaaagaatctattcttaatttgatagatatttaatggcctttagaaaattccagtagtattctaacatgactagtagtgagaaagtaaatctgctacttgatctgccttaaaatttcctgtacaatgtaattcattactttttctgtgaattaatcagcattattttttcttttttctttcttttttttttttttctgagatgaactcttattctgtcgcccaggctggagtgcagtggtgcgatctcggctcactgcaacctccgcctccagggttcaaacaattctcctgcgtcagcctcccgagtagctgggattacaggcgcctgccaccacgcccggctaattttttgtgtttttagtagagacggggtttcaacatattggccaggctggtcttgaactcctgacctcgtgatctgcccacctctgcctcccaaagtgttgaaattacaggcgttagccaccgtgcccggtcatcagcattcttgacaagaaaaaaatcaagcacctttctaatagactttcatgagattatgacctcttctaggagattagactggcctcaagtaaccatcatgctaatagcccaatgattgttaacgagaatctttggaatagttgcatataatctaatagtgattgtctaatcatcatgttttaaatgaatcatctctatcaagaggacatatttaaatttactttttctaaagcctatttccttgcagcatgttggaaatagagttttatcatccggtcataattaatttgtctgagaagttgttttaacagtggttttcaactctgttccaatgagagtgtctcaggaagcactgtgggtagagagagaagaaggagggggtgaggagaagccctactgaaaatagtgtgagttcccacactcaatcgctgttacaaagacagcagcactttttcatctgttctatatatttaagttcagtttcactggaataaaaggttgtgtaatactaaaaagactggaaatcattgctctacattatgaatatagaagtcttgtataaaatagaaaagctgaaacaggaagacaagttaggaggttttagagtaggctagaagaaaagagttcataaagatctgaatgaggatgttggcagtggaaatgaacaggttgggacatttggtactgagatagaaacttcacgattttattgctgattagatgcagggaggtaatgcaaaggaagaattccaagatgactaaggtattgactaatcctgatgtctagaagaaagtgggcaaactattatcagtaataaaagagccaaaaggaaaggaagtctcgatgggttaataagagtctattcacgttgagtttcaggtaagtttcaagtccagatacctattagacagtcaggacagagagagagagagagagagagagagagggatttggtaaacatttgcattgggatgacagttgaagccatggcaataggccaaatcatgcttgatattaggctaatttccctatagtttgaaagaggaacttggtagtcataattaaatgtgtctctgttgatagcttcacagacttttaagacaagaggggattcatccttttggtgacacctgtcatgttacaggaatacctgtattgtatgtgaaaggactgtggaactcaaaattactgttcaaatgtaagatggaaatatttattgacattattattacattgtaatagagacttaacctaagacttgtcttttttttagaatttgttaatgaaactgcatttatctaatgcactataagagcaatatcttactgaaacattctaagcgtaggttaagaaatgcataatcgttggcttggtaatctctttctgggcaataacagcagaaccaacctccagcaaagaaagcttagtagcagagatcctatctacattcagaatgggactcagtgtatttccctgataagaaaatggagaaagtggcaccagaattgaaagtttgtaattgtaggacatggtaggtgattgcacatgtagggggctgggacagagggaataccttcagagattacttgcaataaggtagtgtcagtttataaagccaagacaaaacagaaatcaggacaccataccaggaagaaggaatcaaaaccagactcagctgaccctaaggctacaaggccacaaatgtcgaactttttcctcagtgactgctgctgtcaactacaaaataggctccctcctggtaaagatagcaggtcacatatcttagttaccgctcaggaaataacctgtcagcacatcatctctgaacacaaaggacaagataattgtcccacgttctgtcaggcagaagtcccagtcatctgcagaagtggtaatatggaacatggtgtatttgtattaacattaactcttttgtctctggcttcagtaggaaaaattttggagatggcaataacactttttagtattggatgatttccttagtctttcttaatgcaggggatgcatacctaacttttgtagttaataattaaggtatatctatgttgaatgattaagcaaaatcaaaaccaagactgatttttatttttttacactttctatttttacttcaaccagaatggaagaagtacacataattctggataaattccaaatccactgagagtatatttggtttatgtggtagggaaattagcctattattaaaacagatttttaaagatttataggaagaggcaagtagatgaaattgccctgtcagaatatttcatgactttgatgggataaaagtaaaactatatgatttctattgtactttctcagctgttactcaaattgattataactataaaggaatttcattttctgattcatcaccatattaaaatgactatgaagtcttctaaacaaaagcacgaaattctgtctcctcttctagtattcaattcacatagcaagatctctttaaaatggtcatcatattttgtatttatccctaagtgtgttttaaaaatagccaaggttagaataacaaaataaactcacacacacatgtgtgtgcatgcgtgtgtgtatatatatacacacacacacagatctatatatctatatatctatatctatacacacacacacacgcatgcacaaaaatcatgcctgttgattgattctggaaactagaagaaattgtatactgtttataatccaagggaggattatctgtatggatttcaagaagattttacttcactaaatgttgtgacattttacaaaatgttggttgtgtcatgctttaccccctggctttaacacatccacaaggctttgaaagcttgattagcaaacataaataataaaaagaaaagtagaactacttagggggcaatattaaaagatggatgtgctaaatacaaagcagataaataatcagacatgttatttttgccccactgaaaatccatgccaaaaatagtaacgactgtttttctttttcttgtccactttcttttgaacattgatacttcacattttgttaattctgaacaagactatgaaaatgttacatcattttactgaattgaaaacattaatgaaatataatgtgtgagcagatagattctatgagtttatgtgtgaacttacactagaaagagaagaatggcagtagatgtggggggttggaaggaatccagtcctatacacacataagagataaaaataaatttatttattttaaattcatccttgaaataggttaatcattgaaaaagacggatctacagattccacataaccaccccctggttccatccttgcaagccgggcataaatgctgagacagaataataaataaaataacaatttaaaataatttctgggaaaattatgggactatatacatggaaagaaacttcctgaaaactggtttaagaatacatttaatcatatattttcaaaaagtaattatatatattaaaaggtaaattttacatctgtaccaaaagtaccctgtcttttgccctctcttctgagagaaacattgcatttttctgcaatatctcttcctcgtgtcctctatcctacatttatagagtctcaaatatgctcagcctcaaaattaagatgctttgagcttccagaaaacactacacagataaaggtggctttcaaaagagatgtttcttattgtctacgtaatcatgcagagttaagcagtcactgcaacctttcatcattttctacaataaggccaactttccagataaccacttagtgaaacaagaatcctgtatttctatggtggagctactgcgggtctcatccaacctcctgccatgtttgggccactgactgtttgggcacttacgtccagcttgcgaggatggagccatggggtaagttaagtagaatttgaaagcagatgagtataataggagtacttactctggctttcagaatttaggcagagagaaacagggactgccataactcagtgaattttccctataactagactccataatttgtaataaactgcatatttaattaaccagttaggaggctatttttcctgtctggttcattgtttgtgtatgtgcaaccacagcagaaatcatgaaagcagcagcagcactgggagaacccagcctctaaaatgtgttagagtatttatctctgcaagatagaggtagttgataaaatagcaaggttaaagggcagacacttgcagatcaagcctttaaacaaactttcattttgaacacataccataacttagatgggttcattaaggagacacaaggcatttggaagtaataaagttagtaatggtttcaaaccaacactgtagggaaactaaacttattagaagaaaataatgaaataatcataaaatagctgacccattacttagcaatgtacccaatacattgtaatgtgcattatatatatatgtaatatataccatatacacacatacatatatatacacacataaaaaatacattgctaaagatgagataagagagttacagtggttatatcttacatttctcttccccagtatccatcaccctttcttccagccctgaattttctctcaggaaatcaccatttccctttcgtggatattttattgggagacggtacctgcctttcactctttaagccaaagagatcatgtcttctccttccccatagtatctatagacagagagttggcaagtgatctagtcagccaaaaagattgtctttcctcggattttgaatcttgagctagtgaagcaacaaggtaaagaagaatacaggatcttccattattctctagtgttacatattgttcagagaaacatttacaacatatgaaacctacgaaaggaaaataaatcttggagcccccaaatcactaatctaaagggaaaagtcaagttgggaactgcttagggccaacctgcctcccattctacttgaagtcatccctctgctcattgagataaatgcgtatctgattgcctcctttggagaggctaatcagaaactcaaaagaatgcaaccatctgtctcttatctgcctatgacctagaagccccctccctgctgcgagtcttctggcctttgcttcaagttgtcccgcctttctagacggaaccaatgttcatcttacacatgctgattgatgtctcgtatctcactaaaatatataaaaccaacctgtgttctcaccatcttagatgcatgtcattaggacctcctgaggctgtgtcacaggcgtgggtcctcgaccttggcaaaataaactttctaaattaactgagacctgtctcagattttctgagttcacaaacctaaaaatgctggattaaatatagttaaaaaattgtaccatgggggtagaagaataatttttttaaatcctcagaaattacaaaaaatataatcccagaagagaaagtaagtgctagagtggtgtttgccctggagaactctgcctaaagtagcaggttaattccaatgaaccatgcataaaagagaggatgaaaagtctgcaccatgagtgggaaggaaaattgtatctgaactatttagccttcactgcataaagcttgaactttcaaagcatcacactcattggatgaagtaaatctatactatccattcagagagaaatagttgggatatgtaaactggaagacagatttgaagaaactacacagaatgaaacacaaagaataacaggaatggaaaacaaaaagagaaggtaataaagaagacggaataaaaatcagattgaatatatgcttactaaaaggcccacagtaatttccagacttaagaaatttgaacaactaagaatagaaaaataaaaataatatacatccagaaatagtaaaatacaatgaggaaattttttttctttttttgagatggagtctcgctctgttgcccaggctggagcacaatggcatgatctcggttcactgcaacctctgcctcccaggtataagcaattctcctgcctcagcctcccgagtagctgggactacaggtgcctgccaccatgcctggctaattttttatatttttagtagagacgggttttcaccatgttggccaggctggtcttgaactcctgacctcgtgattcacctgcctcagcctccctaagagatgggattacaggtgtgagccaccacacctggcctacaatgaggaaaaattttttaaaatcaccattagaatatcacagatataatttttactgatgaatgctaaaattactgggcaaagcattaggagaaatagtacacttgcaaggcatgaaaatacttgccaaaccatatttattaaatatcctggtgcttgtattgaaaattctttgatacttctggcaccaggaggattatttattttcttccacttgagtataaactggacctggtaactcaattctaaacaacagagcacggaaagggagtagtagctttatactgaagaaacatggcaagtactgtcttaaacaagtgattgaagttaatatcactagttatataagtcatgttgatatggattcctgatactagatgatgagaaagatacttcatctgtgtggtattcttccctaaaatctgtaattccagtgaaatcatgaacactttagatacatacaaattgaaggtaattctacaaaatgcttgcccagtgctctttaaaagtatcaaggtaaggtatatatgagaaaaaaaaaattaaagtctataacctaagcttctactttaagaaactagaaaaagagcaaataaaattcaaactaagcagaagaaaataaattatacaaattagagcaaaaatcaatgaatttggaagcagaaaatcagtaaagaaagtcaacaaaatcaaaagctagttatctgaaaagatcaataaaatttacaagcccgtagccaggttaactaaaaaaaaagagagaagatacaaattactaatatcagtaatgaaaagggactatgacaactgatatcatgaacattaaaaagataataacaaaataccatgaacaaccctatactcacaaatatgatagcctaagtaaaataaataattccttgaaagatacaatatactgaaactcatatacacagacatagataacatgaataggcttatagctattgaggagattggatcaataattaataaacttccaaaacagaaagaaccaggaccagatagactcactggttaattctaccaaacactgaaggaggaaattataccaattctttccatctcttccagaaggtggaagcagagtgaatactttccaactcattctatgaggccataattcccctattaccaaaaccaaagacattgaaagaaaggaaaattacagatcaatatttcttacgaacataaatgccaagatttttaagaaaatgttaacaaaactaattgaattatgtataaaaggaattatatactaattcttttagtatataaataattttattataaatagtcataaataaatctacaaagaatcaagtagatttatcccaggtatgtaaacctgattcagccttcaaaaatcaattactataatccatcatatcattaggctaaagaagaaaaatcacataataatattaaaaggaaaagcatttgacaaaatcctacacccactcatagtaagaactctcagcaaagtaggaatagaagggacctttctcaacttaataaaaaacatccacaaaatgcctacagttaacatcatacttaatggagacaaactagatctcttcccactaagatcaggaagaaggcaagatgtccactctcaccactagtgaatgtaataaacaataaaaggaaataaaaaccattcagacttggaaggaagattaaaaatctctttgtagatgacacgattgtctatatagaaaatagcaaagaatcaatttaaaaagtcctggaactaattaatgacagcaagcttgtaggatacaactcaagtcttttgatttcttatacaccagcaatgaaaaactaaaatttgaaattaaaaacacaatgccattaacatgagcaccaaaaaagagatacttagtataaatctaaaaataatatctacgagatccatgtgaagaaaattacagaactctgatgaaagaattcaaagaagatctacataaatggagagtgagttccggtgcctagataggactcagtatggtctagatgtcagtctttccctacttgatgtacaatcaagttaatatttaatacaatccctatcaaaattccagccaggcattttgggtatttactaattgaccctaaacttaacagggaaaagcaaaagacccagaatacttgatacaatattgaaagacaaaattagaggactgacactacctgacttcaagacctactataaagctacagtaatcatgacagcattgtgtttgtaaaagaatatacataaagtaaaagaaactgtgaaaagttgtcacatttcgaaagacactatgaagacgtgataactaaatgcaatgtgatattctggaacagaaaacagacattagtagtgaaatttgaacaaagtctacagttgccttgcaccaatgctaattaattagttttgacaaatataccatgataatgtaagatgttaactttaagggaaactggtagaaaggtatgtgggcactttactatctgtactatcattgaatctcttctgtaaacacaaaattattttaaaataaatagtttaaaaaaagattctaagccaaatatctctcatgtaaaaacatacaaaagtcctaataaaattttagcaaggcaaaattcatcattacaaaagaaagatactattccatgcccaaattagatccatttcaggaatacaagtttattttaacattaagtaatctattaattttctaattcatcttatttacagattaaaagggaaattagatataagcttctcaacagatagaaatcaagtaggaatttgtgacataatttcttactcaaactaggaataaaagggaacacctttaatttgacatagcacattcacaaaaatttaccgcaaacgtgatattcaaatgtaaaatgttacaagccttattttaaaataggataatagcaacaaggataaacactaacaacacttctctttagcgttgccttggttattgtaaccagcacattaattaaaagcataaagatgaaaaaagaaataaaaaaatgtacaaactacaacaaacccagagcaaaggttaagaataaacagtgtattctggaagaaaaaaaagaaacaatagttatgaaaattttctttaccagttatcatggcattttaaatttagaataattaagatgcacagtaaaataatagagacagacatatagtctattggaacaaaagacaaatttttacacagacaatgcatttatacttgattatgtatctggctctgcacatcattatgggtaaaaaaacttttttatttaaacaattattattaaaaagtttttatataattggttaggcatatgaagtgaataaaaataaaagtcttatctcaatatacaaaaaaatacaaatggttaagatcttaaatgagaaaggcaaatttatttatttatttagagacggagtctcactctgtcacccaggctgtagtgtagtggcgcgatctcagctcactgcaacctcctgtccccgggttcaagcgatttgccaccacgcctggctaattttttgtatttttagtagagacagggtttcaccgtgttagccaggatggtcttgatctcctgacctcgtgatccgcccacctcggcctcccaaagtgctgggatatatagatgtgagccactgtgcccggtaaaacttgaaaactttaaagggcaatttttaagtcctcagtagagcaaaggatataaaaccacaaaccttgaaattttctttaacaataacatcataaagagaatgaaaaggaaatgtaaactaagaaaagatgaaatatatacaacccatagtatccagaaaaataaaaacaaccccaaagaaaaatggatcaatgttgtaccagtatttcaaagaagtgaaataaagagataggacaaacatattggggggaagaagctcaatctcatagggaatcaaggaatgcaaattgaaaacatgatatcatttagatatatctcatttacacattggccaacaattcaaaaaatctaagtctatagaaggttgttaaacatctgaactcctccttcactcctcgctgaagtagaaaatcagaaaaccttttggaaaacaatttggtatgacctcgtaaatctgaacagccacagaacctatggccctgtccttcagtcccaagcatgtatcctagaaagcttttgcaacagatgcaccagaattaaattgttcatagtagctttgtacataacagaagaaagagaaaaagaggaaagagaaaaagaggatgagaatgaacaaagatttgcactaataatccatacgctcatcagtagtacaataaatatatttcgatacatttatataatggggtaaagcatctgtatcttgaaaacaaaatgtggagaaagcaagttgaagaggattaaaaaaataaaatttgatcctacaatacaacaatataatactcaagagtatccgcccacaccactcacatataaaccatacacacacacctaagtattatgttgtattgactgtgtaacaaaagtataggaacaggtataaaaatgagcaatacaaatttcagaacagtgattaagtaagagtggggagacaggaccatgaggtaaggttaagtacatagatatttacttgatttattattagtagtaatattttaagtacatatatgttatatttactcttgtgtttgatatatatttcctagttttcaaaggttcaaaacaaaaaatttcagtcatatgaacttttgtggttctggctcctctcccttctgcctctccctggtggcacacgcaacttctcatgcctgcctttcacatgcaggctcatcctcagcccctctctaacccccactatataaaagccctgatttcggctagccaagttaatttctcttgcttccacccaagaatctcttctgaaatgcaacataaacataatctttccaacttagaatgacaaaaactatctccctaggtatttaagttattagttgtattacttttgtttcattaattgtagttttattgattttagatcatatgcacacacatatcatgtttgagcttcttttgctgatttctataaaagaatttgtacaaaacagtgttgataataatgtatccaacacatagggacacatgaaaaactgaaaagaataaggaaaaaaaggtgaagcagtcaaccctattttctcaagtggactctgcatttggctcattattcaatctttaatcctgtgttaccttccttccaccatcctgattcaaaatccccttaagcaaaatataattagcacaaggagtcaactgaaagtaaacatatatgattttaaattctgatggtaccttatacttttctaggtgctttcatggtgaagtcttcctgttcatgaagtagacagtttaggtgttgcctgttttacaaataaggaagtcaaggtccaggcaggttaaaagattcatctgaggttatagagcaattatcaatgacaactctgatactgatgctacagattcagagaggattgtcttattcttaaaaagggaaaatgtatataaagcccttgttacaatggtggacacatagttaagtacttaataaaggcaaattctctctctcttatcccttgcactttgcctcacttatcaattccatgcagctgattattctggtctataaatctaaagtctcagcaagaatgttgagtgaacagtatccaaagtcacatagcggcttttcctatcctgacccaactaaatgtattttgcaaatatgtcacttattaattattactacacaaagattatcacataatcccacattccaagcaaataataaaaaactgtcacatacctaaagggttagaaaaaaatccagattttaagcaatacatagacgcagtgtccagatacttaactaaattttttgaaggttccatgtggaagcacagatagtggacagaccacaaaactggccatcagccacctggattttgtgttctgtagtttgactttcagcaaatcacataacttccctgagtctcagcctcctcatctaaagacagacagtttaactaggtattcaataaggtccttccctgttctgagtcttcttttatttttttaactgccacaaatttatagtatcttagtgttactgccaatatagaaagccaaatgacagcttcaacgctggtgtttctcaataatgcactttatgctatagcacagaagggcttagtgaatcgatgatggtgccaaaattagaatttatggctgtgcctaatctattgttttgctagtaagccatactgcctgatactgcctccacttaacaataaaacaagatttaaagggcaaaactgtatgatttcatactggcatatgcaagggtaaaattgaaagacggtactataaaatcatctcaccataacgaccatcgagtacttacgctctgcaaaaaatgtgtacttgtctgcccttgccagacagatagcaatatttggttcaaaggattatagtggagttaagaaaaaaagaattaaagactggttttcgtatgtctgaaagctttgcatacaaaagtacatcatggaacgacactcactagaaaaagaacaattatacttctaaaagtaagagatttaataagcaatgagcttaaaactaggctgaaagaaaagttaattgaagtctaatttatctctttctggaccctaaattactaacaacaaaaaaattagctaacagttactgaacctgcgtgtcaggcacaacggcaagcattttttatgtgttaattcacttaatcctcacaagagccctctgaattagatactgttaatattcccagtttatagatgaagacacagagatttgaagttatataactagtacagagcagaacaggaagcaagaatagtttctgttaaacatgtgaccttcttcctgtatgtaaaatggccatgttagtaatttttacatgtgattttcatatattcataaaggagtgcatgttgaagtctgcactctttaatgatgtaaaataaaaattattaagaactaaaaataagttttatcattatagtatctggaaaatgttacatatcatttgcatgtgtgacattaactattttaaataaaggtatattgaaacttaaaaaattagacttgttccacaaacatgaacaagtcagtttttagtcatgattctaaagatgcttttatgtgatattgtaaattgatattagaatatgtaagtggctccagtcatctttaacacttctaattattcagagagatgacataatatcttctgacaaattctgatttgctattttcccactagctgtttttttaaattgacaaactccaaattttaatttgatttaggatgagaataaataaaaatggttgattctcatttgcaaactgtgacactcattatgaatttcataaaaatcaaaagtattgcattttattgatctaaagacttaagtttcatttttagtttatttcctgataattcattttttgacattatctaaaacatatcctttgcaaatacacaaatggagaacattagtttcttaaataaggtttactaactgagactgaacttgcttgtcaaatgtgccaagaaatgcaggctgctgctcagctccattaagcagccactctgctggtttaaatattttccagagtgggcagtagttcctgaggcatacctggaagagaggttgacagggttgccatactgccaccctaatttgcaagaccaaagtctcatttgagcagggttttcactgaagcatcatgtctaaaacacatctttgtttatactgtaggtggcaggatttttatgctttaaacattttgctataaccctgcattttttgcaaatgaaaatttaagatgccatcagataacattttatgaaaatatttatatggttccagaaaaaatagccaggccttgaaggtgggtgcctttcattcttggtattgttcataaattaatatacattgtttgatataatcatatttcacattaggtttaactttttctctttgttctgcaaattcgatatttttctaaattttgagattcaataaattaaaagcactaaatattgaaacttaaaaacagaattcactcctgtttaagatttgaaaatgggtatatctgcattgaatccaatatgccaaatgactttatttcagacttttgagtaaggaatataaatttctgaaagagggcatcatttttagccattaatatctgaaaaagatagcaatttataaacaaaaacaaaaacttatcaattctttgcaagcttatgaaattctgaatcaatctttttattttggcttccagtagtacaaaatgtttccattcacatttgatatacttacatatatttaaaatcatcactattttttcataatatatgaaaacatttttatcatgtctttttaaaagcaaattatgtcagtgaagacaattttcttggctaacccttgtacaggctaatttgcttatattataaacatctataaaaattcatgttttattatatatttcaaagctctaaaatgaaattaatcagggtgacttgaagttcatcaggacaccttggcttcttcttaaattgaagttgacatatgctcttccttaatatctgtttcttactctacttaagggaaatggcaaattatctaaaagttaactcaaattgcttaatatgctatttcagcctttgcatttcttctacttggcccatactctcaactaattcaaaaagagttctctatacaaattcctacatttaccaacagtaaaatggctatcactcacgtctacttaagatgaacaactaatgatctattttgtacaaatgtgtttatgcaggcattttagaggaaattttatctccttaggtaaagtttatgaacctttctcagtaaaaacatgagacctagaactatatatactctgctcttatttgaaatgcttcatgagttttttcaccaaaagtttacctcagtgtttgaaatcattatgtgccatcataacagttacacacacagacatacacacaaatagacgcttctaataacaccttttttttcgtctctggagctcaaaattctgtcattaaggctagattccgggccgggtgcagtggctcacgcctgtaatctcagcactttgggaggccaaggcgggcagatcacgaggtcaggagatcgagaccatcctggctaacactgtgaaaccccatctaccaaaaatacaaaataatagccgggcatggtggcgggcacctgtagtcccagctgggaggctgaggcaggggaatggtgtgaacccgggaggcggagcttgcagtgagctgagatcgcgccactgcactccagcctaggcggcagagcgagactccgtctcaaaaaaaaaaaaaaaaaaaaaaaaaaagggttagattccaaccttatatagatagggaaatagggaaatgagggacaaaaaataatatccttggccaagtgcagtggctcacgcctgtaatcccaacactttgggaggccaaggtgggcggatcaggaagtcaggagttcgagaccagcctagccaacatggtgaaaccccgtctctaccaaagatacaaaaaataaataaataaataaataaataaataaataaataaataaataaataaaataaaaataaaaataaattagctaggcgtggtggtgagagcctgtaatcccagctacttgggaggctgaggcaggagaatcacttgaacctgggaggttgcagtgagctgagattgcaccactgcactccagcctgggcgacagggtgagactccatctcaaaaaaaaagaaaaaaaaaggcaaaaaataatattctcaatggccttttttagaataatttttacatttttttcttgcaaacatcagatattaagcctttggtgctatctttcatgactttaccactttctactctgcaacatatttacatagtaaactgtgattttgacatagagatattcgtcacctttaacagaaaagaagaaatctgaagcccacagaggttgatttatccgatatcatatggacaaagcctagctctcctaattctaaatttagttcagtaccccacgatccatttctgtaccctaaactatttctataaattgcctttatttgggcaataatagatgataatttgtctggaaaactgggtacattccatcaagtgtgtctttaaatttggcctatattccttggaaatccatgctatgctaaattcagtttctagaatgttttattctgtgttttcatcatgcctgaagagggtaacataaaaaagcaaatatttatttcccattattctaggccatattccagttgagcaataatatttgtttatacataactttttttttttttttttttaggcggagtctggctctgtctcccaggctggagtgcagtggtgcgaactcagctcactgcaagctccgcctcccaggttcatgccattctgcctcagcctcccaagtagctgggactacaggcacccacaacaacgcctggctaattttttgtatttttagtagagacggggtttcaccatgttagccagccaggatggtctcgatttcctgacctcatgatccacccgccttggcctcccaaagtgctgggattacaggtgtgagtatatataactcttacttttggaagttgaattaattcactttttcctagactgttgtcctaaatgcaataatgctccacattctatcaaagtgtaggtacagtgtatcccagaatcactagaaaaaggtaactatatgcccaccttatgtagaatacttgaggcatatatatccaaagaatatatgttctacagattgtggagagcacgtcactaattaggaaccaagtatccaaacacatagatagctaccttcaaaattatcttggttaaaagaatgacagaaatcagaaagtttgttgctcttatggtcattttaggttttcagtatttttttcctatggcaagttgcactagctaaaagtagcataaagagagttagagagaatcacacccaggtgtaaggcaaagctgaatagctgagcttctgaagtctttgtggctaaacttttcatttttaagacatagtagtcagtacaggaatcagaaggtggaaccatctgcagctatcagcttatacagagtacatgacagtgatccaaacagccacaagaataagcagtcctaacagtagcatggtgctttacttcacttagtacagtgacagggccttgacccgcaagctccagcagaaccccaccacgtgtgtgatgtgtattcaacctgcaatggtaacatacagcaatacattaggcacacagtaatgccagaagttttaatattagactcagaaagataccacaactaaaaatttctacatggggctcctatatgcatagaactcttgtatatggaaaaggaatatgggaaaataattttttttacgttgctccctgatagttactctcctggggaatttcagggtcctgatttttaacttctcctatctcctgacccttacgtagatgataagactttttaaaagccatgttctatcttctaaatgttgggttttggtagatgacttgctacttgaataatagaaggtaaagtatagctacatatagtttaatgttgtaattatgtaaaacttacaactaaacaaagctgctacgtatcactattaagggtgtgcctaagagcttttgtagttataataattagccacatataggctattttagtaattgttataattattttcatctaattaattgaaatagatttttctcattttttagtactctagtatctaaaaagtgtctgcttaatattcatgacacactctcctgactcacttgcttgtgtggctggtctccttacccacctcccagtgccattcagttaaaggcaaagtttccgaatcctaaaattttctacatctcactatgtagttaggccttgggtagctatcaagtacatgcctaacttgcctgcaacaatctttcttagaaatttttgagcagtgtttttagctgcttcatgattcctttcccaatctacaaatgtgtgtttttgtgtgtgtatgtgtgtgttgtgttgtgtgtgtgtataaatacattgagggggagtatatatgaaggctgtcaaaataatcagagggttataaaccttagaaactctgagtccatggattgcagattgttttttttttttagacagagtctcactctgtcaccaggttggagtacaatggcatgatatcaacttaccgcaatctccacctcctgggttcaagagattcccctgcctcagcctcccgagtagctgggactacaggcatgcatcatcaggcccggataattttctgtattttagtaaagacagggtttcaccatattggccaggatgatctcaatctcctgacctcgtgatacacccacctcggcctcccaaagtgctgggattacaggcgtgagctacaatgcccggtgggattgcagattctttaaaccaccaccaattgtcagacagaagaaagaaggggaaagaactaatgttacaggtgggaagaggtgaggagggagctcaaacacattgcctgctgaaattcttagacacaagccttgaccatgataaactttaaaatgaaatcacacaaatcataacttcaccattaccggacgaaggaaaaggaagagagtctagattgagaagagagagagtgtatcttcccccttccttatttaaaataataaaacctatcatttacggagcacttcctatgggctggacattcccgtaaaactctgcatggcatatagcctttagttctgacaaaaagtcctatgatgtgggtattattatctttgaagctcaaataagattaaaaccagtaccaagatagatagctagtaagtgatcagtctggatgattcttttgcctaagatttgcttctgtttcacagtgtttgggggaggattaaatgagagtttccaatgaacttaccaactcttcaccatggtttgtccactttgccaatatcatcttccttttattcaagtaggctgcaattgcattaactttgttttcagactctaaagctgggagataaaacactgtgttcccaaggcgtttgctgctgttgatcctctgcctagagttctcttctcccagcttgtacagtgtctggctccttctcctcttaactctcatcctaaatgtcatccactctgagaggccttctctgaccacgtagctatagttcctactactgtttgcatgagtagcaacttctttacttgattacttattatttgtctttctctcaagccttgggctgtgagggtaggtgtatatctccagcaattgccatgacaatgacataaagacactcaacacacaagtgaatgaatatatgcagtaaagcgtaagagcctgattcagagcctggtacacatttcactcattacatcttaaactcctccattctctaatagctacaagaaggcaaatgggtcagaaaaataatgaatactgaaatatttcccttgtctacaaggtgaatttggtaaaatgggaggccctcagatttctttgctctattttaattcctgaatttgagacatacaaactatctcatcctccctggcccagaaactttaggtctaacagacaattgaagcaaaaataaatatactcatacatacatacataggattaccagtgtatgcaggctgcttagccttcaccagtcataggaaacatctcagcaggggcccctgtttcatcatagctcacatgttcttccccgggagctgcacaggtaacatgaatgagtgaagctggcccagggacagcattgagcacaagactagatgtcctagataaagaaggcagctccaccccagctttagctaattcataagtgatgatgccatgatgaaataaggcccaaggttgccaaatgtatctttttttaaaaaggctagaaattagatttgtatataaaatctttctaattataggtagcaaaaattaatttaaaaattttaaaatatcatgtgtggaaaacatctgtgtgattatgctctcattgaccatcagttcctaattatcatgatccaatatcattcttttttccttttcttcttctcttccctcaaggggacattcttgaagtatggcagagaaaactctaagttcaaatatactttgacaagatctcaatttcctccaattagaatatagaatcttcaataagtttttcaacttctctgagcttcaatatcttataaaatttgagatattattggttgaataaaatagagtagaacttcttcacaggtactaacatttcaataataatttatataaaaacaattaatttagtgttcaaactgtcttttacaagattgaacacaatacttataaatttcaagccaatctttagcatcacttggataaaagtcagaagaataaaaaacagtaaaaatccagttttaaaaaaatcatatcataattaagcatctgcttttgcactcagttgtgtctgtcagtgcaaaaataagtcccctttaaaatagaaggaaagtgacagttcttagaaagaaacttacgatgtgtggtgggttactttttcactttttcatggacttaccctttcatctccaagaagatatggaaaaaactgaaggaggcaaaggttacatttttcaagggtaatagtacaccgtggttctttctttattaataaattttactgagatagcttattgctcctttttttttctctactagaagtaagtaattttcctccttaactacaaatgatttttaagtaaataccagttttactaaggtttccagattcccagttctaacgccacaatccctgatgacttaatgtatcttctatcctggccccacttcattattaataatgacagctgactgatattaggtcaaaatatggaccagagatgtaagacagattttgtatatcctgcctctagtatctacaacaaccatgaaagaaaggtcttatacccattttatgaacaatgaaagtctcaaaggagttgaatgacaagtattaaagggctctgtgtttgaaccaatccagaggcaaggggctctaaaaatctgacttctcttgtgtgtgtgtgtgtgtgtgtgtgtaaataagtgctatggtttgaacactgatcgtaacttggttttgtttatatacacttgctaattatttctggtatttcagatttataccacaaagactattttcaacttgcttatttctcaggccagatgttacagagaaggatgaggctgataaaaggcaatatgttaaaaatttcttattaaatgagattctgacctaaggagaaattattctgtaatatttcatcctcaaaacaaaggtaacaagtttattctcttaggaactggaaaagctgaagcccatatttcctacaacatgataaaactctaaaacatgaaggcaaataaacaatactatcttaagccagtctgaaaagattttaaagtcagtcacacctttattcccttcatcttaacatcataacttgtaggaaatcctcacttaacattattgataggttcttgaaaaccgcaactttaacacaaccaattttaacgaaggttaattgatataaacaagagttaagctcccatggcatgtttctggtcacaaaaatatcaacaaacttctaaataagacaaagagactttcaatattgagtattgaaataaatgtgagctatacttaccattaagaaagacaaacaaaaacaaataaaataatggtttacccaatttttggtgaatcagtgagtgacagtggtggtaaaggtagtgggttaaatctaagaataaatattcgcaaaagtgaaaattgtaaagagcagctcttctatcatgcagttctaaaacaatcatgaacagggtgggctccctgagcacttttgcactgcatcattttatgtagtgaatttgtgggattattgtctactttatgaacttttattttacagtaatatatattaattaactcattaattttttaattccagttctgggtcacaggtggctggagcctatccccgaaactcagtgcacaagaagggaaccagccctgaacaggacaccattccatcacacacagcaagtactaaacacacacccacactcactctgattgggacaatgtagacaagccagttaacctaatgtgcacatcttggggatttgggagcaaaccagagtaccaagaaaaaacccctatagacaccagagaatgtgcgaattccacacagacagtggcccaggtgggaattgattttctccccctatcattgtttataacaacaggagttgaacaaaatgatattattcaaggacctgctatatttaacttctaatacttatttaaaatttcaattatccagttgacagataattatgttttaaaacaagtaatataaatttaacttgttgtctagaccaaaacctatgaacttttctcaataactgattacggcagaataaaatttagacaaaacgtttacttaaaaagaattgaatagcagactaattagtgatcttaaaagcacccataagatagatgaaagttcataaaatgcacacatattcaaaaacaaattagttcagtttcgcattacattcaaaatataatttttttagacattcatgcttatatcaaatgtaagtgaaattttgttaacatagtctaatgatcagttagacaataagataaaatacaaattttaagtttggaaacttaatgcaagtttaatacattaaaatacagagaaaatggtgatgtttctaagaatacttcttcgttcagtatctgatggccagcacatgcctttgaataattttttttccacaaactaaatttatggttagtcaagttttgccatttctacataattcctcatttatttgggtttgtttatgatacagttttcgtagaaatacttataaaaagaaattttaagccgggcgtggtggctcacacctgtaatcccagcactttgggaggccgaggtgggtgaatcacaaggtcaggagttcaagaccagcctggccaacatagtgaaaccccgtctttactaaaaatacaaaagattagctggacgtggtggtaggcacctataatcccagctactcgggaggctgaggcaggagaattatttgaacccaggaggtggaggttgtagtgagctgagatcactccactgtactccagcctgggtgacagtgcaagactctgtctcaaaaaattaaaaaaaatttaaaatgagaaaagaaattttataatttatattatcaaattagtgtgatttaatgtcagtaacacaaacagtaaaggaatgcatggtgatttatttctatggtgttttgtaggaaaggacatttgaattttctgtcaaggttatgaaaatgatctctgaaagctctcaatgattttcgttaactaaatcaataacagtaatatttaattacattcactaatggattctccttttattttatagagtcggatatttattaaataagtgcatgccagcaactatatggacaaaagacaaagcaaaatatgaaaaaggtggaaagcattatggtatgtggttgaaaacattgcttgaaagttttaaaataaccttcagagccccatctccttgtacaggctcttatttattttgcccatgaagctttattttcaaaatgaagcttgctttgcagctggcccagtgggatagcagggtttttatcttgccctttgtccctagatcaaccaagtcatctatgaatagttagtggaatcagctgagtaagatcatttgcaggtggagttgctgggagatatatatatatatatgtgtgtgtgtgtgtgtgtgtgtgtgtgtgtatgtgtgcacgcgaatttggataagtgagattttcttctaaatataatgcatactctataatcccagtggtcaatagtaatctctccacctatgtgaaggtctttgagacaagtgcacctatctttctttgtattctgtcgttgtgatccatagataccaattactctggtcttccctcattttgatctgattgctcccagttctctgtgcacgccaagcttcctctccaatatccatatgccacatgtttttcctcatccatgctattgccaaaatccatgccctctaagtgaaactttatttccatgtttctaggtcatccctattctccaacaactagattaaccacctcttctaaaaattcttccatgcttagatgaaactgatctcaccctctctgagtggttcccaagtcttagtatgcacatgtaaatgctcttcaaagctaattatgctgcagttaccaggctctgtccctagatatttggtaaaataattctgatgcatgcaatccagaaatatcttttgagaaccttcttgcataaaacttctctgagccacagtggtatttcaacttcacatcactgcaccttaaaggtagaagtattttttttttttggttcagtaccctttccctattactttaagagcactcgttcacgcattgcaagcccttgagttactcctgagagaaagaaaggagctagcaaatacttaagaaatcgagttattaaatgagtcaattttaggtttgaatataaatccacttttataaagtatgaacttggtcaagttgcttagctcttctgagccttggatatcacaactataaatgggaataataataaaaatgggaataattacttgatcataatcaaatgggaaaaaaaatcaagtgtttagtgttttattctcccttattcatgttttcaaaagagaacttcaccttgagaaaaacactcttggagtaacatgtcccatagagctacttactgattcaatatttactctccctttacattaacggaatcccaataattgagggaagcaatatgcccagttaaaatctacacaccaagcctacttttcagctagggataaccatgcgatgttggtcagtaagatgtacgtagaagtccttgggtagaaatgcagagaaaagctcttcatataagataggggatgggatgtagggataaactaaacttgtttgcaacactttgccttttgcttttctagaacatagaatatgaacataattgtttaagcagctatatcttaacttccagggaaaatctaaaagaatcacaaaatcctttgccctgatattttaatgccaccaaccatacacctataaatttcttgtcattagacaaaaataaaacaattacattggttaatctactgtttggaatgtctgttactagcattcaaatgcgatttgtaactggataaaagaaaacaaacaaacataaaacaccaaaaaacatctttcacttcttactcccactcttcaaaggaagagagtatttatttgtgagactaagaaagggcatgaattaaaatcaccaagttcctgttctcctgtgggtaggagtagatactgagtggatgaatttaatactgagagaaaactatttagaaaggtcattaggattcaagttgattcacagaattcattgcactctccaatgcagctccagtaataaagctgacattttgacccatcatcaaacctacattatacctacgttgtggggctgttgtgagcttttacgcagcattgcatataaaatgcctagtctcgcacctgatatataagtcttatcgaccatcactatgaccattcttatcactatcatcttcattttgaatattctttcttttggtaagtcacagttattctcctgctggctttaggctgctgttttaatttccctaagtctccctctagttgtgatctttggctttgatttaccctacacatttatgcacttctttttcttgcctacttggttctaatttttcctgcctctagccagttggcaaatttctccttttgatgtctatcttggcattaaataatgtttaattaatatatgtcagtgttaccaagcataccatctgaaacaaaattgccattcagccaatgtaaactgaatgtgaatcttacaaattcttgccttagcttcgtcaattcctggtcacttgagttatctccacaacccttggccacttgctgccctgaggagcatgacacattgacaggttggctgtcttcgtatcactaggactttggtgcaggtcttggttctctcattcctaacccagcctgagacattctgttcctgataataaaaaacacattttccttttatatataatattccatatcttctaatacatctgtaaaaatacttttgacctagtaatttaaagatgcttcttgtaacaccataaaaaagagaaaatattgccaaatgttgccaaaggagagaatagacagaaataaagaacagtaatgcaaatgaagcttttcatttagacttttgttaaagtggctgagaaaatattcttttggccaagaaatgtgttgttatcaacagcttccaaaattttggcctttaaaaatcatgtttacattattattattaagacatcaaacatgcaattaaataactctctctttaaatgcaataactttgccttccagaccaatgcccatcacaaatagccagccagattatgctctgtacagcttcaggagtcctcattcccatagattatgatatgaatagtggcccttgagttttacatggtagcccaagtccagcttctactcaactgatcaatgatttttaattatgttggaccatctttgttgaataggtaaaaaataaaatatagatttgaaaaaaaatagttataacatgttagaagagctttctgcaaaacataattttggaaaagtcatgtttccattgggatcaagattgtccattctattaagttaccgaaagaaacataaaaactaaaggtaaatttataccttagggggctgctgatatttaaaggttggaggtagaagagggttggacttggtggaaatcctaagaagtaacttaactgtgcaattaaagtgaactatagataaaattagaaagtgaaactaataaaaaactcttagcctgttttagaatcattcaagttattctcaacaattccacttattatttcctttaaatgtattcttttactaaatataattagttgcatacatttttgaaaacctgcaatgaatacttttttatggtaactacttaaatgccaagatttaaatttcaaaatactgattgtttccataaacaaagatataacatatttttatactctccgagtgtattttctattgccaaaatactgtgtttacaataaactttaaaaaattctcgctattttaacctttgtccactgctacgaaaaagctccaaataatactctttatgctgaagccaaggaaatgtgcgtatgctatatgagtgtcctagtgaccaggctgtgatgtgtggccttgcactctcatctacaattaaatagttcaggagtagacacatgagtcagatggattatatccaagttggcatttaaaggtcttcatttgggaatgtgcatggcaccctggaacactgaaagtgagactaggtagactagtgggtgaaaatgacagtggctgaggtgaagctctgctggtagatagggcccagaacacactcagaacaggcctcacagaggatttcgaatctttttctaagttctgtggaaaaccattgaagagctctaagtagaggaatcacacacttatatctgtttttaaaatatcaccctactgcttctggctttgagaataactggtagcagatcagcctgccagccataaactattggaaaactcgaaaaatatgtgcaacagctcttttcaggcactggaaaacagacactaaggaactgtgtttgcaatgaggagtggaacaaatgaggaatgtcctacagtcgcccaggatttctgcctggaggcacttcctagatttagacatgagcagaggaaacccaagcagggcatgccaatcatacttagctgaagagacagaaatcaaagttcagttggaggaggtgaggcagctggaatttgtagggcattgtaccagagaggagggcactatgcagtaaaagagttccagaaatctctatacagatttcctggaatctttggctgagctgtaaatgcagagaagagactacacaaagccttgcaaaacaaacaagtgccaggaaaagaacaaatcctggttggcgggagggagttggcaggagtatctccattctggacatttgggaagaacaagaatcctgctgaatatatgttgccagctgcacttaagtgtcaaccttaggaaaagagacttttgacaaaatatggtgacttactggagaccaaaacattggtatttagtgtcccttttcactagatacaccgctccccagggcattgtgagggagcagagagctgcttttcaacctccactctctcaaggacctagaaccaatctggtataagccctcaaaagtctctagttagtcacctttcctagaaatccaagaactcccatactcctgcttgaactgtgcatcataaatcccataaatgagcccagacctgaacaaacaaaagtcaggacttatttggcttatgggtatctggtaacttctgctttaaacctgcagcacaaaagcctctgaggtaaaagaccacattacggggtcccttttaaaaaatttatttttaatgatacaggaggtaaatgtaattccaacagcagtaagaacaaaatacaaattaatgtctcaataaattaatctgccacactaagtatctattttataaattcaaaccaaatgtgcttaatcatcaagggttgtatttaatatatttttttaacatgccatttgtacttctatttaattgtgatgatatgaacaggagttggaaatactgggtagaagagggcagtctacacctgtaatcccagcactttgagaggccaaggggcacggatcacctgaggtcaagagttcgagaccagcctgggcaacatggtgaaaatttgtctctactaaaaatacaaaaaataaaaattagctggacgtggtgccatatgcctgtagtcctagctactcaaggaggctgaggcagaagaatcgcttgaacccaggaggcggaggttgcagtgagccaagatcgtgccactgcactccaccctgggtgaaagagggagaatccatctcaaacgaaaaaaaaaaaaagaagaagaagagggcagttccccagcaaagcccctactctcaagcctggacacccgtggccctaaatgagaacaggcatttctgttttctctcccaaaaagttgccttttggcctgccatgtccctatcctgtatcccaggctccagaaaagaccagcagatgaggatataagacaagcagatgaacagcagaatgacacagcagagaaagagggaagagggggaatgtctgagtgctgagaggagttcggcttggggtggtcagagaggagtttagtggctgaatggtccaactccaagggaagatcatctttccactccatccccacttctggctccccatccattccactgagggccacctccaccactcaataaaaactcacattcgcttgaattcccagcactttgggaggctgaggcaggcagatcatgaggtcaggggttccagtccagcctggccaatatggtgaagcctcatctctactaaaaatacaaaaattagccaggtgtggtggcgcacacctgtaatcccagctacttgggaggctgaggcagaagaattgtttgaacccaggaggcggagattccagtgaactgagatcatgctactgtactccatcctgagcaacagagcgagactgcatctcaaaaaacaaacaaacaaacaaaaaaacctcacattcatccttcaagtccatgtgtaatccaattcttccaggacagtgggcaagagctcaggacacagaaagctgtcactctggccttctgcccttgcaaaaaggcagagagtccactgaactggttaacacttaaagccatgtgcagacagcaaggctaagacagcattgtaacactggggttgcaggcacccacccctagacactaccacagggccagagcccaaagcactggccccagcctctgcacctgcccatctgcatgctccccttcctgcaaggggtttgagcagtgatggcaactgaacaagtgagccacaaacctgttccatgtcctgcatgggggatcagggaactcttcagtttcatgatgacaagatgctctgagaagccatcatttaacccgatgcatgccggttggccttcagtttgctttaattagtttatcatcatgcttaaactggatatggagattcaaaaggaactaaggtagaaccaagcacagccaaatgaagataccctgtcataattttacaacttctgagacatcataattttacaacaaaacattggagatattttctggaccaaatcacagagaagtaaacccaaacagagcctggcagtcttcctcagctgtggagagaggtcagatttgcaagagtgggatagctggatttgtgaggcactgtcccagagaggagggagctacacagaggaagaattttagaaatcaccacagaaatccccatgagtcttttgggaccaaaagcaaacattaaaataagaataggcacacgaaaggcaggagtgcaaatacacttaacgataatcagtaatgactgtagtccctcagctacatgcttatcagtttttgtttagtattgactgttttctgtacattaaagggtgaaagaaaaagaaacattaaaaatgtgctgggtaccttctatgtgcaaaactttgaatgacagatttgattttaccatttcaaagaatagaaactagcaaacaagagtcaagatgagttgttcatatcttgcctgcagaaaaaataacgtgcttctttttgttgtagagccgaggagtctccctatgttgcccaaggtggtcttgaactcctaggctcaagggatcctcctgccttgatctctgaaagtgctgggattataggcatgagccgctgcacctggccaacaatgagcttcttaataattgttttcaatgaagacaatgaagggttgttctgaggaagatgctcacctgttctacatctcccctgcaagcaaatctaaaggcaaagagtgcagctctaaccaagtcataaggcatgccttcttgactctgaggctgtttagccacaagaactaccaagggactctaagtggggtcctgctattagaaacattaaatctaggactgaaaattgtctgtttgaaatagttatgtgctcatattaaaaaatgagaactgattaggtaaattgggagagcaaaagggcaagacaatgtctgttattgatgattttcagattgctgaattaaaatgcttatttcattcgagaagaaggatttaacagccaaaatcacacttaaccatgcatgaaaagagccactgttgaaaaatggctgataaaaatgattactcaattttaaaagcctgcattgtttaacgtaattgatgcaaactttagagaactgagtcagaattttgtaaaatgaacaagctcaatccaactaatacaagtgcagagtgccctttacaattttgaaagtaatacttgggtgtaaatgactacattggattacaagatactttaccacacaacttagaagatccttttgacatttagagcagaatgtatcaaacagcaggaatgggtaaagtgaaggacactaatacttgatctacatgttacgcttcactcttacaatgctctcatcactctttatgcaccttcttcatctacataaccaataagagtttcatataaggcagatgatgctactcgacatttggcacaggtagtacttataaataccttacaatttggcctccatctatgggattggtagaaagggcagattcatattcaaaaagtacactaactcatattaaatgtgttcagagttaggttcagtataggtatataaggcatgagtcatataaaaagtgaatgtatataaaatgctgcataagttataggaaaataatacaatgaagggtaaaatatataaactgaaactataaataaagataaactgtaatggccattaattgttagtgtacactaaattaatgtatatttataaattcatattaatagatgtacattaaattcacgtgtgtattgggggtagcgggagatcagaccagaaagggtgctagcagattgttgcaacttctttttgtttaatcatagtctctagtatcttcctctttggggggtaacaaatatattttaaaaaatcctttcatatttcattcattcagtgaatgagtttacaaaataaaattcttttcaatatgtgtttttagtcttattcataagggaaaacaaagtaggcagagagcttttcagattttaattctgtcataattacttacatgtgcaaatacatagaaaagtttagtcaaacagttaggcagctaattgtgttgaaaatacaactgcatgctcacaaagataatcaagcccctagggtgtacacttctgtttcagaactatttttaggccctcaggaacttcagccacctcttgactcctggaaaacaatgtcaaaatctaactaactgaatgtgacccagcatttatttcaaagcgacaacactaaatttgattgcaaagtaacagtaagaaattaaaagtttaaaagccagcaactgtgaatgttcaaataggaatgttcctgctatcaattttctacacatacagtgaataaattgtgttaaataaggaactgatgttcttcacagtagggaaacaaccatttattgcaaatcctaaatttgataggaaaatttactttcttttcttattctgtgtcaaaaaatatttttggaacatttaaaatgatcctgagattgcaattgtttatcactacccatgctaaaatagatacattaaggtgttaaggacctaaagaatttagaaatgtccttcaggggaaaaattcctgaaatttcattgtacatgtggcatatatttctttgccattgtcgttcaaattttgcattctagaatcaattaccctatcaattttccctcaaaaatattatctctaatcttattctctccctttaaaaatcttcaagtgcaattcttaggaccctataatatgattattaaaattttttccattgtgtatattgatatttagaaagagagtgtgaaaagaattgtgattggcttttaaataaattttcttaaaactgtatcatgaataatttgccataatttacattttatgtgtcaatttataaacactatgtatttgtttctcattttattatgtcaccttgcattataactaagatgttatctctgcttgtttcttaacttcaatcattttatgagagaaataccagttacttactcaggaaagatgatttgaaacatggaaaagaaaattatttcccatgagggaatgtcaataatgggaatctaacatcaccattcttttaatatttaatagatagccattcttttaatattgacattgtgccatgctaatattatttcaagtgtgatctctgccaaaaggtaggtgtctagggggtaagaatcaataatgacaacaatcttttatttgtaggcctactaagtgttacacattgtgctgacagcttttagcatattgtattcaatcttgataagaaagcttcaaggtgagcattattattgtcatgttataaatggcaaaacagggcttagatcattttcccaagttataaacctagtaagtagcagatgtgagattcaaacctagggatacatcatatttaaatgttagattaagtagtatcaagtggcagctaagacaagacacctgagcatgctgaagggtacctagctgtgatgttattgtgctcctctaccattataagtcattctgaatccttgtcaattcaactctttatttactgggaaaattctcacttttccttctaaaatcagtgcagctcagacttgtccatagagaagtctttcttgatgatcacaggatttctttcctgaaatctcacggtccattttattacttaagtctgtgtattactcaggttctccatagaaacagaaccattttatgtgtatataaatgaggaatgacccatgcaattatggaggctgagaagcccacaatatgccttctgcaggctggagacccactaaatctggtcgtataatttaacctgcatctgaaggcctgagaacccaggagaaccaataatgtaagtttcagtccaagggcaggagaaatgtgatgagacattccagctcaagcagtgaagcaggaaaaagagggataaattcatacacatacacacacacacatatatacatatatatatatatatatatatacacacacacatataaatataattttttttttttgagatggagtttcactcttgttgcccaggctggagtgcaatgtcacgatctcggctcactgcaacctctgcctccggaattcaagcaattctccggcctcagcctctcgagtagctgggattacaggtgtgtgccatcacactctgctaatttttgtattattagtagagatggggtttcaccatatcggccaggctggtatcgaacccctgacctcaggtgatacacccacctcagcctcctaaagtgctgggattacggggtgagccacggcgcccagccaaagagggatgaattcttacttcctctgccttttgctctattctgggacctcaatagattggatgataccaatcactttggcaggggtgattgtgggccttgcaatctactatactgagtcactgattcaaatgcaaatctcagccagaagcacccttacagtgtaacaccccaaaacaatgtttctcctgggcaccctgtggcctactcaaatgaacgcataaaattaactgtcacagtctataatggagtataacatgcggcactgcctggtacaccagtcttcagctctgtcattagaaaccctagggcttgaacatgtttcagggaaaaaaaaaaaaacctactacaaaagtactatcgtatgtcaaaataaaatgaaagaatgaacgaacagttgaacaatgggcgaatgagtgaatgtgcatcacacatagctggacgagaaaaatttaatacttttttttctcacagaaatagagttatatcaaatatacttgaatagtttctagtgttttcagactgaaaaattaatttcaaagaaactttatttactttatataataccctgtaagtcatgaagctcaagtaattggactgtaaattaaattactgagttacaaggacccatattacaagctattcctcctgctgtttttcatcagaaacgttcatatgatattgtggaattgaatttttaccatcaaataaatattgcatgcttggttaaatgggacatgattccaagctcaaaaaataaaatatagaacaggcaattcactggtcagttgtgaaatatgaaaaagaagtaagcacatatttcttttttttattatactgtaagttttagggtacatgtgcacaaggtaaaagtttgttacatatgtatacttgtgccatgttggtgtgctgcatccattaactcgtcatttaacattaggtatatctcctaatgctatccctccccccctctccccaccccacaacaggccccggtgtgtgatgttccccttcctgtgtccctgtgttctcattgttcaattcctacctatgagtgagaacatgcagtgtttggttttttgtccttgccatagtttgctaagaatgatggtttccagcttcatccatgtccctgcaaaggacatgaactcatcctgttttatggctgcatagtattccatggtgtatatgtgccacatttatcttaatccagtctatcattgttggacatttgggttggttccaagtctttgctattgggaatagtgccacagtaaacatacgtgtgcatgtgtctttatagcagcatgttttataatcctctgggtatacacccagcaatgggatggctgggtcaaatggtatttctagttctagattcctgaggaatcaccacgctgacttccacaatggttgaactagtttacagtcccaccaacagtgtaaaagtgttcctattcctccacatcctctccagcacctgtagtttcctgactttttaatgatcaccattctaactggtgtgagatggtatctcattgtggttttcatttgcatttctctgatggccagtgatgatgagcattttttcatgtgtttttcggctgcataaatgtcttcttttgagaagtgtctgttcatatcctttgcccactttttgatggggtggtttgttttttgcttgtaaatttgagttctttgaagattctggatattagccctttgtcagatgagtagatggcaaaaattttctcccattctgtaggttgcctgttcactctgatggtagtttcttttgctgtgcagaagctctttagtttaattagatcccatttgtcaattttgcttttgttgccattgcttttggtgtcttagacatgaagtccttgcccatacctatgtcctgaatggtattgcctaggttttcttctagggtttttatggttttaggtctaacgtttaagtttttaatcaagcttgaattaatttgtgtataaggtgtaaggaagggatccagttttagctttctacatatggctagccagttttcccagcaccatttattaaatatggactcctttccccattgtttgtttttttttttttttttttttttttttttgagacggagttttgctctgtcgcccaggctggagtgcagtggcgcgatctcgactcactgcaagctccgcctcccgggttcacgccattctcctgcctcagcctcccgtgtagctgggactacaggcgcgcaccaccatgcccggctaatttttgtatttttagtagagacggggtttcaccatgttagccaggacccattgcttgtttttgtcaggtttgtcaaatatcagatagttgtagatatgcagcattatttctgagggctctgttctgttccattggtctatatcttcgttttggtaccagtaccatgctgttttggttactgtagccttgtagtatagtttgaagtcaggtagcgtgatgcctctggctttgttcttttggcttaggattgacttggcaatgcgggctcttttttgcttccatatgaactttaaagtagttttttccaattctgtgaagaaagtcattggtagcttgatggggatggcattgaatctataaattaccttgggcagcatggccattttcacgatattgattcttcctacccatgagcatggaatgttcttccatttgtttgtatcgtcttttatttggattcctaggtattttattctctttgaagcaattgtgaatgggagttcactcatgatttggctctctgtttgtctgttattggtgtataagaatgcttgtgatttttgcgcattgattttgtatcctgagactttgctgaagttgcctatcagcttaaggagattgtgggctgagacaatggggttttctagatatacaatcatgtcatctgcaaacagggacaatttgacttcctcttttcctaattgaataccctttatttccttctcctgcctgattgccctggccagagctcccaacactatgttgaataggagtggtgagagagggtatccctgtcttgtgccagttttcaaagggaatgcttccagtttttgcccattgagtatgatattggctgtgggtttgtcatagatacctctttttattttgagataatttattgagagtttttagcatgaagggtgtagattttgtcaaaggccttttctgcatctattgagataatcatgtggtttttgtcattggttctgtttatacactggattacgtttattgatttgtgtgtgttgaaccagcctttcatccccggcatgaagcccacttgatcatggtggataagctttttgatgtgttactgtatttggtttgccagtattttattgagaatttttgcatcgatgttcatcagggatattggtctaaaattctctttttttgtagtgtctctgccaggctttggtatcaggatgatgctggcctcataaaatgagttagggaggattccctctttttctattgattcgaatagtttcagaaggaatggtaccagctcctccttgtacctctggtagaattcggctgtgaatccatctggtcctggactttttttggttggtaagctattaattattgcttcaatttcagagcctgttattggtctattctgaaattcaacttcttcctggtttagtcttgggagggtgtatgtgtctaggaatttatccatttctttgagattttctagtttatttgtgtagaggtgtttatagtattctctgatggtagtttgtatttctgtgggatcggtggtgatatcccctttatcattttttattgaatctatttgattcttctctcttttcttctttattagtcttgctagcggcctatcaattttgttgatcttttaaaaaaaaccagctcctggattcattgattttttgaagggttttttgtgtctctatctacttcagttctgctctgatcttagttatttcttgccttctggtagtttttgaatgtgtttgctcttgcttctctagttcttttcattgtgatgttagggtgtcaattttagatctttcctgctttctcttgtgggcctttagtgttataaatttccctctacacacttctttgaatgtgtcccagagattctggtatgttgtgtctttgttctcgttggtttcaaggaatatctttatttctgccttcatttcgttatgtacccagtagtcattcaggagcaggttgtttagtttccatgtagttgagtggttttgagtgagtttcttaatgctgagttcgagtttgattgcactgtggtctgagagacagttttttacaatttctgttcttttacatttgctgaggagtgctttacttccaactatgtggtcaattttggaataggtgtggtgtggtgctgaaaagaatgtatattctgttgatttgaggtggagagttctgtagatgtctattaggtctgcttggtgcagagctgagttcaattcctggatatccttgttaactttctgtctcgttgatctgtctaatgttgacagtggggtgttaaagtctcccattattattgtgtgggagtctaagtctctttgtaggtctctagggacttgctttatgaatctgggtgctcctgtatgtggtgtatatatatttaggatagttagctcttcttgttgaattgatccctttaacattatgtaatggccgtctttatctcttttgatctttgtcggtttaaagtctgttttatcagagactaggattgcaacccctacctttttttgttttccatttgcttggtagatcttcctccatccctttattttgagcccatgtgtgtctctgcatgtgagatgggtttcctgaatacagcacactgatgggtcttgagtctttatccagtttgccagtctgtcttttaattggagcatttagcccatttacatttaaggttaaaattgttatgtgtgaatttgatcctgtcattgtgatgttagctggttattttgctcgttagttgatgtagtttcttcctagcctcgatagtctttacaatttggcatgtttttgcagtggctggtaccggttgttcctttccatgtgtagtgcttccttcaggagctctgtttgtcaccaccaggcctggtggtgacaaaatctctcagtgtttgcttgtctgtaaagtattttatttctccttcacttatgaagcttagtttggctggatgtgaaattctgggttgaaaattcttttctttaataatgttgaatattggcccccactctcttctggcttgtagagtttctgccgagaggtcagctgtaagtctgatgggcttccctttgtgggtaacccgacttttctctctggctgcccttaacattttttccttcatttcaactttggtgaatctgacaattatgtgtcttggagttgctcttctcgaggagtatctttgtggcattctctgtatttcctgaatttgaatgttggcctgccttgctagattggggaagttctcctggataatatcttgcagtgttttccaacttggttccattctccccatcactttcaggtacaccaatcagacgtagatttggtctttcacatagttccatatttcttggaggctttgtttgtttctttttattcttttttctgtaaacttctcttctcgcttcattttattcatttgatcttacatcactgataccctttcttccagttgatcgaatcggctactgaggcttatgcatttgtcatgtagttctcgtgccatggttttcagcatcatcaggtcctttaaggacttctctgcattggttattctagttagccatttgtcaaattttttttcaaggtttttaacttctttgctatgggttcgaacttcctcctttagctcagagtagtttgattgtctgaagctgtcttctctcaactcgtcaaagtcattctctgtccacctttgttccattgctggtgaggagctgcattcctttggaggaggagaggcactctgatttttagtgtttccagtttttctgctttgttttttccccatctttgtggttttatctacctttggtctttgatgatggtgacgtacagatggtgttttggtgtggatgtcctttctgtttgttagttttccttctaacagtcaggaccctcagctgcagatctgttggagtttgctggaggtccactccagaccctctttgcctgggtatcagcagcagaagctgcagaacagtggatattggtgaacagcaaatgttgctgcctgattgttcctctggaagttttgtcccagaggagtacccggccatgtgaagtgtcagtctgcccctactttggggtgcctcccagttaggctactcgggggtcagggacccacttgaggaggtagtctgtccgttctcagatctccagctgcgtgctgggagaaccactactctctttaaacctgtcagacagggacatttaagtctgcagaggtttctgctgccttttgtttggctatgccctgccctcagaggtggagtctacagaggcaggcaggtctccttgagctgtggtgggctccacccagtttgagcttcccagccgctttgtttacctactcaagcctgggcaatggcggggtgcccctcctccagccttgctgctgccttgcagtttgatctcagcctgctgtgctagcaatgagcgaggctccgtgcttgtaggaccctccaagacaggtgcgggatataatctcctggtgtgctatttgctaagaccattggaaaagcgcagtattagggtgggagtgacccgattttccaggtgccgtctgtcacccctttctttgactaggaaacggaattccctgaccccttgtgcttcccgggtgaggcaatgcctcaccctgcttcggctcatgctcggtgcacagcacccactgtcctgcacccactgtccgacaatccccagtgagatgaacctggtacctcagttggaaatgcagaaatcacccatcttctgcatcacccatgctgggagctgtagactggaggtgttcctatccggccatcttagctccacccccagcacatatttcttcttacctaatttgattacccaaaattttgccaccgtttgtctagtcatttaataataactttggaatctttgcttatgtaaaaagaattgcaaagagttaataacctctctatcctccaggaattattgcatagtttaagacattccttattaacatcccacaagaatttcccagtggcccacaatagtctttcttcacacaatattttttgtaacattgtctattctataattcattatttttataatttgattatgttttctaatattccaaaaatttcacatctacttactttccaataatttttttcaaaattaagtccaaaatcattcacactgaatatagtgctgagtataaacagggcctaattaattgggttgaaaaattctctcatagctcttatagcaatgcttctcaaagagtggtccagggcctccaggggggccttgagaacccatcagaagatctgtaaagtcaaactatttttgtaataatactaagaccttatttgtctttttcactgttaggctctcatgagttaactgtggatttttttccagaggctgcatgaagtgcagtataacagattgactgcagaagcagagaggaaaacccagatgttttctattgagccaaatcattaaatagatttgggaaatgtaaaaaaatgctactcttctcattattttgtttctaaacatatatttatttttcataaaaatattgtttatgttaacttctaatgggtttatcatagttattggaaaaattaatttgtaaacaaatttttaaaaaatatgtcagttttagtatctaatacagaaaatatcaataaatttaatctgcatacgaaggctttttgtagtcttcaataatttttaagagtgtaaaggagtcctgagaccaaagagtcttagaattactacttttaagcatctcaaacggataagtacagatacacttatttggaagaatagcaactactatttactgcatttgtccaaccagctggccactttatacacattacatcatttaatcctccacagtgctatgagccagatattgtgctcctctctttttgggaaagaaatctgtggctcaggatgatcaggatgttcctctaaggtgataagaggaagcactggactttgaaccaggtctgactacgttcaaacttcagattcttaatcattaccctggctcagtctcaaaaaagatttaaaaacttgttgcatgagcacatgaaaagctgatcaacatcaaaagtaattaaggcaatacaaactaaaaccctaatgagatgtcatttcatagccactaaggtggtcataataaataatctagacaataataaatatgaacaagaatgtaaagaaatgaagaaaccttatacatcactgatgggaatataaaatggtgcagccactttggaaaacagtatggcagttctgaaagtggaatatatatgtgagttaccacatgacccagcaatttcattcctaggtatctatataagataaagataaatgaagctatgcatagcctaggtatccatagctaagacaaataaagtatatgttcatgtaaagacttgtagagaaatgttgataacagcattatttataagagcctaaaaatagaaataaccctaaatgttcatcagtttaagaatagataacataaaatgtggtatatctgcacaatggactattattcagccataaaaaggaatgaagttttgatatatgctacaccaaggatggacctcaaaacattttgctaagtgagagacgccagtcacaaaggaccacatgttgcataattcgattatataagatgtcatagaaaggcaaatttaaactcaccaaaagtagataattggttgcctgggcctggaggtcggaaggattaatagcaaatagacataagagttcttattgtggtcatgaaaatgctcaaaaactgacttatggtgatagttgcacagctcagtaaatatactaaacatcactaacttttattcttgaaatgggtgaatatgatacacagaataagcctcaaaaagtgcttaggccatttggaaagatctctttttaacagttactgaaggaacatacagtagttaaagaaataacatagtaattaagtgatagtaaagaaaaagctgaaaacttggtgactgaaagcttaatagagattagggagtcagtgcaagaataagatcaacacagaataaacaggggaatgaaaacctaaagagaaaagagcaaggaaggatgagacaaagatcagggaggcaggttgttaactgtgatttcacagttctaaaaggaagttggaactgagcagattagaacagtctttgtccaaagcaatgtgaaaatagacatcaagacccttaatttttctttcctttgacccaaggatttatactgtgaaaatttatcctaaggaaattatcttaactacagaagaaaatgttacgcatgaaataattttaaaaaataaatccttgccattgtttacagtgtaaaaactaaagaatacctaaattctttaagaaaaatagtgaagtaaatcactacattcacatagtgaactattaaacaataattaaattgatgttaccaatgagattgtgttcagtatcttcatctgtaaaggcgataatattagcatctagctctaccaacaaaaatctatgtattttttgttgagagaattaaatgtagctaacacatatgaaacatgtgcattcttaaacacagtgagcaacacatggtaagcgattatttaaaattaatctctgttattaattgacagaaactgacacatgggagaatcaataagggattagagtaaaacaatttagctagctattaaaagaacaataatttttaaatcatttatttattccaaagcaaaggagagaaaaatatggtacttttgtgaatatctaaatcaaactttaatttctatattataaacataaaagtctgattgttaaatcttagaaatctttcataaatcagcagaggtaataggttcaccaattatgaaatttcttctttgagaagattaaaagaagaaattgggaaagagaaataaacaattataagctaaaataaaaagatagataaagacagtaaaggaaagattttaaaagctcagccagggttaattcttatgtcctacttggtttcctaacccccaaattccttttatttctacagacagggttacagatagttcctgctacttgagtgccgtctaatgtcccaattcctatctttcctgtagtgaaaagggaattttaaaaatcagttctcagaagggtcagagttgatttaatcttattcataatccagctctgaccttgtgttaattctagtaactagacttctggtttacctatgagattaagtcaccattttctacttcatttcaataattgaattctttattgtcagatttcttgagtggctccctgcttctaatacccataatttgctggatttatcttgctagaatcccatggatctcatctttgaaatacagccgagtggatggagccttgcagacatccctcatgcatgatacttatttgacttcataattaataatacatgtactaatgttacccaggattgtacacacctgttacatattaataaaaaaggacagggttatatttgtgggtcttggttgacacttagagcttgcctaaattgtcatctcttgcctgtcaccatatactcaagaaactcaacttcccttgcctgactagctttcttgacttacaatataggttgttacatctccaaaacaatacttatagcatccaaaaagtcacattcagtataaaaagtgtcaactctactactgaatttttccattgcagataccaattctatgtcaagttccagagataaaaattgagaatcagagagtcagagaggtcaaggagacacagctaatcccttgggtggttatacctaaaaacctaaaatctaaactctaatttagagatggtagagctgtttgtttgttttacgtactccactagacagatagtatagagtgtatatatgtttagaaattttctatatttgttttaaatattactatgtctgaagacaggaaggagcctatactatttacatgattctattctaataagattcattactactaaccctatttaacagttattaagcaattgcagtaattatggttattcatatttcaatacatgaaatattattaaagatagtgtcttaaataatatctcatatttatcatttgatgagaaattttaaatacattattagatttaattttcgtaaccatcctgagagatatacggatgagatattcttacccctgtttaatagataaataaaatgtggcgaaaaaaaggtgaagtaatatccaaaggtaacattatttttattttaggtataatttgaactcagatctgcagactcgatatatagtgttggtagtaaaaattatgctcctgtctctataatgtatttttaatggaattttagaagttagcattatgctaaatggaatcagattaagaaacatacctctgtctaacattgaaacagactccaaatgtctttataatgggcaagtggatacagattaagtgccatgaactatcatcatcctaagagtcttacttcctttcatggtgattgtcagggatgcttttctgagattcaaatattctcatggatgagttaaaagaagatgaaacaagatgataaaaccagtctcttttcaagaaaccataaacatgttagcaaccatcaaatttctttacgccctcattctagtaaattataagctatcaaaactgcacacgttctgaaagtttactaaatgcaaataaaatagtctctttgccatgctgtaacttgagataataaaggacttaaataaattcagtgaaagcaaaaccccatatgtttgggtgtcagaggctactttgactaagctcatttcaaattataacatcagcaaaattaagctattaaaactacaaataaaagagtatttttagttctaagaagaaataggactaattggatacacatatgcctcctaggctgtatatcttaaatgtgaggctcatcagtagttattattaaagttggcagaaataatggacatagtaaattgtactttagatttttctttatgcacaattgcttggtgttatcttcttaattgagtcacagaataaaatctaagaaaacagatgtaaacacacagacattaaaatgcatcactacttttgcctttaccttttcatattggttttcgaagtgatgcatggttaaatgaacctaatttgagagaaatttggagatggccgctgagtctgtgtgctggtcagggggttgctttctactgttgatattattctttgcgtattaacctcagaaggggaacaatatatggaaatgggatagaaagtcttcagaaaccacagtaggaagattaatattcatagcacatttatgaagtaggcatcattatgtgtgtgtgtgtatatatatatatatattcacatatatataatttttgaaaaattattttacagataatgagtttgagatacaaggatggtttataacttacacaagatcacacagatttcaatattctaattctaattcaattttttctaattcttagttgcatgtgttagtccttatctaggtcttagaaaattacacttcttttttgcaatagtccaaatagtctaaaccgtacttagcatttagtgttcaaccaagtttcttgactatgtcagtaaaatgtgctggctttaaacgctgggatcatgtcatcatcactgtttcctcagagcccaacaaaatgcctggcacatatcaggaacttcataaagagcattaaatgaatagataattgaggacatgaaaaatacatccatttattcatttagaaaactgtgtgtatttataaatgacagcattccaagtcacacatatttaaacttatgaaatttctagatggtttaaatttataattaatgtaaaaatgaggaaggacagagaaaacattctttgtatgcaaatattattatcttctacatagtcaataagattttagaaaacaatgttgcatagaacatatgaaatatcaattgcttactattattgtcaataaaggagagcttctcttatataacattcattataaacatctgtgtgtaaggaaagaaattagttttgtgctataaatattggtcatataattcattaattccttcatttattcactaagaggaatggactactttaggtaatgttgtaatataagccacatcacaggatcctttatttctcttcttcaatattctgaatttattccttaatattcaataatttttggaagatattatctttgtcgtattatttgttcaatgacaactatatgtaaagaattatttggaatatttgctgattgaaaactatgtgcaaagggcagtaagaatcttttcattgttttatttaattctcaacaaatataacatgaggtcaccatttcacatatatgaatactgaagttcagaaagtttaagcactttgcctaaagatgcaaaaccagtcattggcagagtttaaagtctctggcacattgacaagccctctcaatgtggagaaaaaggaactcataagctgttggtgggaacgtaaactagtacagccactatggagaagggtatggaagttcctcaaaaagctacaaataggaccccaatatgatccagcaatcctggtactggtaatttatccaaaagaaattaaatcattatatcaaagagacacctgcactctcatgtttattgtgtcattaatcacaacaggcaagacatgaaatcaacctaggtgtctaacaacagatgaatgaataaagaaaatgtgacacatatacacaatggaatactatttagccataaaaagaatgaaatcctgtctttcacagtggatagaattggaggattaggacattatgttgcgtgaaataagccaagaacaaaaagttaaacaccacactttcttactcaaatgtggaagttaaaaaaaaaaagttgatctcatagaagtaaaagaacagaggatactggggctgggaaaggtcaggggaagggagtgatagggagagatttattagaggatacaaaattccagctagataggaggagtaagttctagtgctctataccactctaggatgactctagttaacaataatatatagtttcaaatagctagaagtggatatttaatgttcccaacacaaagaaacgataaatctttgagatgatggatatgctaattaccctgtgcattactatacattatatgtatcgaatcatcactatgtactcataagtatgtgcaattattatttgtcaattaaataaatttaaaaagacaagccctctcaatcttcaaattctataatttttactcttcctctaaatctctataaaattgattgtaggctgggcataggggctcatgcctgtaatctgagcactttgggagggtgagactggcagatcacctgaggtcaggagttcgagatcagcttgaccaacatggtgaaaccctgtctctactaaaaatacaaaaattaaccagacgtggtggcggttgcctgtaatcctagctactcaggaggctgaggcaggagaatcacttgaaccccagaggcagaggttgtagtgagccgagatcgcaccattgcactccagcctgggggacagggcgagactccatctcaaaaaaaaaaaaaattgactgcaatgtgtttttgttgttgttgttgtttgtttgtttgagaaagagtctcgctcttgtcacccaggctggagtgcagtggcgtgatctcagctcactgcaacctccgtctcccgggttcaaacgattctcctgcctcagcctcctgagtagctgggattacaggcatgtgccaccatgcccggctcatttttgtatttgtagtagagacagggtttcactatattggccaggctggtctcgaactcctgacctcaggtgatccgtcggctttggccaaccaaagtgctgggattacaggtgtgagccactgggcccagcctgtagtgtgtatttttgtatgtttctaattttaaaaatcaaaaattgaaattcctgccactgtttacttaaataaacctaaattagataccactacccttatgatctaaagtcttctctctatggtcccaaacagtctctttatgaaagtttatgatttctatagaaggaaacatccttcagacgaactgaccaatggtactggcaatagaggcatctgatttagaaagccagttggtataaatatggccttatcatattcctgccttcctggttctagaatccccagtgtatacaaatctaaacatgaatgctttcttgcccacaagtataaagcaaaaaatgtttcctttctggaacctaaaggtatacaaaaattctagtccttcattaactatatttaatttaataattaaggaaacatattaaaaagctaagccacaggtaatttcaaaataggggagagtaaaactcaggaaagagaggagcaagacttatctttattaaaggtttatcataaattagaaaaaatatggcatagtctttatattttcaggcatagaaattttgccggcattctgaactacaaatgctgctgttaagataattttgtcactaaacaacaatatgtgatgggaacaaagcaagatgccaggagatacaataaaggctagaatgtagtttatagcaaatttggcccactgcagtggaattggtaaatggcttctggaaaatgtatagcatcataaaaaaccccaaagccatgtttcctctgaaaaatgttaaacaaaggtttcaaacataaaaatgctcatttccatattgattttgatgaccagcgttaaatcaggcagtgtgaatggctgatggactctgctcctctgtgtcattattctaccatttcattctgaagggaattactgtatagatggcagtttgaaacaattttcaagcctctagatagagggttttattttttttctctaaataaatgtaaacaattcttttctgagaataactgtacccaaagaaggtggaaacttgggaattcagtatgattttaaagaataaaggtgttatttcacttgggtaagtattatttggttgaattcttcatgatatagcaaaataatttttgaaaagtccctttttataatgacaagctatgcatacatttctgaaagcagcagaaagtttctgaatcatcttgaaatatcccacatctgaaataatggcgtggtggctcacacctgtaatcccagcactttgggaggccaaggcgggtggatcacctgaggtcaggagtttgagaccagcctgaccagtatggtgaaaccccgttctctactaaaaatacaaaacttagctgggagtggtggtgtgcacctatagtcccagctactggggaggccgagacaggagaattgcttgaatctgggagacagaggttgcagtgagccgagatcgcaccactgcactccagcctgggcaacagagagagactccatctcaaaaaaaaaaaaaaaaaaaagaatatttagttggaaaccattgccttctgttctcatgttagaaagaatgtggaatacatcctccaatttgttgtaatataggaaattaaattgaatagtaagtatgtgtgtgtgtatatatatatatatatatatatatatatatatatagagagagagagagagagagagagagagagagagagagagaaagagagacagagacagagtcttgccctgtcaccaggctggagtggagtggcatgatctcggctcactgcaacccacgcctcctgagttcaagcaattatcctgcgtcagcctcctgagtagctgggactacacacatgcaccaccatgctcggctaagttttgtatttttagtaaagacggggcttcaccatgttggcctggatggtcttgatcttttgacctcgtgatctgcctgcctcggcctcccaaagtgttgggattacaggcgtgagccaccgcacctggccaaatagtaaatatattcataacaattaaaaacacttgtttggtaactgctctcacaacataaattttgtatgaccagtaatgactggattagagacttttgcttgcagctatatggtaggatagacaattctaattacttgatcctaataacttacttaattacctaataacttacatgaaacgttatttttatcacatttctgggctctcagtaagtaaagagactcattgaaggtgttaggttggggaaagagttgtaaccaagtgtgaaagacattgggcatctagacttgagtggaaaaattgaggtgatgagattaagaatcttgattatacttgggaccctggaatggggctaatgtggtctgagatctgcagatgtgaatataaatcttcggtagaaaaaaaaaatgcctcacaaaaagcagcaaacaacaaatatcagatttacatcctgaaaaaaattcatgtactagagtgatctaatatagtatttctctttctttgtctatagatagagatatggaatcataaaatcagaaaacaaaaataatcatcaggcaaattcaataaatagtagaaaaaaatatacatgtcatttcctatgggccaaacattttataagtttcaatacattaaatgatttaattctctagttattgtctaaggtaataacaatttccatatttccattttatttatgaaaagattgaaattaaaggaagttttatgtcttattaagagccaaacaggctggatgccatggctcacacctgtaatccaagcactttgggaggccaaggcgggaagattgcttgaggccaggagttcaagaccagctggggcaagatttttgtgagattccgtctctacaaaacattttaaaaatgagtcaggtatggtggccacatctgcggttccagctattcaggaggcttaggtaggaggattgcttgagcccagaaggtagaggccacagtaagctgtgatcctgccactgtactcttgcctgagtgacagagtgagaacctatcttaaaaaaaaaagcagacagcaagaatctaccaaatatctaaaattgaagaaatatatatgtttaaaaaaagttaacaaatggatgaatcatcatatcatacacaactgaagaaaagattagtgaattggaaaagttatctgcagaaattatctggattacagtacagtgaaacaaaggcctggaaatacataaatctgaataaagaatatggtggatagaatgagactacccatcatgtatactgtcacatgctcaggacgagataatcgagataatagaataaatgacatatttgaatagaaaatagctaggaactttctgaaacttgttagagacatgagttcacaaacaggaggcaatgatatatacctccaaaacagtataaataaaaatgaatccgcacttagacacaccttagtgaaactacagaataacaaagacaaaaaacaaccttaagaatactaagaataccaaatcatgaaagacaatcaggttggcatcagattcagaaaggaatcctgactcttaagcctcttctcttcctgtctactctttcttcagtctttcttgcaaaaatgaaacacaataacttcatcttagataaaatatgatgttagcattaattagtctatatatttttatcagtcttagaatagtggctaaaagaacaggctttgaacagcagatttgcattttgctatcaaccctataatttaattagccgattattagcttaaatataatcaattcacataatcccactgagactccatttcctcatctgtacaatgcatattattccatgtactgcatagtatggttgtgggattgagtgtgataatgtatatacaatttagcattcttcttggaatgtataaaacaatacagggaaactatcaggttgaatcatatgaaattatcttgtaggtcaaaaaagttgaatatcagtcatttcacttgggtcaacttaatagtaaattgtggtttcaagttgagaaagaatcaagtttacttttaaattcatatacaaaaagagacatacattttaataaggaaaagaagctagtttacaatcaatcttgcctcctacaccattatagtctgtaggttttactctacgagtgtccgcttgttgatgatgtgatgtaatctaccagaatctgacttgaatagaatatttaataagttgataatcatataactacttttatgattagaccatgtattggctgctcaaataacaaaatttcctggtgcttctactggtaccaggggatttatggtttaggcataagatttaggcttgcattttattgtgactattctaaatatttctctgatgtgtcaggtagtcctttaaggtggccaccatgaccctttcttcctgagtttgtgacttgtttgtaacaaacagaaaacggaaaagttgatgggatatatttgattacatgttcgttacttcacaattcgttacataagattatatttcttgtcctgatggagtctctctcttccttgatggcattcagaagacaagcaactttgttggggaaatcatacagcaaaacctgtgggcagcctctaggagctgacagtggcttttggcagatacaaagaagaaactgaagccctcactcctacaaccacagggaactgaattccgccaacaacctgaatgagcttgaaaaagcctcaaatgaatccacagccctgtctgacaccttgattgctttctaagactccaatcagagaacacaactccaatcagaggacacagtaagccatgcctggatttctgacacacaaaaacccacatgtgagtattgttttaagctgagaactttgttgaaatattaataggcaacaatgattaacaaatatacctggaaaataaagagctatcatcagagagtggctcatgaaggaaaagaaaaagcaggttattctttccaaagccattcacaaatttcacaactacgctaacttttctattttgaaacagttgcaatcttaagaaaattgaattatcaggatgatctttaaaagtaatcatttccatgagaaaaatacccaaagagattcaaaatccagagagtatgacatgtgcagtaacaagtttgagagttttttttgtacaagaataatgttgaaataaggtggttttatggtcataagtacagtttttaaactgcaactttaccattaaatggcttaatcaaaactaaccaaaacaaatatactcatcatttactcttcagaatatcacatacctagcttctcagtcaccccatcaccaatggctttgatcctgcagttttctttagaggcagtttacagagccaaagaaaaacaaatgagtggaccattactaatactcttcaactgcacaggaatcacatttcctctattatagcaacgtaacacattggtgatataaagttatatcattcagtgtaaaggattattctgtgatttttagtatatattgttctagatagcaggcataaattgggtactttgttgagaatctgctgcccaagttaactgcaatatcctctttcgttaaatacttcaaagtgtcttaattggctcttctgtgaacattctgggctactcactgaaagacacataagactatacatggaagcaagaatcttagaggaagcattcaggacagagaagggaaaggaagcttgctttttgctgtcactgcctaggcaaatgatagagcttcaatttgctctgagaaagagaaattttgattatactttttagcatttgtccacaaacaagaagcaaaacttagaaatatgttcttttcccaatcaaaaatagaatgttgaacgaatttatctgagtaagggcaagagatacatttcctgactccatagtcaatgaacacaaaataaatcaaaacgtagctccagaaaaaaaaaattggggaagaaattcccacatcttattgaaaaatgatgggaaattggaaaggggctcctgaaaaaaaaaaaagcctggagaaattgctgaagggtcaattgggaaaatgcttattttcctcttatttcagggcaacacatgacagaatcaatgtcatctcaagagattccagtagctgaatggtttatttacatattaaacacaagttggaggaatgagtttggtctttgagtatcctgaattttacactatttacacatcccctcttgaggttttacttagtgtactgtaaaggcaaacaaagccttgtctatccacagaaggactcctccagatcctatgggaaagatccaagagctttgttaaacaccaaatagtctttaaataacaatcttctgataacttgatagtaaacagccatactttagtgatttcctagtaaacataaattaatatactatatcagattatttggaaagatcattattttctttgaaaataaaacaaaaacaaaaacaaaagtctgtaattttgtgcacagacccaacaatctcatttcccatttatgacagaattcagtgaatcatgcttctacaacacattctgcttcagggcacacatctaaaaattaatctttctgaggatacagtaatcatgaccactccggtgtcaattactgtgtatggagaatgtactatgtgccaagtgctctgctatttcattcaatatgtagaaggttattacaacaacccatgaggttgctgtaagtatttcctctaatttttcagataagaagacttgggctgagagaagttaaataacttacctacaatatcagaataaagttgggatttgaatgcagacaatctgattcctgagtaccattgttaaatagcagatattaaaaaaaatgtgagtcagtgttagaaactgaataatatcatcttacatttattcaggaacatttaacaatatgattgcttaatgagattcataattttactgcaatcaaatgctgcaaaactcaactcctgaattagatttacggtatgctgcaagtagatggttaaaaacatgatcacattgtagatatttacaaaaataaatgaataaaaataaaaatttgcactatcatgtttagtagcatggagaatttggtatgggaaggtcaagacaacttcctagtttgatgagttttgtaagatatttcctaattaagtgtgtgaaattttcatcatgtaatattaaagatctctcatatacaattctgcacaaaaagaggtctgaaaatctgaattattttatagtacaaataacacaaatgtagttgaaattagcaaatgtttagtgactattatatgccattaagtatatcaatttcacatgcatccaaactttaattttactgtccaggaggtgacaatatataataataaaaataataataattttaagagtcatgaagtaagtactatatgccagaatgaaagggagaagcactaaagagatggaagatttcattctgacttagttaagatggattcctagagcagatgtcacttggatgggtttttaaatagtagaatttcaacaagcaagcaagaaggtatcaaatggaaggaatatttcattatacttagtaggtaacaaggccccagcagtcagactgaagactcaaacatacatgggctctttggggctaccctccctccttgtatctcatttcataaattgattttcaggcagagcctctttagtggggaaggaacatacacaatgaactattgtgatcaaaacatagacaaatgtgcatgacaaattggtagagataggaggaaccaaatattgaaggaagatagagatagttttccaagaacattcataataaaggaagaggactagcagtaggaagcaaatacaacaaatggggtctgaaagatgaaggaaaacagtggttctcagcactgcattgcgatagggccttgaactcagctaaacccatctagcctaacaccattgtatactttggagtgaaaaagggctgtataataaattgtgtcattaaatgtggccaataatcctatcatgaaattcccctaattggcacagagactctcacttcttaaggtgccattgagttgttttaactgtgaacatagggatgaaatgaaaagagagaagcaaatcacgtaaagatacttaacaatataattccattttataaatctcaaaaatgtacagctacattagatattatgcactatattcttatctggcaaaactatttttaaaagaaataacaaacaaacaaaagcactcattagtggttatcttggggaggcagactgtggtgaagcaggaagaggaggtcatcaacgaggggcactaaaggggcttccaaaaatgaagcaagttttatttctcaagctgagccataggtaaatgggtgattattttattatcattatgtaatctttcatgtatgatatatttcatcataaataaatattgattttaaaggtagccggttttatctttaaatgatatatatatgcttctctaattttgtgtcctactttttattcctgtataatatactctgaaaactttccaatttcattaaaaattcctcagtaaagcatttttaatgtttggaacaaaatctattaaaatagaatagattcatgatatatattgttgggtactttcctaattttcattgctacagtatcagattcatttccattataaaaccagtgactgcttcagggcccacagaaatgggcacaattgtaaattcagtaggctcaaatatatatttttaaaaggctatgtttgtacatctttcttagcctgttggatgcgcagctcactgtgttgaggcagacatctgttggtatgcacaaaaataaaatattgttgtcttgtttttgtatttttcatatccagagaatcaagtcatagcttttgcctgagggagaacctcaagaaaaatgaactagtgtgacgtgtgtttctgccaagcagaaaagaacatggaagtaaacttatctacataaattaggtcagacagctggtccgagtctgcccactcagcctgctaggggagcaaccaagcaaaagttaagattgccaatttgtttcattttgtttccctctggatttcaggagttgatgtagaaaaaaaaatcaggaaggaggaactggagattaatcaacccagggatagtttttgtaacaggggaaagggatcgctgagataaatctagggagatgaaaactgggtttagaatatttgaggaggctttttgttttgtttcactatgcaaatggggaaagagtaaaaaaaaaaaaattaaaaacacacaaaatctcaaaaatgtgaatagtgaggaaaaataatcatccatatgggagtatccgtgacatttgtaaaaattccgtgaacacggccagacgcagcggctcacgcctgtaatcccagcagtttgggaagccaaggcaggcagatagcctgatgtcaggaggtcgagaccagcctggccaacatggcaaaaccccgtctctactaaagacacaaacaattagctgggcatggtggcgggcgcctgtaatcccagctacttgggaggctgaggcagggagaatcgcttgaacccgggaggtggaggttgcagtgagctgagatggcaccattgccctccagcctgggcaacaaagtgagactccatctcaaaaataaaaaaaaaaagtctatgaacactaaaaaaaaaaataagagtcccttgttagtctgtgtctaaaaaagaaactagcactggctcttgaaacaacatcaaggtatcaagctctgcttccttctgtctcataaagcacattgttctgaactaccttgagatatcaaaaatgtgtccaaaaacagttgaaaatctgaattattataactaaagggttatcaggctcaaaggaacctgagtttgagggtgggtcatctatttgcaacaaaatatttagaagtagttgagaatctgtcttttagagtaagtggatcgttgaaaatgcctcctctttttgccatcctcttcacttgggtaacgtccttagcctttttggatttaggctttcacttcatgtgccctgggaagtcattctagacctcattccattaggacctagacatccattactctaagtctgtcactgtgggctctctcttcccgaactaactgtgagctcctgaagaatacatactttgtacatcatagcatctcaccacccagcatagtgcctgatgcataataatatttgttgaatgaaaaatcactgaaatagaaagcatatgtataaaaatgttagttctagtgtactgggattcaaaggatcatcatgatctacacttatcagtcttaacttggaattaccagaaagataggctcagacatctgcaactaatattatttttaaagaataatcaaatattcagacaggccaggcaggaatacacacgctagacaggcttaattctggtgtggcgttcatcatcaaacatacctgagagtcatgacaaagtgagtttggttaagtagatatacgatttaaaagaaatacaacttaactgagagctcattactgagtattagtatgtgtaagaaacttgcatttaaaggtactctgtggcctctgtgtttatgccaattttggtagcaagcccattttattgtaggaagtcactatttcatggatccaccatttaactgggtcacattgggaaaattattttatgcaaatctttaaaatgaaaataatattatgctcatagggctgttaccaggattaaatgtaatggcaaatgcaaatcacctagcagtaccttcgatacattataaaccctccacgaatgacgcttccctctaacccttgagaacaatatgtcagtagcacctacaaacataaaataggatatctcttttaattgattgtaatttccattattatgttatttttgctatggaataggaaactctttatttttgaatttttacactgtttcatatattctagatgcaacatttttgaggagtatgatatgatatgcaaatattctttcccactctattatgacttttcactcttttaacagtgcctttcacagaggattttttttaacttccaaggaaatcaaattataatttttttatgtcattacttggtgttgtatctaacaatgccaaaccaaagtcacaaaaatttatcctatgttttcttttaagagttttctattgtaatttaaagctgttatctaatttgagtcattttttgtatataatgtaaggcataagttgaggttcaatgtctaaattgttccagcaccacttgatgaaaaggctagtctttctccactgaattatcttggcatttccatcaagaattgtttgatttctgaactttccaaatgacctcattgatctatgtgtctactcttttgcaaatatcactcttaattactatagttttatagtgcaagtctcaaaatcaggtacagtggatgctccaaatttgtttgcttgttttgtttttttttttttttttttggctattctggttcctttgcctttccatataaatgtatttttgtaattctttctttagaatcagcttatatatagctggaaaaaaattctgctaggattttgactggtattgtaacaagtttatagatcagcttaggaagaattgatatcatcatcatattgagtatattccaataatggaacatgatacatcactccattttttaaggtcttctttaatttctttgactagcgttttgtagtttctggcaacatataggtgcagcaattatttttttttagatttatacttacgtatatcaatttttgaagttttggtaactggtattcttttataattttggtttccaattgttcattgctagcacgtataaatataatagatctttggaattcacaatcatgtcatctgcacatagaaaaattttattttttctttgccaatatatatgccttttatctttcttttgccttattgcactgactagaacctttaatgtaatgttaaaaaggaccagtgaaataactagccttgtcatgttcctgttgttaggaagaaagcattcattcttttactgttaagaatgatgttagctgtgggctttttgttgataccttttatcaaattaggaaagtccctttctatttctaatgtatagagaatttttattatgaataaaattggaagttcgttgaatgcttttttctgcatctttgatataatcatttgatttttccttttttagtctgttaatatggtgggttgcaataattaatttttgaattttgaacggtccttgcatccttgagataaactatacttggttatacagttattactctatattgctgggttagatttcctaatattttgttgcaggtttttgcatctacgttcatgagagatactggtctgtagttttgttttcttctaatgtctttgtttagtttgatccctcgggtattactggcctactgaaataagtttagaagtgttccatctttttaattttttgaaattatatttaatgtaattccttacatgatgcaatgtttagtagaattaaccagggaaactgtccaggcctggagttttatctcttgaaagcatttaaactgccaatttaatttctgcaacagatagaggacattcaatatgtctctatcttcttcagtgacttttttttgacagctttaagatataatttacataccatgcgagtcaccctttaaagtgtacaattcagtgcgttttggtatattcacaaagttgtgtatctatcaccataatcaatttaagaataagtttatcaccccaaaaagaaactctgcgccctttagccatcactctcaaatgtccccagtccctctaggcaaccactaatctgctttctgtgcttatatatattttcctattggagtctgctatgaaataacattttatattaatggaatcataaaatatatagtgtttgactggcttctttcactcagtataatgtttccaagtattattatacttggaataatgtagtatgtatcatactttattatatagtatgtatcagtactattatactcactttagggctattaataatgatgctataagtacgcatgtgtaagtttttgtgtgggtgtatgtttttatctctcttaggtatacagataggaactgaattgctgtgtcagatagtaacacatacgtatattgtttaaaaacagtctgaccattttccagagaagctgtactattttgtattcccaccagcattgtgtccaatttctccacatcttccccaacactccttattgtctgttcaatgacatttaaaggtacgtgtccttcaagcacttggttcatttcatctagttcattaaatgtatgtgcatagacgtgtttgtagtattttattattatccttttagtgtccatggttctgtagtgataccctgtttcattcttgatattaataatttgtattttctatttctcttcagtcaacaggggaactgctgccaccactacctccaaagtggacttcattttcaaaggctaggagagttaaatgagtttcatcccatacccctaacccctgcttatctgtcctctggcctgagaaagtgttttgcttggaggttttttgtccatgcttggtgtgcacttcccagattcagcttgcagaagagtctaagccaggaaatatggggaaaaaaaggggagtccagggaacatattattgtatggggttatccttcaaactctgatttcctctccagtctgccattactttacagagtcctccaagatttgctttaagtattatgtccaatgttgtagttgacatcagtggaagagttagggaaaggtatacttactccatttttaacttgggttggtgccacaagctacccagtcccacgtatgacttactagtcacataaactgcctgacctagtgggaaaatctactcacctttctgctcatttttctttcaaggacacaatacttgaaggataatcctgaaacattacaagaacctaaagtatctttgcaatcaaaagaagattaaatcaagttcagtataattttagttgtctctaattacatcataatgtaatacaaatattttgacatcctttccaggaagaacatactttctttttaaatttaaataatgtttagattcctacttttgttcttacatcttctacctggtcttctctgacctacaaaacttataaaacttacagttgtattatgctctaatctattcctttttgcccctattcattttgttccttaacatattcctgccttgttttataaaagaatcccactatttaatatatcctcaaccacagttaaacaactgaaagatttgaatcatgctctccttctcagcacttagtttattggtatcctcacagcaagtaaatatcaaatcagttttgactgaagaaacaagtaaagtgagcataatccttcattatattctcaccctaaaatggcagaggggatagcattgcatccagacacttatatgatgagaagctggagacagttttacaggctcctcacaggtaaatgttgatagataggaggtcgtaaaaagggacagaacaggaaagtttgcacttactttcagggattgaagtctactgttttcttttttattatagaaggagatgggggtgagtggatgtggattggttcagaatatgaattatgacttgattagcctctcatttcataatggtggataagaaaaagctggtgatcctaaataaggcctgataattatctaggaatatcaggaattaatattctcctacaattatgttatagagataattaataagctaatttcttaaatgtttagttccagggtagtactccaaattttctacaatttgagtatcctgatttctggattaaatcattcccagacaatagcatcaattaggagatacatgcatacctctgttctgttttgcattaaaggttcacatctgtcatcccccccaaacattcattcttcttgagagaaagaattatgtcttatttattttgtctttattcattatttgataggtacagtgcttgtgcatcagtatagttcaatgaaggttaaagtgatcttctaattgtgatgtaattgcatgccattgtaccaatcatcttactatttttttttttttttgagatgggtctccctctgtcatccaggctgtagtgcagtggcttgatctctgctcactgcaacctctgcctcccaagttcaagctattctcctgcctaagcctcctgagtagctgggattacaggtgcatgccaccacacctggctaatttttttttgtttttagtagagacggggtttcagcatgttggtcgggctggtctcgaactcctgacctcatgatccacccgccttggcctcccaaagtgctgggattacaggcatgagccatcgcacctggccctcatcttactaaatttgttcagcatttgaaaacttttaaagcattatatctatatataaaaacactgaacttttttttttttaaactcagtcaatttctcatccctctatcatgtagctttacattattcaatatctgtacattgaaaataagggtttccacgtgtttgggaaagaggaaatctatgaataaaagttactctcatatctaatcatttgtatatcttcattgtaggaaaggcaatggcttaaagtgaagtcttccccatttttctgtgggaaatagatgttgctcattactgaacaaaaacccaggatgtatttgaatatgacatctgaattttagaaattttccaaagtcaatgtagagataatctaaaacagattatgctgaattttttggaccagtatgtgctttccaggtgggacagggaaacaactctgaggcttacctctaatgtattctttccttctttctttctttctttctttctttctttctttctttctttctttctttctttctttctttcttccttccttccttccttccttccttccttccttttctttctttctttcctccttcctttcttcctttctttctttctttctttcttccttccttccttccttccttccttttctttctttctttcttccttccttccttccttccttccttccttcctttctttctttctttctttctttctttctttctttctttcctttctctttctttttctttctttcttttttctttatttctttctctctctctctctctttcttcctttctgtctctctctctctctgtctctctctttctttctattatattttaagagatggagtctcactccatcaccccagctggagtacagtagtgcaatcatagttcattgcatccttgaactcctgggctcaagtgatcctcctacctcagcctcctgagtagctaggactgcaggcatgcaccttcatacccagctaaattttgaattttttgttttttttttagtagaagtgaggtctcactatgctgcccaggctggtctcgaacccctgggctcaagcaatctatctgtctcagccccctaaagtattgggattacaggcatgagccactgtgcccagccatcaaattcataatgttttaaaccaacaagaatcctcccctccccgcccctccccttcctccctccctccctcctttccttctttctttctttccttttcttttttcctttcctttccttccttcttcccttccacttccacttcccttccctttccttctttcttttcttttctttctctctttctttatctttctctttctttctttctatttttctttctctctctctctccttctttccctctctctgcatctttctctctttctttctttctttcttttttagagatagggtcttgttctgtctccctggctggagtggagtggcacaatcttggctcactgcaaccttcacctcctgggctcaagggatcttcctacctaaacctcccaagtagctgtgactataggggtgcaccaccacacttggttgattttctaattttctgtagagatgagatctcactatattgcccaggctggtctcaaactcctgggttcaagtaatcctccttcctcagccccccaaagtgctggaattacaggtatgagccaccatgcccaacctaaccattctttttgagattagggtagtcgcttccatcattaacctttatcatccacttaccttctgtttctttctttaatgaagtgttaaattgtaccccaccactgcattgagagaatacttttgagtgaaactttattagcctttgtaatatcagaaaagatctgtgtgacatatgcagctttaactaaaagaaaccactggttttgctcaaaacagtgatattttccagcaaatatcacagaggttcatacacaatttttttttttttttttttttttttgagacggagtcttgctctgtcaccaggctggagtgcagttgtgcgatctcagctcacagcaacctccgccttctgggttcaagtgattttcctgcctcagcctcccaagtagctgggactataggtgtgcaacaccatgcctggctaaattgttgtattttagtagagatggggtttcaccatgttggccaggatggtctcaatctcctgacctcatgatcctcccacctcggcctcccaaagtgctgggattaaaggcatgagccaccatgcccagcccacaaaattattaaaaggtaatttgataggccaggtgcagtggcgcatgcctgtaatcccagcactttgggaggccaaggcaggaggatcacttgagatcaggagtttgagactggcctggccaacatgctgaaaccctatctctactaaaaaatacaaaaaattagccgggtgtggtggtgtatgccagtagtcccagatactcgggaggttgaagtgggagaatcacttgaacctgggagacaaaggttgcagtgagctgagatcctgccattgcactccaccctgggcaacagagtgagactacttccccctgccgaccaaaaaaaaaaaggtaatttgataaattggaagctttaaagaatccctcagatagctttgctctgagagttctgtcaaatgtttattttttatacatgaagtagttttacagactaagatgctttcaaatttgcttttcacatttaattaaactgtcatctgtcattaagataactattaattagatgttcttgatatctttttaattctctaaaaaagtgactatttctgaaaaggaaaacatctttaaataaattccttcattataaacttagatcagatgacttagtctttcactatttttcttttggtataaaatacacggtttcttctaccattgtattccttaagcatgtgtaatagcgatacacttcaacaacagaatgaagctgctaaacattaggccaaaaaaatctcctttgctatatcgtgcgctgcttatcatttgaattgttaaaaatgtcttctcttcaaaataattttagtttgaagaaaggacacaaaactggtaaacctagatgctgtggactgaatgtttgtgtccctctcaaattcatgttgaaaccctaatccctaatgtgatggtatttggagatggggcctttgagaggtaattaggtcataaaggtggagccctcataatgggattagtgcccttataaggagagacattagataacttgcttcctttatctttcggctctccatcatgtagagacagcaagaaggcagctgtttgcaggccagaaagagggccctcaccagatgctgatgatgctggcaccctgatttgggactttcagcctccagagactgtgaaaaataaatctctattgcttaatccactactccatttaatttgttatagcagcccaaactgaccaagacaccagattacaataaaaaaaattaaaaacatattaggggaagtgaaaacagccctggatataaaattttgtcagaacaaaatacaaatctcagtattggttgttttctgtgatttatgttttatatattgcacattaacatatttccacttcattcagaaggtaaatcacatgaaatctaaccaagtattgctttactatattccaatccaataataacaacaataatgttaataacttgctatttatagaactaagactatgcagcaggcatttcaagagatctatatatgctatttaatggaaattatcacaaaacctctaagagataagttttattgcccttgttttacagatgacagaactaaggcttagactggttaagtaatttgcctaagatcacttattgttggtaagtattagagctaaaattataatacagcttttggttttaatatctacaaatattatttgcctactaaaccacaataaactaaattgcttagtctttatgtacttctctttcttttgacaaacctgacaaattgttcttgttatatatatataatatatatatatagcaaataattaatttcaaccattagaacaatagcaaaaacaacaataaaatcatttaaaatatggacaaaatgtccaggtgcactgactcatgactgaaatcccagaactttgggaggctgaggtgggaggatcacttgagcccaggagtttgagaccaacttcggcaacacagtgagatcccatctcaattttttaaaaaattattgaataaaaaaattacatcgacaaaacacctagttctccaggagtaaaaatgtataagattggcagaaaacttcttaagaaattaaaaacaacacttttttatattttggacattttttctttggttattttatattttggccattttttctttggttattaaaaagatgtagaattttgacaatttgaaaacagctaaatagcaaataaattaatgcattgtagacaaatgagtcttaaatttatttcttaaacgtttaagtaaaataatgtacagaggaacattgaagatctcctagttaaccctcttctagcacttacagatatggggcccatagagtttaacgtattttcacaattatatcacagtaaatctaaatctagaattttggttttccatatttcctctgtaatgatttctccacatgaccatggcacataaaatgatacttatggcaatggttacagtcctctatgtatgtctctaaaatgatgaaaccatgttgcatgaattagcaacggagaggatttcctcttccacagtattccgtactatcaataatcaactctattaaggatccctggtaagatgtgcattgtattattcatccatttaatatatacatttactgtatgtcaggtcctttgctaatgtttccagtattaaatgtcaggcgagaaaacagggaggggtataagatatatgtgcactaaaaatgtgtagtctctcggaaccaacccaaatgtccatcaatgatagattggattaagaaaatgtggcacatatacaccatggaatactatgcagccataaaaaaggatgagttcatgtcctttgcagagacatggatgaagctggaaaccatcattctcagcaaactatcataagatgagaaaaccaaacactgcatgttctcactcataagtgggagttgaacaatgagaacacatggacacagggaggggaacatcacacaccaggacctctcaggggctggggggactaggggagggataacattggtagaaatacctaatgtaagtgttgggttgatgagtgcagcaaaccaccagggcacgcgtatacctatgtaacaaaactgcaagttctgcacatgtaacccagaacttaaagtataataaataaaaaatgtatagtctatttggtgacatgggaccatatgaagcatatccagagtataagccatttagaagttgtagtaggcagcctgtaacattgtccagtgatatctgcctcctggtattcatgccctattcgcttctaacaaactgaatacagcaaaagcgatggtatgccactttagaagttatgttatacaaagatgctggcttgcatcttaggctctctctctctctctctctctctcatctggatcattcacactgaggtgccatgatgtgaaaaaatataggcagcatggagaggtgcccatttagtgaggaactgaagcctcctgccaacaaaaacatatgaataagcttggaagcagattctttagcctcagttgagacttagatgactgcagctctggccaacagtgtgaatacaacctcacaggagaccctgaccaacaccacctagcttagctgctcccaggttcatgaccgtcagacattatgagacagtaaatgtttgttgtcttaatttgctaaattttagggagatttgctatgcagcataaataactaatatggagaggataatgtctgttgcagttctcagtttttaaggaggcagagtaaggaagctgtaatttggtgggcagctcacactgttgcaggaaaggccataaaaggctgagtcagtactcatgagaaacgtttgcccattaactaatgagatataatatgcatgtcagttaggtgtaatgtgtaagttaaacgaaataaatctttagtcactaaggtttttgagcttggaaagttctctgagaaaaaaccatgattcagcaattctgactgcacaaattctatgctattgtctacatatgtgttcccccaaaattcatatgttaaaacctattcgccaatgcaatagtagtaagtggtaggacctttaaaagatgaaggtcatgatggttctgccttcatgaacagttattagtgcctttttaaaagaggcttgaggaagcttgtttgtcctttccaccacttagaacacatcatctatgagggatgcatcctccccagacattgaatctgctggtgccttgatcttgaatttctccagctccagaactgtgagcaataaatttctgttgtttataacttgcccagactaagatattttgttatagcagcctggatgaactgagatggtctaattataaaagcttactgagcaccttttaaaaagtaaataaaaacagagcagttagcaacaaaacctaatgcaaccacttgcttaactctgtatgattaaggtagatgtgtatgtgtgtatctttgtgtgtgtgtgttctagtatcttcagtgggtttttaaaataaaataaatgagttataactacaacagttacagacggtgttggataattgaaagggtttgcaaaattctatggaaactactcaaggaagacctattcaatgtaagaaatgcaacatagcagaagaaagaatgtgcagcccacacacccgggcctgggagacttgcacacctacctagagtcccttctcagtcacacaggatgtgcttcatctctgaattatgaatcttcaggatatacgtcccactgatcacatagccaagccatgctatgtaactggttagcccatgcgtaagccatcaatctacacacccctaaacattgtaaacaagctgactcttggtaccaacaaggtgatttcaaacttaaacaatgtattataaatataaactagttcaagccttcttattgtggccaaaagtcagtgtcagacctccaggtaatcatggagagttccagcccagctgtaagataactcttttccaaatgatcatttaaaacaaaagaaatcaatcattgacatgttatatatataatacatactatacatatatagttgcaacattacatataatacatatatttatatataatattgtaaatatatagaaacatatgcacatatgtacatatctttaatatatgtaatagatattcaaaaccagcataacagatgtttgccatgtgacactaaaatctggtttcttaacaatgacaaaagaaatgacaaatataggaaatgaacaaatacaaaaagttaagcataagctgatagcagtggaagccgaattttaaaattttggggtcatatagttagattcatgatattctaagcctcctgggtggggactggtagagtaatgcattttacagaggatagcgaattgctttctttatcatgtgactaatttagttattctggttttctgcatctttttaaggcttcttttataataataataataataataataataataattattattattattattattattattattattattattattattattttctgggagcccgctgactttgtattctaatgtggatccattgctttctggatctgctgggcatctgccaacttgccattttattcattacatctctgggttagaatcactatttcagcattccatgtcgtcctatttctgtttttcccatctcttgtttagtttgggcacactttcaagtcatttctcaagaagatctacacaagttacatttctgagttcttatgcacacaaaaaggtttttatttgaccacataatttggatgaatatagtattctaagatcatgttaattttctcatgaacatgaagccattgcttcattgccttgcagaactcagtgttgtgataagaagtctaacaacagtcaagcagaaactcacagctcctcagcagagccctcctgtgcacagtttagatagaggcttttgctgctctctttcatctatctccatgtttccagctgctttctatcttctggatcttttttttttccctgtgataatcctacacccatgcatttgccattaagagtttattcccttttgtgttcctttactgttattttaacgggatgttagactgggactgcgtagttatatcttttcagtttactcttgtgttagctttctaaatagatggaaaagacaaaacaaaacattgttagtaccttgactcaaagttatttgattgtaattgtggagatacggcaaatacattaataaatgcaaataatggaaaaacactaataccgatttaccaacagaagtagctattaaaggatatataaataaataacataggggagatggcaagagaagtacaatattttaacttacttcttcttccctcaaaaataatttcattttttatcaacatccatactttaattcctctttttacataagcattttgaggcatgtggtaagggaatttgtataacctttcttaaatcactacaacctacaatcaacactagactttagaatatctggaatcttaaagaaatactgccagcagtgtttataataaatgatacttttaaaaatccctatatcagcagaggaattttataatataaattgttcatttaactttaactgctacagattttggcagacagtaaaattaaatggtggatgatcaccagaatatattacattttgcaagatagcactgggttactaatacatttcaggagaagaaatctcttcccaggtccttaggctgctgtgtagtattattaagcagtaatactttcttttgtaattgatgaaagaggaagctgtaaattaccatgagctagaaattttgatttgtgaagtgaaaatatatttcagtagaaatcatggcttggcacacagtggaaaccgctttccagctgtctaaagtctccttggctttattcgaactacttctatcctccctgagctggttaactggacacctgatcgatgtccacttgttctgctctcagaattgttcttccaattgtggctatctttagaatatcctttccacctttagtcaagcaatctttcttcattgatgatcttatgatatctagtgtttacagtttttttgtttttctattatactttaagttttagggtacatgtgcgcaacgtgcaggttagttacacataattttttcccaagtgaaagagagctaaatagaatttacccatgcatgataaacaattaattgatttcattgaataaaatattcacatctattaataaagcttgtagataacattgtcatttgcaaatgttggccggctaatttgtttttttcttagcaacaatatgccctttcagcatttgcttttacgtccatgaagtctgatagcataaatgcaatataccttatttcggcaacagctataggtactgctcacctaagaaatgcttaattcttcatttactaaacttgctcgtcttgaaaacgtggcaatataattatacccattgtaaccacccccacccaaccaggactacatctgaggaatcacataaaaattggcatgaaagacatagttgggaagagggtggggatgaaatggctaaagctattgtcaattaagttctgctgcctgcaccaattacttaccaccaggggaaatgcaatctgatttacacactcgaattcacatggtttatgttctctcccaaactagaggaaagaaaatctaagggacataatatcttggtttattctccagcctcagtgaccttgaacctcgaattaagttttacagatgagtatataaaagttttatcagctcacatcaataaatatataaccagacttttctggctatatataaagacccctaaaaaagtaaaattagctgtctttgcagctacaggctattcatacatgaaatagatacttgcaacaactgaagggaattgtttcattagtttcataaatctgatttttgagatgaaatggaagagagaagccttctgccagtttgtctacatttttaaaaacatacactatgttatggtttataaaacattttacagtaattatctttcaaagatacttaactattggattactcagtagacagctatctagaacagagctcctaacagctctggtgaggcatattggtgtgtgttagtgagaggagctttcagatcttgagctccttagctctcaaggtagctgggaaggagctaaaactgcttgataactgcagagcctctgatcccctcgggccttgagcagccacttcttttctcccagtggctgtgcaaacattatgattttattttatttttttgagagacagggtctcactctgttccccaggatagagtgcagtggcacattcacagctcactgaagcctcaaactcctgggctcaagtgatcctcacacctcaacctcccaagtatttgggactacaggtgtgtaccaccatgcctggctaacattttttaattactattttcttcttttgtagagctgggtctcactatgttgcctaggctgatctcgaacacttgggttcaagcagtcctctcacctcagccttccaaagtgctgggattacaggtatgaaccactgcccagcctcaaacagtatgatcttagaaaacactagtctatgctgttacaaagaatgtctcatacttagtaatcttaaaaattagtgaagtcaaagtacccattccgttggatttaaaacaaaatataaagttcaattcagtatcactctacatttgaacaataccaggatacagatgtgttaaattttgtcattgtagttaaagaaagaagaaacctcagtatatcactgaagggtaaacgttccccctttttgaaaacctgcatagactcctttatacttttacatatacagcaaaacaaacattattttatgaagctagtgtcttggccatagaatcatattcacatcatatattctgctatggcatgtcttccctggaatgtacctcaatttggagtggtatcataataccttgtttaataaatctaccagaaataaagcaggcttttatgcttgttttaaaggtttcataaaccatctaaaagaattggctttgcaacaagctgctgaagggcaatgttcttggttgcataatatggatgcaagtagttccattgtcccagtgatgtccaattaagttggcagcatcaatcctcaatttcctttctctgggtccttttgcttcctcgttgataatcatcctctcctgcttctcatcatccccaacttccccctttgctaacagacttcaaagccctttattatgcagggaatatgccagtgtaagagtcttagtgtgaggcagagcactgtctgcaaagaagctcgaaggccaggtactcacccctatgcatgctgacagccaaggtgtgggcacatgatttaaactctactaagataatgcttctggcactggaagttgagtttaaagcaagtgaggcaaaagcagggatattttatgatttattccagtggtagaaccatctgaaatgtggtagcgaataaatgtaccagctgtgtggtccagtgtcataatgttatgatactgttagtggcattaagtgttcagagggggctggaatggtactttgaaaagctattctttgggatgactttaactgtgttcctatatgaagtgtcccttgcagtctgccagttttttcttcttgttctccagtcttcctgtgtttttctgcctaatttagccattcttaatttcagttctttgcaacccagaaccaaaactaatacttaatacttcatgtctaatctttttaaacataaattatttttctattgccttcagcacataaagatccatagagtaaatctgaattagtcattttacagaaatacgggaaagtaggatcagaatgaaagatgtgacctctttctctttctagatgatatcttgtttcccaggagaagatccatatgaggctagtcacaggtgttctagagttacagaagatacaagacctctggaacacctttgcactggtgaataaccacacagcatgttcccattctctggttcatcttccaattctcccttcttttcagcccatgccaattcatctccactgttgttaacccatccttcatttagcaaaaatctcaaagttactgtattagtctgttctcatactggtctcacactgatatgaagaaatacctgagactggctaatttataaagaaaacaggtttaatttattcatagttccacatggctgggcaggcctcaggaaacttacaatcatggcagaaggcacctcttcacagggagacaggagagagaatgagtgcccgaaagggaaatgccagatgcttataaaaccatcagattttgtgagaactcactgtcacaagaacagcataggggaaaccacccccatgattcaattacctcccactgggtccctccctcaacaaatgaggattatgagaattacagttcaaaatgagatttgggtggggacacagccaaaccacatcagttacatattttacatttttcagatatggcagtatctcaacccctctttatgattctttaatatccactcttaagccctttatattattcctcatttaacaataaaatttctatcactgtgtcagaatatattattttttaaaaaataaggctataccaacagtgtcactttagattactccatgtaccatgtcaaaaaggtgagaaaagattttgcatcacacaatacatattgaagattgcagtttttatagcattttcttttttctgacaagtttgtatgttcatttacttaaaatggcaagataagaatcttgccattcttattttagttctttaactggatccttagtctcttaactagatctgggtcctatataaatccagtcttccttggacagaaaatagatttttccactcagaagttctaacagctactttcttcaactcataatgtcacctaaggtcccacactcctatgggaacagaagcacttccacggtcatgagatcttactcttctttagagaggctgagttgtaatttaatttccaactttagaattatcaacacgaagacacacagttatccaggttagccaagtgatctgcagacagaaacctcttgttaatgctctctaattgtgttaaaaaaaaaaaagagttatattaacgtctaatccaaaaggcagaaaggatataatttgaaagcctgttcagactgcttaaaggggaggaaattcgccaacaatggctcccaaatgtgaaagcacagttactaccccttacagggatttgctggaagcattaccaaaattaggttcagtcagatctttcaacagacgtagttcaatgatggttcttgtaagtaattgaatacacaatattcatgatcaattgttcaaaagcttgctaaagaaccttttaaaaatctgaccccaagttttctggaagtggctaagatctaactctggacagtaatgaatcactttcttaatcttttctctgccccatcctttgacacagcccactgtttccaggggttgttttcctcctgaattgggatgacaacctattctcctgcttaactagactgtatcacagtgtaatcttgcagtacattttaaatttaaattttggagaaggacttggtgatcattgatcattgggcccctctgctatgtgtagatgctaccggggaaaataaaaataaagaaagtgtggtgtctgtctttaaggacattacaatctagtgggagaaacttgtatgtaaatggctgattatgatcaaaggcaaagtgaaataaacattaactagaggacaagctcatagtaatacagataatggagcaattaattctaactgaaagggaatcaaaagctcctttgcaaaggtggtggcatttgagaaagtgtttagaatgattatattttaagagggcagtagagaagaaaaggcaatcattccaactgcagggatagaattagcaaagccttagaagctcaattcaagagatttcgttttgggttttgatttttttttctttttaattctaacatacgacacaatggtaggccctgggagagattcaaagaaaaataatatgagtgtctttttctcctgtagctcatattccattttgaaagaaaagccttttttttttttttttttttttttttgagacggagtctcgctctgtcacccctgctggagtgcagtggcaggatctcagctcactgcaacctctgcctcctgggttcaagcaattctcctgcctcagcctcccaagtagctgggattacaggcacatgctacaacacccatctaatttttttgtattttttctagagacggggtttcaccatgttggccaggctggtcttgaactcctgacctcatgatcctcccgccttggcctccaaaagtgctgggattacaggtgtgagccaccacacccagaccagaaaagccatttttatgacagtatatctgaggagttcatcaagagcatatacttgtctgggatgatgtaattgagttggcacgtcccttaagagctacagtgcacgagaacagaaagaattcattattgccaaagatttctagaggacatgaatataagctttttcttgaaatatgcatagaatttgatgtgagaaacaaggggtagagatatttaaaaagagagtgatggcagttaataatcttggcatgtccccgccattgtggaagtattaacttaagtgttgtggaaggtgccttttggcccacatcagaaaaaaaaaaaaaaagttagaaataaaattttaggtgaaatcaaattcctccagagttcaagaaggtaaactgagtgaagaagactggggctataatgagacagagtggaagagactatggcatggtagagaccatggccaaggctcagtgaaaaagaggacaccactaagctccagccaattcccgtgaaaattatgttggtcaaaactccactggccacataaaaattctttgagtcatacctagtatgtagactactaattttcaaacactgccggactgcagagggtaaggactgctagaactaaaacctttagtttttataaatatttaagattgtaggacagagctgcaatgccaaaaaaaaaaagcatgttttaatcaagctacaaaatgcaagatatgtatatgtaaaccatattaaatgaaagggaattgagaggggttaccaactgctattaaagttttttcaaactacgttttaaatgaaatacatcttaaaactctatctgttgcttaaactggagtaaacaatttacaacaaaattttagaaaaatttattggctcaaaatttctttcaactgtctcatttgcctttgagacaaaaaacatgtaactatatggcaattgttcattctaagaaggtgggaattctggatacacactttccagtctcggcctcatcagatacttgatgaatgaacctgtatttgccatcactgccagttgccaacagtggatgccaccaggatatcttggtcagattcatttatgtacctgttctgttttggtccatgagcctggcaaacagtaaaactaggtgggggttggaggtttgcaacagctgctctggggcctgctgattcctgaattttatagcgttcataaatcacacaaaaatgtcttatgtccgtccacttccagtttaggtttttccccaacgtagtacaaaagaactgaagttgacactaagagtataatttgtaagccttcacaatacagtccagaaggtttattatttatttaaaaagctaatatattctatattctctattaagaattcctgacaggaggaggagcttagtaacagggataaatggggtggaataaagaatttcacatgaagattacaatattatgcttctatctgggtgaaatgtagcattccagatgttgactacatttcactagagtttgtgaacaatataaattcctgagatataataggtcagccctgcttcttaatgctgagaaaacacttagaagatcatcaaattttgaaaatgtactaatgagctacaaagtctgattaaaatcaaaggtgctatgttctaaaaaccttctttgtgatttagataagtatggcttatatttcatcatttatgacaatactttaaggcaaactttgcaaagacggaaaagtcttggtaataaacaacaattcactatagctcctcataaagtcattttcagaaagcagggttaaatcctgaagactgtataaaagaaaaggaaacacagagaaagacagtccacagatattactgttcacttgctaaaaagtaaactattaaggcctcataacacaaaacatgatatttccaattatttaatttggcaattatttataactaataagtccaagatgtgaagcagacgcaaacaacgatgaacatctcctgttagtaaattctggaggatagagtagtgggaagtatctttcatagacaatgtctccatgggaaagaaaattttcacatttttcagctttggttaagatcaaactgatctaattagttttctcatctaatttattgctcagaattccttttagtaaggcatgcttttcataaatttcaaagaaggctatttggagaatagtttggaattagacataaacaaaaatggaaagctttttcaaagatacaccaaaatttttctgagtaactaaaataacaaaattgggacatcataaactataccgttacgctaataataagatgctgtttatacataataacccaggattattttatattcattatatttgggatataggacataatttatctagagaattttaattaaaattatatacaactaattagaagaaaacagatttttttctcttctgaatgtgataatgtagccatatggattagctatctagaaaggttattataaatcaaagaggtattaataaacttgcaattaagtgtttaaataactttgtttcattattttctgatctcagagtgattgcaaacagtggcataaaactgtaaacctggtacctcaaacagaattatgatcataaagtatgctcacaagactaacacgattataaaactgagacagaggcaaaatattagtcctcctagattttacctaaccaattcctgataggaaatttttatttgtctaaaaaaaaaacccctgttacattcttcttttacttacattctattctcagaaggtagaaaaaaatcagggacacagaaaactctgtatgtggttttgaccaacatgaaaggagtgcttaaatttagttagggaagagatactgaatgaccagagcacaatcatctttttaaacaagtaaatatattgccataacttattgaaaaagtaactactatgtgccctattgataccggtgactttgaggagtggatatagcaatataaatttaataatatcaagagttttatctttccttaccacattgttagcattgcattattttagaaatatttcaaagagatagtaagaaaattacataccaagattcatcaatgattttgtttatcaacttgctagaaaaacagcaaaactgatcatcaattccctgcaaaccttgctaagcttgccttgcagcatagcacttcagacctagtctctagtgaatattattcaactgttggtttgtttctcttaattcatttcaaggagtggcttcaaatataaaagaaaaattaaaaaaatgactcatctttgtcccttctactcttttggctaaacaatgtgcatatcaaatttcatattccatatgcataacatgaaaaatgattctccaggatcgatgacttaaggttggaatttcaaatattttaggaatcacagatgcaccatcaccctagtgtgaggaggcaatagtaaaaattctaacctgaggatttcacaaattcacaaagggttttcccaggaaggagttctgctatcatgacttataaaaatagttgattgtcctcattgtttttgaatccatatgaattcagacacttctgtaagtttcttggagaaaggttaacaatagtgttaaaatgccatttcactgagggattcaagaactaagcatttgctggctggtttttcgaaaatactaacctgagtgctgcaatcaacacaaaagagtggttccacatttcttatgcaatcaaagaagattatgtgcaagaacaaattgctgttttgcaaacagactgcagatgaaggtaagagcatttctctggaaacgtaggacagacttgctgtgtttaagtaatgtaaacaaaaacttagggatatcaatgatacagttaacagagggtttggtgactatcacatacttgataccatatcagcctaattatatctcctaatagataaggcattaatgaacattctaagtggtttctgactaaggcctgtgggtaatttatataacgcatatatttatagaagacctctttttaccaatgaatatatttacttctcagtgataaatttcaaatcgcataaccaaagtgtgcaagcactgtatagcaatgtatgtcaaaagaagcaacacagactagaatctttcccacatgtatgaatattcgtagctatgtagattcaaataagagaaattgtgcagctgttattggcaactgacttaccagtacttgtaaggaagttaacatttctcattacaccttccgtgtaagcccctggctcgtaactgtccatttcacccgtgacgatgtgagcaactcttgctgcccggcctctgatagcacccgcagcacggtctaaattatcagcatcctggtctcttaaggctatgatacacttgttgacatcttccaagatatggctttctgtaagtaaatgaatcaaattagtttttgcgtgtgtctgtgtttaaaatcatacaaatctagcatattataattatgttaacttctgacttcagatagagtgcacattggaaatggaagactttgagaattataaaaaaattggagacatattttgcttacatccctttattctttaatagcaaaatccatgaaatataacatgttacatttttaagagaaatttgtattgactgcatattattttagattctagttccagtagattagattttagactgacatagaggtggaaattaaagacagtttctagattaaaatgaaaacaaaatatgtgatgatgaaattctacatcgtgaatgaaagcaatattatacagattataaaacttatatatacataagtcttttaaaagatggatttaaacaaatgaattccagagaaagttgcctactctgaagagtgtctcctgacctcatcctctccattctttagatgactaggccatgaagatagcaggaagttactatagcacagtaatattttctttcttcataaaatgattaatactcccagctaaaactaatgaatgaagatgcacaaatatgtggaatatcaacaaacatggtcaatgatatttctaacaaattgaaagaatattaaaagaattagtgttctggcttctggctttatcacatgaatccccacttaatatctttaacgactatttctttaaaacacacacagaaaacaattataacaataagatctcagtaattccagaacatatcattaattctctttctctctttttttgtccctctcactctctctgtctgtgtctctctgtctttctctttcccaatctgcttgtgtatatgtgctgactatgtgtgtgtttgctacaaaggacaattattcttcagttttctttcagagtcacacttccctcttgtcgtccaaaaaataaaatcagtctgggtgtggtggctcacatctataatcctagtactttgggagacctaggaaggaggatgacttggggccagaagttcaagaccagcctggaaaacacagcaagaccctttctttacaacaaaataaatttagccaggagtagcagcatgttgctgtagtcctagttacttgggaggctgaggtgggaggattgattgagcccaggagtttgaggctacagtgagctttgatcatgccactacactccagcctgggtaatagagtgaggccctatctatctatctatctatctatctatatatatatatatattaaattaattatatatagttaaaatttaaatgtatttataaacataacattatttaatcatatatgtattcatatatttcataatgatatgttccggaattactgagatcttactgttataattgttttctgtgtgtgttttaaagaaatagtcattaaagatattaagtggggattcatgtgataaagccagaagccaaaacactaaatatatcctaaatatatacgcacccaatacaggagcacccagattcataaagcaagtccttagagacctacaaagagacttagactcccacacaataataatgggagactttaacaccccactgtcaatattagacagatcaatgagacagaaggttaacaaggatatccaggacctgaactcagctctgcaacaagcagacctaagagacataatttttgaaaaaagaaaataaagtcaaactaccattgaatatggtccctgttaaccttctgagatctggcttctattattctgttatacatattttatgatttccaaaatccttcatgatcttccatgcctctgtcctgtgggcatattagaaccttggcctgaacagtctgtcccctttgacctgcttgctcaactcctactattctttcaagccactaggcaaatgttcctgcctcaggaaatgcatgctgacctcctcattctctacaacaaaaccaactttgttccatgttgtttaggattcacataaaatggtttatgtgcctcaattagagattctacctgtgttttaattatttacttttaaaaatatctctctagtagaatttgaaatatatctgagggaaagaattttatcttattcctcgaggtattctaagtagtacttgttataatacttggcacttgttaggctaacaagaatgcttgttgaatgaatgaatgaatgaatgaatgaagctctcttataagacattcttaaatcatgggctatgaacctaagtgaacacatatctgttatctgaaattagataaatttaacccatattaaggacatttaaagtcacttatattaaaaatattaaacactgaaaaccttcattataaattaactagggctttaacctaatttgcagcattcagttatgaatgtatcattaagccctacagtaaatacagtcatggtccaatctcaacagaaagcatatgtatattatcatatttcccctggaacagaagtataggttggaccttagaaggtatagtaatcatcaatttttaagaagtccacagatgtacactttaatgacacattaagaagctaccattttcacctaaccaagatggccaaataggagcagctccggtctgcagctcccagtgtgattgatgcagaagatggatgatttctgcatttccaactgaagtacctggttcatctcactgggactggttggacagtgggtgcagctcacaaggggtgagctgaagcaggacagggtgttgcctcacccgggaagcacaaggggtcagcggatttccctttcctagccaagggaagccatgacagactacctggaaaaacagggcactccctgcccaaatactgcgcttttcccaaggttttagcaaccagcagaaaaggtgattctctcccatgcctggctcagtgggtcccatgcccatggagccttgctcactgctagtgcagcagtctgagatcgatctgcgaggcggcagcctggctggggaaggggaatctgccattgctgaggcttcagtagataaatacagtggccaggaagctcgaactaggtggagcccaccgagctcaacaaggcctactgcctctagactccatctcttgggcagggcacagctgaacaaaaggcagaagacaactttggcaggcataaacgactctgtcagacagctatgaagagagcagtggttctcgttctcccagcatggtggttgagctctgagaatggacagactgcctccttaagtgggtccctgacctctgtgtagcctaactgggagacacctcccagtagaggccaacagacacctcatataggcggctgcccctctgggatgaagcttccagaggaaggatcaggcagcaatatttgctgttctgcagcctctgctggtgatacccaggcaaacagggtctgtagtagaactccagcaaactccaacagacctgcagctgagggacctgatagaaggaaaactaacaaacagaaaggagtagcatcaacatcaacatcaacaaaaagatcatctacaccaaaacgccatctgtaggtcaccaacatcaaagaccaaaggtagataaaaccacaaagatgggaagaaaccagagcagaaaagatggaaattctaaaaatcagagcacctcttctcctccaaaggatcgcaactcctcaccagcaatggaacaaagctggatggaaaatgactttgatgagttgacagaagtaggcttcagaagtgtggtaataacagacttctctgagctaaaggaggatgtttgaacccattgcaaggaagctaaaaaccttgaaaaaagattagatgaatggctaactagaataaacagtgtagagaagatcttcaatgacctgatggagctgaaaaccatggcacaagaacttcatgacacatgcacaagcttcaatagcagattcgatcaagtggaagaaagggtatcagtgattgaagatcaaattaatgaaataaagtgagaagacaaggttagacaaaaaagagtaagaagaaatgaacaaagcctccaagaaatatgggactatgtgaaaagaccaaatctatgtttgattggtgcacctgaaagtgatgggaagaatggaacccagttggaaaacactctgcaggatattattcaggagaacttccccaacctagcaaggcaggccaacattcaaattcaggaaatacagagaacaccacaaagatactccttgacaagagcaaccccaagacacatgattgtcagattcaccaaggttgaaattaagggaaaagtgttaacggcagccagagagaaaggttgagttacccacaaagggaagcccatcagactaacagcagatctcttggcagaaaccctacaagccagaagagagtaggggccaatattcaacattcttaaagaaaggaattttcaacccagaatttcatatccagccaaactaagcttcataagtgaaggagaaataaaaccctgtacagacaagcaaatgctgagagattttgtcaccatcaggcctgccttacaagagctcctgaaggaagcatgaaacatggaaagaaacaactggtaccagccactgcaaaaacatgccaaattgtaaagaccatcgatgctatgaagaaactgcatcaactaacaggcaaaatagccagcgaacatcataatgacaggatcaaattcacacataataatactaaccttaagtgcaaatgggctaaataccccaattaaaagacacagagtggcatgttggataaagagtcaaaacccgtaagtgtgctgtattcaggagacccacctcatgtgcaaagatgcatataggctcaaaataaagggagggaggaagatctaccaagcaaatggaaaacaaaaaaaagcaggggttgcaatcctagtctctgataaaacacactttaaaccaacaaagatcaaaagagataaagaaggccattacataatggtaaagggatcaattcaacaagaagagctaactatcatatatgcacccaacacaggagcacccagattcataaagcaagtccttagagacatacaaaaagacttagactctcatacaataataatgggagactttaacaccccactgtcaatattacacagatcaatgagacagaagtttaacaaggatatccaggacctgaactcagctctgcaacaggcagacctaatagacatctacagaactctccatcccaaatcaacagaatatacattattttcatcaccacatcgcatttattctaaaattgaccacataatgggaagtaaagtactccttagcaaatctaaacgaaaagaaatcacaacaaactgtctctcagaccacagtgccatcaaattagaactcaggattaagaaacttactccaaacaacacaactacatggaaaatgaacaacctgctcctgaatgactactgggtacataacgaaatgaaggaagaaaaaaagatgttatttgaaaccaatgagaacaaagacacaacataccagaatctctgggacacatttaaagcagtgtgtagagggaaatttttagcactaaatgcccacaagagaaagcaggaaagatctaaaattgacaccctaacatcacaattaaaagaactagagaagcaagagcaaacacattcaaaacctagcagaaggcaagaaataactaagatcagagcagacctgaaagagatagagacacaaaaacccttcaaaaaatcaatgaatccaggagctggttttttgaaaagatcaacaaaactgatagactgctagcaagactaataaagaagaaaagagagaagaatcaaatgaacgcaataaaaattgataaaggggatatcaccaccgatcccacagaaatacaaactaccatcagagaatactataaacacctctacgcaaataaactagaaaatctagaagaaatggataaattcctcgacacatataacctcccaagactaaaccaggaagaagttgaatctctgaatagatcaataacaggctctgaaattgaggcaaaaattaataggctactaaccaaaaaaagtccaggaccagaaggattcacagccaaattctaccagagatacaaagaggagctggtaccattccttctgaaactattccaatcaacagaaaaaaagggattcctccctaactcattttatgaggccagcatcatcctgataccaaagcctggcagagacacaacaaaaaaagagaattttagatcaatatccctgatgaagattgatgtgaaaatccttagtaaaaaactggcaaactgaatccagcagcacatcaaaaagctcatccaccatgatcaagtaggcttcatccctgggatgcaaggccggttcaacatatgcaaatcagtaaacataatccatcacataaacaaaatcaacaacaaaaaacacatgattatctcaatagatgcagaaaaggcctttgacaaaattcaacagtgcttcatgctaaaaactctcaataaactaggtattgatgggacatatctcacaataataagagctatttatgacaaacccacagcccccaatatcatactgaatgggcaaaaactggaagcattccctttggaaactggcacaagacaaggacgccctcactcaccactcctactcaacatagtgttggaagttctggccagggcaatcaggcaagagaaagaaataaagggtattcagttaggaaatgaggaactcaaattgtctgtgtttgcatatgagatgattgtacttttagaaaaccccatcatatcagcccaaaatatccttaagctgataagcaacttcagcaaagtctcaggatacaaaatcaatgtgcaaaaatcacaagcattcctatacaccattaacagacaaacaaagagccaaatcatgagtgaactcccattcacaattgcttcaaagagaataaaatacctaggaatccaacttacaagggaagtgaaggaccacttcaaggagagctacaaaccactgctcaatgaaataaaagaggacacaaataattggaagaacattccatgctcatggataggaagaatcaatatcgtgaaaatggccatactgcccaaggtaatttatagattcaatgccacccccatcaagctaccaatgactttcttcacagaattggagaaacactactttaaagttcatatggaaccaaaaaagagcccacattgccaagacaatcctaagcaaaaataacaaagctggaggcatcatgctacttgacttcaaactatactacaaggctacagtaaccaaaacagcatgatactggtaccaaaacagatatatagaccaatggaacagaacagaggctcagaaataatgccacatatctacaaccatctgatctttgacaaacctgacaaaaacaagaaatgaggaaaggattccttatttaataaatggtgctgggaaaactggctagccatatgtagaaagctaacactggatcccttccttacaccttgtacaaaaattaattcaagatggattaaagacttaaatgttagacctaaaaccataaaaaccctagaagaaaacctaggcaataccattcaggacacaggcataggcaaggacttcatgactaaaacaccaaacacaatggcaacaaaagtcaaaatagacaaatgggatctaattaaactgaagagcttctgcacagcaaaagaaactaccatcggcgtgaacaggcaacctacagaatgggagaaaatttttgcaatctacctatctgacaaagggctaatatccagaatctacaaagaactcaaaccaatttactagaaaaaaaaacaagtccatcaaaaagtgggcaaaggatatgaacagacacttctcaaaagaagacatctatgcagtcaacagacacatgaaaaaatgctcgtcattactggtcatcagagaactgcaaatcaaaatcacaatgagataccatctcatgccagttagaatggcagtcattaaaaagccaggaaacaacagatgctggacaggatgtggagaaacaggaacacttttacactgttggtgggtgtgtaaattggttcaaccattgtggaagatattgtggcgattcctcaaggatctagaactagaattaccatttgacccagcaatcccattactgggtatatatacaaaggattataaatcatgctacaataaagacacatgcacacgtatgtttattgctgcactattcacaatagcaaagacttggaaccaacctcaatgtccagcaatgatagactggattaagaaaatgtggcacatatacaccatggaatactatgcagccataaaacaggatgagttcatgtccttttcagggacatggatgaagctggaaaccatcattctgagcaaactatcacaaggacagaaaaccaaacaccgcatattctcactcattggtgggaactgaacaatgagatcacctggacacagggtggggaacatcacacactggggcctgtcaggggatggagggctgggggagggataacattaggagaaacacctaatgtaaattatgagttgatgggtgcagcaaaccaacatggcacatgtatacctatgtatcaaacctacatgttgtgcacatgtaccctagaaattaaagtatagtagtaaaagaaagaagaagctactattttcaagtatattggcaaggtttctttttttaaaaacaaatgcaacatatatgtattcaacgaatgtttactctgtattcactaaggtgttcaattttatattgtagagctattttcttagtcctataaaagtgaaagaatatttacagtaaaaacaatgtctgttcttggaagattaataatatataatacactatgtaatttctctttaattaaagatgaaatgatagcttgtacaaactattttttccccagtgaattttgcagaggagaaaatatacaaagaatattcactaacaatgaatgagtagtcacctcttctgtagaagtatgatctatatgcccatgaatttattatttaaagcagtgaataaaaatatagcaagaatttttctggttctttttttgtttggctttgcagaaggttgtgtgattactgctcacaattaaataatcctgtctgaggccatagtgttaaatcttgttgaagaattatagatgtaaggtcagatatggaaataaaagtcttatataaacatatgatatgaaaaaattataaataaaataacgaaaagaagctataaccagacttaacccaaagcagctatagtaagaatattagagaagatgtgtaaatgatctttgaaattactaagattaaatatagcacaaaataattagaaaaggttcacaaagtttgtattactgtgacacgttcccattaccctgaatgctttacagaatgctaggaacaactatttgcatgaagctctaaacatagaatgcccgaaaaagaaaatcaaaatgttaggtacctcccacatatgcacaataactaaacattaagcaacttcttaaaaatgattatttctctgctatttatatttctggtgaatttaagtggctaaaagaacttcatgaaggcttgagcttttatgcctagctacacagcctttaaacttttaggaaagaaaaaaaatgccaaataccttgtatacaacttcctactgttgaatctctttagactttgcttctgatggaatgggtttactctttaaacacagcaaaagtcatttggttctctcctcaaaaattttttttttctgaagtagatgcacttgaactcaacaaatgcatcatttttaaaatgaggttaaaagaaagagaatatgttattatagaacaagcacatttagaatattatgttttgaaggattgtcacatagtgaagatttttcttaacagcttcagagtatcagcttaacatttgctctgaggtgaggggtggaatgtcctggtgttagcgtaaatgctgaaatgcattcatttaagagcagacaattggtgaattattagcaatttctatcaatcatttttatagccatcttgagatgcaaagggtgatttctattttgttggaaaatagtaatacatgggataataaaggaattgatgttttactaaaagatactttgtttggtgcaagcttctctggctaactccatcttcagtcaccacaggaagtgtagcacaataaaattttgaaatgcatttttaaaattataattttttctagttgttcagtttcattcatatatatatatggagagagagagagagagagagagagagagagagagataaggtctccttctatcacccaggatggggtacagtgccataatcatagctcattgcaacctcaaactcttgggcccaagtgatcattccacctcaggctcccaagtagctagaactgcaggaactcaccgccatgcctggctgttttaattttttatagagacagggtcttgctacgttgctcaggctgatatcgacctcctcgcctcaagcgattctcctacctcagattcccaaagtgttgagattactggagtgagcccctgcacctggccagttttcaacagttaaagccagaatttaaaggtcaaatctattgccccagggaaagtagaaaacaaacaaaattcagtgaaaacaaaatgttaaatcactggctttctacagccaaagtagaattttataaatctatagtccagagaacagactgaaagtagcagcacattttgtttgcaaaagctagattggttcagaggtaaaagtttctccttttaattcctgaagtgggactttgaatacatcaacagcaaagccttaaggggaagagagtttatgctataatccatcaagcaagaaatgatacactatcaacagtttcctcccctgatatctacatacacaagaaaaagattcagagaagggaagaagagagaaaaagatattaactagtttttctggagaaactgagttataatgcaaaatcgattgaattttctaaattgtcaagattaattctagctacccagtgtatatgagctaagagacttaagctaaatttaattataaaaaaaagtttccatttttgcatacctggctccatagctataaattaaaaacacattacataggcaactacataaatgttcaacaaataaaaacaagaatacagtaatttttctttcccatttacccaacatacatgaaactaaaaagcaaatagaatgcattagtgtgtgagttaattgttgcttatctatgtacttacagaatttgtttgtcaggagtttgactatgatgattggtttccaaattaaataatatcccacagaaagatctaagcaaaaactagcttgagaatacagagtatgcatacagttaaatgtaaaatgtaaagtcccttcttcctctttacctcctaaatcctttcttctgtctcttctttccaaagtcttaatatatgttagaaaatgtagacgatataaaagataaagtacagtccctgtctgcaaaggattcacaatctagtaaccagaaaataaagcactttgtattttattgtcttttattccgcccaatacaatagtcaaaattgtagtcacttggtaattttacaaaagttttgttaaactttaacaaaatttgcccagtttctttgcactgaaagctgcttattctttcgcttttagacagctcgaatttagttgacttacttttgaaaattattgaaagaaaaataaagtccaatattgctatttacaagccaattatcaacaatacttatacaaactctgcagcacttattcacacacaattctatagaagaacacacacacacgaaaaaaaagaaagtcattgaaggcttcatatttctctcaatatgtcttaagtaggctcttgtaacaacttgtgtagttgttaagaaatttatcaaagcttggaaacagaaaaaatggactattgcttgtccttttaatgtcctgttgaacagacattgcaatcaggcccacctggcaaatatctaattctcaaggagtgtgtatctttgttccacttgctattagtgtcgatcaggatattttaaaactctgtaagagttaatgctctttaaaaaaaaatttgatgaccatgtaaatgattcttgttacaaaaagtgttatttttgtagaaaagataatcctaaaggctatagcttcattgctctgtaggacattaaccagttttgtttctaaatgagaaattttattgaaccattctttatctaaattttttaaacaaggcttatcattttagcgcctctcaaaaataaatttttgacacatgctcatgttaaatttgtaaaactcaggctttcaaatttataaaattatccatagactgtacaccttgacttggaagctactgatttttcaattagagtgctatccagaagaaaagatataaagcaaacattttatgttaaatcataaacctacatttaaaatgcagtactacaaagcttctgtaagataacagaggagaaactctaggtgatcttgggtttggcaagaacttttaaaatataacaccaaaaacataattaacaatttttttacaaaaaaatgaatacattggacttcgtaaaaatttaaaacttctactctgcaaaagacacttaaaagaataaaaagatgctgggcatgatggctcatgcctgtaatcccagcactttgggaggctgaggagggcagatcacaaggtcaggagtttgagaccatcctggccagtatggtcaaacccgtctctactttaaaaatacaaaaattagccaggagtggtggtccacacctgtagtcctaactactcgggaggttgtggcagaagaattgcttgaacctgggaggtggaggttgcagtgagcagagatcgctccactgcactccagcctgggtgacagagtgagaccccttctcaaaaaacaaaacaaaaaaaagaataaaaagccacagactggaagataacatttgcaaaacacctatctgatgcacgactggtatcaaggatgtacaaataattcttaaaattcaataataagaaaacagctcaattaaaaaatgagcaaaagatgcgagcagacacctcaccaaagacatacagatgacaaataaggacacaaaaacatggtcaacattgtttatcatcaaggaatttcaattcaaaacaacacatggcccatctattagaatgactaaaatttaaaacactgataacaccaaacactggtgaaaatgtagagcaataagaactctcgttcatcgctgaagagaatgtaaaatgacattttggaagacagtttggaatgccactttggaagaaatttcagcagttgcttacaaaagtaaacatacttctactatacaatcgagcaaccataccttggtatttacccagataaatttaaaacttacgttcacacaaaacctgcacatgtgtcttaatagcagttttatttgtaattgccaaaacttaggtgtaaccaacatgttcttcagtagatgaatggataaactggaacgctcagtcaatggaatgtacaaaaagcgatgaaaaatgatacatcaagccaagaaaagacatgcaggaaatttaaatgcatactgctaatgaaagaagtcaatctgaaaggctacatactgtatgattgcaattacatgtcattctggaaatggcaaagctacgggaacaataaaattcctagggagggtaaaatgtataggtagagcgtaggggatttttccagatggtaaaactattctgtgtaatactgcagtggtgaatacacattaatatacatttgtcaaaatccatagaatttacaacacaaggtgaagcctactgtaaacggtaggatttacataataataatgtatcagtattggttcatcaatagtaacaataaaggatgttcttcaaacattctacattcagtgtcaagtccattttagaccttaaataagcactgttcagcttctaaaataggaataaaaatattcaattacatacattatttacagatgtctaccaacaatgaagtaggaattgtgaacatactacaattttctgagaatataactaagaaaaagtttggtcctattctttccccaagtttctagccttcacacagtaacaccttctggttgtcaactggtttcttggagtttttaacaaatactgtttgagtctctcttcttttccaggcactgtgttgggtaacatatacataagattttgtttaattctcataataattccaagagatagatctgttacatttcatttttatagttggagcaaaatagagcctttgagctgataaatatgttctcaaaattcacaaagttatagtaatttgagtcataactcaaaatcaaggtttatctaacctgctaagtttctataaaaaatgctaaagtctcatctgacttcaagataaggtgattctataattatattattcagctattccaaatgtataatgggaagggaaaatcataggtttaaaatattttctaaattttatagaaatggtacaaaagattgtttatgctatagtaatctatagctgaatgcattataagttttcacattaattttcattgagcataagataatcatctatgcattttagaaggataattttaattctgcaaagcttacattgactatgctctggtaatgttaacattctggatctgtaataaggagccatcatagctagagggaacttcaagtattctagagacatcaccaggaaggtggccatagaagaataaataaacaaatgaagtttagtgccttagctacttagctattctggtgtaggagctaaagtctaagttattgcattttatgccattcttatcctgacaaaataaacaaacagaaaaagtgaaacaaaccttaggcattctcactcagaccatactcttttccatcaactcctctactactgagctttttcatgttaattgtcccattgcttcctctcccacagactgagaacctattaacatctaataacaaagcactgggttaaaaaaaaaaaaaaaaaaaaagaagaagaaatctttcaggatattaccagactgagcatcaggactgtcagcaggaacagacagtagtgagcaattctcccatattatgcaataaaaccattcaagtcttgcacactggatgctaatgttgaatgcctctgttgctcgattgtcttataaaaaaacagtcagtattcaatcgggtattattcctttctcatagttcaaaatacagaacaacttgagtgtccaaatataaaatctgtgcttttggacacagaaaagcaaatcccagtactgtttaaaataaccccctagaggtatatgacacatatagcagaaaagaaaccctaaacaaataaagtacaataaatgcaaatgcacagatagaatgcaaatgtacagataaaattaagaataaatgagttgctgataacctggtaaattttactaagtttttatttattttttcccctcagaataataagtatatacacagctcaattatctttactaccttcgaaaatacagtatctctccacgtgggaaaaaaaggctaacaaaagagaagaagactattagtagatatacgtcttagggaagttcactttcctagtcaatgaattaattttaaagtcaagtacagcattcttttgctgaaattcatttttctcttatattttgctcagaggtgcacaaaaattgtcagaacagatccctctctatgagacaaattctcttcagcatcatttgtaattgcttcaaggaaaccataactaaaaacttgaattttccacaggtatgacaaaggaggagtccatgaggttaaaagcaaacacaaggtatgactttttccatgcccaaatcggtatcattcacaaaatattctgtatcaccctgattgtttttatcatatgtaaattgctataaaactacatggaattggacaacaaattacaaagactaataaaaaaatacaaggcaaaaagatatggcttaaaaggtaccatgttttcaggaattcaatgtggttcatcttacctcagatttccaaaaagtctgtacttattatttacctttccatgaagtttctccatgaacctgccacaaagctttctagaagattctctaacagatcctaatcatagccattctgtaacctctgaacaagatcccaatttcaccagcatcagtaattgttctcttaagagttctctatttcttgatactctctgtaatttttatttatttatttatattgtttcagattcaggggtttcatgtgcaggtttgtgtaatggtgaggtttgggctcctagcatacccatcacccacgtagcaaaaatggtacccaataggtaatttttcaattcttgccccactcctacccttcccccttctggagtttgcgttgtgtgttatttccatcttcatgtctacatgtacccattgtttagttcccacttgtaagtgagaacttgtggtacttgattttctgtttctcagttatttcacttagattaatgccctccagcaacatttatattgctggaaaaatatatgatttcattctttttaatggctgcatagtattccatgcatataccatattttctctatccaatcaaataatagaatacaaagatatgtatttatatactattagctttctaatttaactctgaaagcatatgcaggagccaaaatcttattgaactgaataaactatacttatttagatattaaaagagggatactaaaattcccttttagttatattgaaccagttttatcctaatacatggaatgtaatcaggcaaaataattaatgatgtagtttactaaacttaattttaaaaagtattgaaataacttagtacaattttcaaggattaaaatgttaagagagtaattatattttcgcctcaattataaattgggcatccacatgaaagtgacaccttaggcttctgacatgtattaaaaccttgtaaatgaactcagtttacagcagatctagaaatgtttatgagtaatttaaccacagcttcccaacaattcattggaatagttattaagcattttaaagaaatgagtttatggatgggtagagttagatcaggaaataatagttcccaaattatcaccctcaagcaattccatttctagtaaatagtccccaaattaccatcctcaaagaaattccatttctaataaagaagatgcttttctatgcacacataagtttacagattcatgtcaaaataaaatttaaaccacagctactgattgaagtgaaacaatgattttaatttataatgcaaactaaccattggtaaacacaaataataactttatttaatagaatataacaaaccaatataagcttttcacttataaagtaattaaattacataaaaagatgcttatgacataattttaagtgaaaaaaatcaggctatgtatctattaaataggaccctcatttaaaattcatatatttatttctctacaatatagcatataattacatacattttaagaaaaatatatggaaggaaatttccaaactcctaattgtagttttcaataaatagtggcattatgagtagtttttattttttaaagcattgatatattttccataaaataatattgcatgcagtaatatacatgcattactattgtaagatactattaaaattatactctatccttgattagccattgttattaaacagagaactcttatagctaaggcttagggaactaagcaaactaccatttattaacatttatatattgctgaagtaaatataacattgatacccacagataaagcttaacatccttagttcttccagtattgttttcctctctctctttgcccaccaaatgatagtaattccaaactaatattttctatttaattagtactcatatatatattcacatggtatattcattcattcaatatctctttcattgaataatgatatattcattttaatgagtatttgcagagttcctactacaaggtattttgtgaggtgtagagaaatttcaagataaataactcactgtctttgctttaaaagaactcacagtctagtcgtagaaataagcaactaaagaaatgactccaaggaacatgataaatgccataatgtacatgggtaaacaatgctagaccatttatttttccaatgacatacttactttttccacatgtgtacatcattgcattatgtaccgtgagttgtcccactgggatcagactgatcacaatgtgtatatcttggtctttatgaaaataattttttaaaagtttattgtgtatttacaagttcctgggtgattgtgggagtaggggtggggcaattttcccatcaaaataataagtatatgtttaataggcattgctgacaacagctattaagagtttgaagacaagtaattgacttactgtgagagttattactagagtaatatttatataaaagatattttagtaagagagttttatgttacataaccaatttacaaatattattttatcacatggcttattgtttatattctctttcttttctttgcacattttaagtattttcagttggctctttcacaacttgcaaagtacaattcgtggcctttgtgtacaagatttcagttttgtttagatcagatttatgaaaagagtggcatgaaaattaaaaatcttccctgttaaagataggaacaccaatagttctcttatttcctaattatgtgctcaagaacaaattttttgtctcatacagaaacttggaaagtgaaaattggcatgaatagcagtcatatgcccagcagttacaacaattgcatgggatcagtgtaatgtatctatggtattgtatttagaagaaattcttgccaggactcaaacatgatgaaagacagtaacgcatagaacacacaaccatataataaggatcacagtaggagaaaccagtggacgtactgtaatgaggccagtgataataaaatcaggaagaaaggtaacatgacggcaaaaacactgatagaaatgagaggtacagtatggaaaagatagataaaacatgaaacagaacacttttttttagtgctaagactaaattaaaatcagagaaattataatcttctcttttactcaattcaagatcttgaatgaagatatgaaatttcttttaaaaatgcaaagagtgcagttagcctacatagcttattctccttttagttctaaacctccactgtcagaccatctaatcaaaccatcttgcacaaattcagtgttattatctcagcaaccttgcctggaaggccattccttgcatttaagcatctctgcatgaaaaacagattcacaacatctggtctgatttccttttactttagttttcattttgttgcctctttgattttatttccttttccaatcatgtctgttgaactgaaaatagtaatttcactgatatctatgttctttatttcacttcctatttttagggttagaggtctaccctgttgcttaaggttagatgtaaaataataatctgggtgactataattacccttgctttcttcatacaatttcaaatgttgacataagctttgttttcttatagtattattcacaccagacacctgagttaaaattgactgtgaatattttctcaatgctgtgtatccatgggctctgatttattttcctttcctgcatctggttgcctcttgtgtcttctgcactagtgaattttcaacattttaagaaagaaactgatcacttagaacaatattattttaacagaaaaaaaccacaagagatatataatattatagcctgaatgataaacataatacttgactttgacagtcaagagtaagtaaatgcgtgcatatggcaccctacattccatcctaatttattctgtggtatatgcgtgtgaagtgaagatgctatatattataaaatcacattaaaggaactaaataagaactggactatttttctcacacttactctgtcatcagctatcaaagccaaaatgcaaaattcctttgttccttatcctactatacagatctatgctgtcatctaaaaaacattgctgtataagacctaatatcattatattttcaatgaatagttatatgtagtgaatttaatcatgttccagtgatactgctttctctataactggcttatatgacatatgttcagctctttaagtgttaatttttataatttgctgtcaggtgccaagaaagaatatatcccctgatatggataatgtcacttctctgtcccaacaaacctaaatttatgccacttgtttataagttgtttatgtcaaaattatctccttgtcaaaacagcaaacttagaagatgaactcctaaatataataataatttacaatggcttaaaaaaattaagatcctaaaggcatacacatatgcatattcacacagacatatatgtgtgcatacatacatatgctttttatagcctattaaatttagtatttataagaataatcctgaagctaagaagctgataaaaaatgaaaacaaaacaaagaatcaaaacatgtttacaaagaaaatataaaaaatagaaaagaagaatacaaataaaccaaccataaggttcaagagaattaccattaatatcctacagatttgtcactatgctttctggcagccaaggcaaaagagaaacataatctgttggaacatgagataattagtaatttttatcatttgctttttatgtaacttaaatattctctttgtcaagctcttttgccccagtggatagctttgaagagcatatattataaatgggttattgactgaggggcctaatggcaaatgaaatcaatatacccacactaagcacttcaagctgtcgatattggcatgtgtgagaaagagtgatatatatagatatagatatatagatatatacacataatacacatattcataagtggcagctctatttccacctctctcccatgtcaattctataactgcatgtcataggtaatttggaaacaaaatctctggtagctttatccctctcttccctgctataatataaacttgtctcatcaagaaatgtttgagctgactcactttacttatttctttcaatagatagatagctatatctatcaattttattttattgctgattattcaacttttgatacctattttctcttccaacagcttcatataaaatcaaggaactctttgacttccctatgaatgaatatgccttactagtataattgggtgtgtcatatacaaagacaacacagacatagaaataagcctggtacctactgtctgataagtactgggagtattctgaattggaaaatggggactatgatcattctgaaaagaccacaggtatgtcataatatagagaagcaatcagataaagagaggcattaacatatagataaattatgtggccttattgttgtttgactaaattatgagtccttgagtgttgttttggctttgctgcttaccagttctataaacttagatatagtgttaaccataaacttgcatttcctcattaataaaatggggttaataagatttacagtctctgagacagttgtaagaattaaataaaaatatacatatagtccgggagcagtggcttattcctataatcccagcacgctgggaggctgaggcaggggattgtttgaggtcaggagtttaagaccggcctggccaacgtggaaaaaccttgtctctactaaaaataaaaaaattagccatggatggtggtgtgtccctgtaatcctagctactccagaggctgaggtgcaagaatcactgaagtggaggttgctgtgagccaagatcgtgccactgcacttcagcctggtgacagagctagactgtgtctcaaaacacacacacacacacacacacacacacacacacacacacacagcatagtagctggcatttagtaggcatgcaaatattgattgaattttgattttacttttgcaagttggttccatcattaaattattccatttctttcttttttttttttttttttgagatggagtcttgcactgttacacaggctggaatgcagtggtgtgatcttggcttactgcaacctccgtctcccaggttcaagtgattctcctgcctcagcctcccaagtagctgggattacaggtgcccaccaccacacccagctaatttttgtagttttagtagagacggggtttcgccatgttggccaggctggtctcaaactcctgacctcaggtgatccacctgcctcagtctcccaaaagtgttgggattacaggcatgagccaccatacccggcctcttttattttttagtggtaaatagaaatttagttgtaaatagatagctccaccgatagtgaggttaaaatgctcaaagtggaaaatgctcatgagacaaaataataactgatttcatctcacatgaatgtgaaatacctcagataaaattcatttgttcaatataatggttattatttcatgctgtattttatattactcataattcaaggaacataagaaagtaatcactaacccaacagatatacaatattaaagagactgtactgaattaaattagttgcattttttattatgagaaccattgattagatgcatagagtttattaatcctctggctgttcaaccctctttacctgtatatttccctgctgactgtgatttccttgaggaaaaacactttgtcttcttcatttattaaatgttcagtaccaaaaagagtgtcaggaatacaataagcgttcaataaaagttgttcaaatgaaccaatatcatacattggctttttcttacatttttatttcattaattactttgtaaattattttcagtttactcatatgtcaatatattaacagttaacagagacctgaaatattattgagatagagcagggataccactttttaaaagcctatggatctcaatcatggacataaagacaaatgctgagtttctaggatggaaattctaggaacctagttagtcctagaaataaataaggaaaataaggaacttgttaaacaagaagataatcgtagcctaaaacaacagccaaggaagttagagttccagagatgcttgctttctgcatagaaacttatggtaacatcttaatgtcactgagttgtctttcagaaacttggacccccacagggaaccccccacctaagggatccactggcatgaagacctcagataaggggaagtgaagactgaactttaatcatcatatttgttccaagttttttcccgagggccttggagaaagtcactccccctacctagttaacatttttctactcactccaattcttaaacaaacttctctgccttaaccaattgcaaatcagaaaatcgttgaatctacctatgacctgtaagcccctgcttcaagaaatcccacccttttaggcctaaaccaatgtgtaacctccatgtattatttatgattttgcctgtatcttctgctttcctgacatttacccttgcctttagacaaccttgtgtgcaagccatcaaggagatcaggatttgagcatttagctgcctggtcctccttgcttggcaccctgcaatgaaagcctttctttctatcactatcctggtgtagatatctggtatattagtccattcttacacctctataaagacatacctgtgaccaggtaattgataaagaagaattgtaattgactcacagtgccacatggctggggaggcctcaagaaacttaaaatcatggcggaaggtgaaggagaagcaagcacttcctacatggaggcaggagcaggggcaactgccaaacacttttaaaccatcagatctcatgagaactgactcactatcatgagagcagcatggagggaactgcccccatgatccaatcaccttccaccatgtccctccctcaacacacggggattacaattcaagacgtaatttggggggagacgagccaaaccatatcacctcgttttactgcacagggtgagcagaccccagtttggtcctaaaacggtatttgcaagacagctactgtacaatccgcttcattaataaactgcccttgcaaaatcatgacagtaagagaaatctgacatacttgactccatcttgcttctgacctctaagctgtgcttggtcattcctgggcatcagccaagctaactttgcgaggaatttatagtttaactttgaaacaaaaatgataatattccttccctaaaactaactcctccttgtttggagactgaaactgtctttgtaagactgagaggccacaagatagatgtaatttctaaaatcgcttactgatcaggagttatgtggtcaggagtcaagatttgtgaccttctcaattgctcctacagataacatcactactgtagaacctcagatttttttttccagatgtttttcagactaaccccaactggactcatgactcttgaatttactggtcttgtggcctcactcagaggcagactcagtacctgaggaccgttttctacacctttatgattttatcctcaaccaatcagtagcacccataacctaaatccttgaccaccaaattgtccattaaaaccccctaacttccaagccttcagagaggctgatttgaccaacagcccaggttctcttacatgggccagcttcaggtcaattaaactcgttcactactgcaatgctgtggtctcagtagtttgattttgtttgtgcagcagacagaaagaacctgttacatgattgactaaactcctagcgcatacttattgagattctattgtgtgctgggcacttggctaatttcaaggtaaagcgtaacagtactttttaatgtcctgactgtcttgagcttaaagtcctttaagagaaagagatattaaattaaataataagtataaaagtaacaacactttgcctaatgttattttagagaacaacttatgaatacattcacataagatgtttaaataagacactttaggtcagacttctccaacctgcagccctgtggcccaggacagctttgaatgtggtgtagttcaacacaaatttgtaaactttcttaaaacattatgaggtttttcctgtgggttttttttttcacatagtctatcattagtattagtgtattttatgtgtggcccaacacttcttcttccactgtggcccagggaagccaaaagattggacacccctgctttagatccatgaaaaatggttaggggcagaacattccaaagagaggggagatgtgggagaagtaagcgtgatatcctaaagccagggcgagtttggtggaattgtataatcatctcctgcctttgccctaaggccagggtgagtttggtaggaagaaatacagaagagttaagcaactatctaaaggatgctgtttcaatagtatgatcaatcagagtttaacattataatggacacagaatgagtgtctttatacagattccagtgaatttatttggactctaaaaatgtttagagtcaaataaccatgattgcactccttgctacacagctctggcttagatctaatcaaagtttttgatagactgcttgacacagaaaactatggttgtggtgttaaattatgtgatttatattaaataagtgacctgatgtctagaacataatgtgttctcaataaatttatttattaacaataaattgcgttaatattccaactaataaattatttaagaaaaatatgtcgaatagagtgctaaatgattgtagtcaactaactttaaacagtgcatctaatttcagtgtttcctttttaagattggctcaaaatgaggtacactgacccccatcattgccatttgcattcatttatatccagtgttcttctcttatatatgagtaatataagaatcctatatatctttctaacttgaaaccacaaaaacatctcctgaacttttcctctggtggtttgctttgggtagcactaccaactcaatttcctattcttttgctgcatatcatatttgagccatacatcataatgtacttgactcagatgtctggtgttcctgtcctatgctgcactagcttgcaaggtcttgctttttcttgacaacctgcctcttaaaacagatttcaaactaaacctcctggttttgtaatttgatccaagtctactcccttggacagaatatcagtaacaggatttgccacatcttttcctttcagccatactgactaccagggtggaaatagtcatattttgaaagcagcatcctttcagactgctttgtccgcttatatatacattttaactctttagtttcactccacagtggaaagagagaggcaaaaatgggtttctctgaaattgctatcagcagtgttatctctcttcaagaagaataaaaaaaggatcttattaaatggcagttaatgacaatgaaaaaagggatctgagaactaatgaaaataattttgaggaatattctctaactatatgcattatcttggctcccaaagaagacccacctccacttttgaggaccatcatttagaatgggcatgaaacataactcagtggtttgatgaagaagtgatgattgagattctttcatctcttcatttttaggcactgtttttcatcaccaccacaaagaataagaatggaatacaaaatactgtgggggtttttatgttcattgaaaagctttttcctgtccaaggtacttgttctataagctttcttgctgcctggatttccagtgttccaaggaaattttcaaaatgtatatgaatttgttttccataccaatgcctgagtcttaaaccaaaaactatatgaagaaaagtctttattgttataataataagctgatgttgaatacttgtacatccaaggaattcttcatatattattagttccattaatcttccaaatgacacaaagagataattagtatcattaccttcattcttatcaaagatatagagacaaacactaatcaagcaacctgctcctagttcaaataccaatatattaagtggtatagagttaggattacatctggacaattcaactcaagagctcttgctctaaaccacttctccatgctgccactcttgtataattatgtcattataagaatatagatagtataatgatatagataatttttccatgactatttagtgaaataaccatacttatatcttcctcatagcaaaagcagatcatttcgatatgttttgatttcttaagttttaaaaggtttctgaataaaattttctttcaaaggattttatttacatagaactaattaatttacccttttattaaacactatgaattttctcttcaaagggctcctctgatactaataaatgcctatcctccgactttccaagaatatcaaacaccagccaacagatttatgtgatagtggaaaacacccaattagcttcggtagaatgctttcttaaaagtgcatgtattctaaccttgtagggaatttaaacaactgtgcttaaaagaaaaaaaaaaaaacaggaaaggaagatttgagtcaattcatcatttttattatgtactctcaactcgacccaaaacacatctaaaaaaacctatattttagtgacatttactactactttgccactccacttttaaagcagcctatgtgaatatcaagtggatgggcctgtttctgtacaatatcacatactataggagaaatatctagcaccgatgataataataataataatttaaaaactctgaacactgctgtttgttagattactccagatatttgaatattccttttctttcttagttctttaattagctgtggctttgatatgagacatatatttatttgaagctaaaagcccactttcacaacttttacatattttttttttttgagacagagtctcgctctgtcacccgggctggagtgcagtggcatgatcttggctcactatcacctctgactcttgggttcaagcgattctcctgcctcagccttctgagtagctgggattaaaggtgcccaccaccatgcttggctaatttttgtatttttaatagagacggggtttcaccatcttggccaggctggtctcgatctcctgaccttgcgatccacccgccctggcctcccaaagtgctgggattacaggcgtgagaaaccacacccggccaacttttacatatttttaaatgttttcattcattatttgcagttctgttctaacgcataaattatagtccttcctggtatcaatgcagagtttgttctacaaccccaacggatatcaaaatccacagatgctgaagttcctggtgtaaaatggcatagtatttgcaaataacctacgtgcatcctcacatacacttgaagtcatctctaaattacttataatacctaataaaatgcctacacatagcttcatctgcacagattcgacatagtactcaatgtacagtcaaattcaagttttgctttttgaaaatttgtaaaatttttattttcaaatattttttatccttagttggttgaatgcacaaatatggaacccatggatgtggaaatccagttgtaccttttaaatctccattttttatacaattcttattttccaaatggtggccttttttctctccttcaactataaaattatagttcattaaaccatttatttattttcatagagtatatgtcatattttagtcacaaaacctcgaccacatgacagaaggggcacctaatcattctcattggcacacaaggtcttgttaaaattataaagtagacaaatattctcttcagtatccttctatctttatatcatcttttaatgttccttcttccaaacccaaaattttaatcatccttaagctgtacaaagtatcctacctaggtcagccataaaggtcttcctgatatataaatattcctccaactttccatttattctttcaataatactcttactctttagtgaatatagccttggcaatcaatgtttggattaaagaaattcacactaaaatgtcaatgactgtaattcagatgtctaatgagtacattaaacattttaaaagaacagtgtataaaacctagctgaaatgaatatataatttatacactggaatggagagatatttttcaattggagagttcttcatactaatctttttctatatgagcaggccacaaccacacatatctcattttcttgacagaatcctgatggcttaagttgaactagaatatttgaaataacttcaaagagcattggcatacttttttgctaataggtacagtataccaaaacaaaattattaaatttctggagttatcctatcagccaaattatttttctatcaagtccacttctattgacattttctgggtattctacatatctctcatattccaaatagtgaatctgcctctagaaatatggctaataaagatggcttcaaatcaaatagttaacctgcctctagaaatatggttaatgagggtgggttcaatgggaaattcctgggaaagtctgagcaatgagaagtggtcaaagagaaattttgggatttgagaatttagattgctctaactttgcttcatgtttttggtctacttaacatgccttctgaattttcacttcacctcatctcatcctcttcaatctaattctacagagaattttctaactgttcccaaaaaaaaaaaatgtctttttaagaaggatagagatgaacttgggaatcttcttggttcaatagttactgtggggaaaccaggagagataatataatcataataaaataaatatagccaaacatagtggtgcagtatgatgaatatgacatctattatcaagtctgattttgtggaattttaaattggaaatgctttgggaaatccagaactcaacggatatactctgatggcagtgagaccataactatacaataggtcacattgtcttctagctgaaattactaaagagacatttagtttatgtattaaacacaaaacaagacaggatcgataatatttttatagttttaatagttaggtcaacatctagaacttaaaatgcaacatttaaaaccaagaacctgattatatagaattagaaaggtacaatcagggaccttcacttattccttatttttctcctaaggaagtcttttagagtgttctgatactgccagttctgctctgggaaatctccatactcaggaagcaccaagtgccctagacctttcccaattctctctccctaccagttgcgttttctactccttcagtggcctggcttgctccactgttattctgattaagtaatctgtgctaaaagcaagcaataaacatccagacaaatacatctatatttttaaaaggactttctaacatgaatgctctaattacaaaatgttgcagtaaatctattcaggaaagctttataagtaactaaatacatttaaggatggctgttaaataatcagatcaaaaagataaaaaagatcagccttgaccttggaacaaaactttggtagaataattatctttcaggtggagtcaagattgcagaccagcctgctcttcacagagtattctaatcttcagatagaaacactcactctcttccctctagtagttccatcatactttagtacctactcaggcctacttctagaaaaaccaaaggggcatttatttggtgaactttgcaacccagtaccaaataaagagtatgctagtcccaccctgatgttaggccctggtactagcaaacctaagcttctgtgccttggccccacgcttttatcatgcacaactgtttctgtggaatagagtctacctctgatcctcagtccttgagatgaggcaattctaaatactgattgccccccactcctgacctttccctctgcctttctgcatattaggtgtatattggttctctgtcactgggtttcccctgccttctagaataatcataaataatctttgtcaggaccctatcacagatcatcttcccatcttttgcctacttctcccattaccagacacaaggctccatctgccagagatgtactgttcgtgtttggaatgcgtgctgtgtttctaaggctctttctcatcctggtgttggtcataaagtgcctgtgtctcttaaaacttacaccattagcaagcatttaaaccagcggaactcttaaaggcaattgagccctctcaatatatagaagagtatagagatctaaagagtgaagtgaattacccaagatggcataatatgtaactggcaaagctgtgattagattaatttgaatttcaacattcaacacatatttagcttctctcaacttcaatttcttctgtcaatttgaaaataataatgtcctatttgctaacagtgtttgaaaattaagaaagacatgttaatatgcctaaaattatttttctggcataaagtaggccttgagtaaataatgtgtcctgtgttcacattttttcctcacatctttggtaaaatcattgattcttaaagtatagaccagaatattaagaaaaataatataaagcaagttatgtttaggactaagttatctaaatgcttactgtaatggagctattcagtatactcctttaatttattttgattttgtgtttttctttgattttgtttttccttctggtacataaacactatcaggagataacatttttatcattactatattatataaatatttttagaaactattgtcaatatagtaattatgaatatgataattaccatgaggtaattttttatataaatatggaattcaaaaataaatttaacaaatatttataaggtttaccattggataaagataatgtgggtgcttgagacacagtgctgaacatgaaagacaaagttcctaagcaagagagtctacattttattaaaaataaatgatgacaaaccagcaagtagataaggactataatttcagacagtgataaatactgtaaataaaataaaatgaggaaaataactaacaacaaacatggtggagttcaattttacatgagtgtcttttagattggttctgagacacagcttcttgtatgaagaactatatgcagagttcctccaggaaacacacccaaaaggaaatgaggaaggaattgtgcaaaaagagaaggtgacccactgagccctcaaatgacattccgaggagctctgaagcctgtaaggattctaccaaattggggcaaggagatgacctatccccatctccgtcagtcgctgatgaaagccatcacttgaaagggtataactttgggcctagaagtttcctacggcaaaattgtggatccaagtacaagagtaattatcacaatagaacatgaaatctaagctgagtaagacaggaaacaaaaacgtgaggaatgaaaaacatgcattcgatattccagcaagataaaaagctaatttggcatgaaggattagagaatacataatcagaaagataataaagtggtggtcagaaaatagcatcttaaaagagagattctggaaaagaaaaatatacttggaataataagcacaggaatggctgactacaataatgttgaagaaaaagatcattaaaaatgaagaggccacaaggttgagaggccaaggtattaaataggttggtggaacaaatgtgagctgcacagaaagatagcttaaaaagtagtagaagggaaatcagagagccaaatactattttttttttttttttttttttgagacagagtctcactctgtggcccaggctggagtgcagtggcatgatctcggctcactgcaagttctgtctccctggtttacaccattctccttctcagcctcccaagtagctgggactacaggcgtccaccaccatgcccagctaattttttgcatttgtagtagagacggggttttatcgtattagccaggatggtctcgatctcccgaccttgtgatctgcccgcttcggcctcccaaagtgctgggattacaggcattagtcaccgcgcctggccccaaatattaatttttatttaatgtgagccagtatcttttttattgttcctggaatattatttggtaaaacttgaaaaaaaaatgaattcaattaccaaatagtttaggaaacacttaggtgaaagtcacataggtgtaataactctaggatttcttgaagtgattaacactttatattaattttaagtatccaaaagaaagataacatacatcaagttttataaaattttcagtgattatatcacaggaattgcaatataagtaacatgttgaggaaatgctaataattcagagtagcaggtcacaagtctttgaaacaggatacaacttatgagtactctatcttgtaaatgcacagacacacacacattgtatacagttttatgtagttagcacaagtcttggtggtaatccatagagcctacattacaaacctctactctccattcttgctggtaatatctggtccatgggtcagcactattggcaccccttgagaacttgttgtatatccagaatctcaggtaccactccggatttactggataagaacctacatttttaaaagattctcagatgatgtgtatcacattcaagtttaaaaagccctgcactagaaggttacatagttaattttcacactcacaaagaaaaactgttttacattgttagagaattactatattttcaaacagtgttctgaaatgtctctgaatatttataatgactcaaattggccttaaaaacaggtgggaattagctctcttaatattttgtcacttttataaaacaaaatatggtaacatggtattaactattaattttatagttggtacaagcaatagagcttgaaaaggtattttcttgtgtcttaataccactaatgtatgatttataaaggcatggaaatacaatctcaggagtcttaatatttccttagaagattaaacagccatgtaaatccattatccagaaggttagacataaatgtcagttcctgagtgtcccacaaaggaaagtgtggattcttaataacagagaggacacaaggtctttccttgagagatttatgtctgatcacaatttcccacgtttaaatatccacaatcaacaataggtacaactttgtttgccaaaaaagacttttaaaatatcaaatggggagatacagaaaagaatataggacaatattttctgtgcattaaatcttcacagataaattctactacttgatataatcagtccagtccttccttccttacagatatatcttttaagagaagaattagtaattattttattctcctaaatttattcttcttttttgtttgtttattggtgaaacaaaaggattattaaaacacttaaatatattagtatgtttaaaacaaatgctctggttaggtaggttagttaggtagttcaaaaatgggttttgaaatgggcaccttgggaggcttcaggatggctgactagggagcattttgtacttgctttctccactaaaaagagctaaaatacccagtagatattagatcatccaagagagaacactggaatccaacaaaatagtgacaggcaatatctaaagtaaggaatgggagaaggaagcaagcagcctgttcagcctggattgactgagagcctagagagactccccaatagagggaaacggtaggtgagagatgctcagcagcctgcattttcatcatagactcctatagtcctagccacgggagagtcctcaatactctcaggccatgaaactaacatagggagttgcaagaagattgtattatggcagcttcccatggaggaagcttgaatatggtcatggtccttcacattccttgtgacctaagcaactacagcaagatgccattttagaactttgcctgcaacagactgcacactgtcctggaacccaggaatgctgaggctaatgtgcaagagaagcattaggctgctgctcccagggcttaggcacaagtgaccttgggccactacactctgatggagttgcaaccagggtatgggatgccatctttaggactgaggtgccagcaaggtgccattctagagcaccatccccagcaaactgcacactacctgaagcccagtggtgctgaagctgaggtgcaagagaagtgatgggtactgcctggggtttagacacaagtgaccacaggcttctccacccaaggctgagcaagggtgccaccaaggctgtggtgcaggtggcatgcatgctccccacctgctgtcctaggccatcatcactgaagctggtaccaccctcaacccccactggcagggcagcagggcagctactatagcctcccactcaagcattccacaatgacttggggatcaccccgctcctgactaccatggccagtgcctgtacatgccatctgggggcctgaagataagccagcctagcccaggtttccccatcatccccatgccacagcatacagtccaggggccagggaatctcccagtttagttcaccactgatgacatatgaccactcctctcggggacctgaggttaggcctacccacacagcagctactaccacaaattaccacctgcaggcctggacactgaccttcccagaacattacagttacttccaatgacagcatgcaccacaagggacctagagggttgtcacaccactgccactcgcattgcctacgccatattagctgcccatggacccaagaacccacttacctgctcagttcacagctgccactactgggctttgagtaagccacctgaaggaacaaaaattggcccacctgtatgacattatggggcatatgagcaggcactctcagcccactgctgcaaccacaggagctcaaagactggtccacttgacctctgagtcccaagcaaaactgcaccagagctttcctcaataactggaccctaagccaccaaggaagtctcagatatcactggcactgtttgtagccaaaaaaatcaagggagactacactaattcatgtacctagaattgaaaccagagttccccacccaaccaacaccacagattcttcctcaaaaaaagtccttccctgtgaaagcaaattgaaaaagttagaagaagcaactgctacatgagatgcacggatatcaatgtaaggacacaggaatcatgaaaaagcaagaatatatgacagctccaaaggagatggaattcataaaatcctagtaaaaattcaattattgattctaaataatttcagtgagatataagagaattctaaaaaaacaaaacaaaggaatcagaaaaacaattcaggataagaatgagaaatgtaacaaagtgatagataacgtagaaaagtatcaaacagaaatcctataaatggagaatcattgaatgaattacaaaatacatttaaaagcttcaaccatagactagatgaagcagacaaaataatttcacaacttgatgacagtgttttataaataaccctcagacacattttttaaaaaaaaagaatgaacaaagccttaatgatatatgggacagaaaaaaaagtgataaaatatataaattattggtatccaagaaggcaaagagagaaagagtttaaaaacctatttaatgaattaatagaggaaaatttcccaaatctagcaagagatttaaacatccagatacagagtcccagcagtcaccaaacagacacaatacaaaaagttcttcttcatggtatactatagttaaaatttctaaaatccatgaaaaatagagaatttttttttttaaaaaaaagcaagagaaaagcatctagtcacctataagaaacctccatcagaacaagagaaaatttatcagtagaaaccttataggccaggagagaatgggataatgtattcaaaatgctgaaagaaaaactgcaagctaagatactatatctaacaaaattatccttcataaatgaaggagaaataaagtctttctcagacaagataaaactaagataattcatcaccactagactgaccatacaataaatactcaaagaactcctaaacatggaagcaaaaggacatttatctacatgaaaacacacaaaagtataaaaaatggtgaagcaaacatacaaatgtggaaaaagatagggctcaaatactatccctacagataactaccaactgcaatgacagacattaagaggaaaatcaagaacaaagaatatacaaaccaaccataaaacaattaacaaaatgacagcaataaaacctcacatatcaataattactttgaacataaatggattaaattcttcacttaaaagctatagactgaatgaatggattttaaaaaaatgatccaactacatgccacctacaagaaacacactttacttgaaaagattcctatagactgagagtaaataaatagaaaaagatatttaactctaacagaattcaaagtgagcagaggtagctatactcatatcatacaaaacagacttgaagccaaaaacagtaaacaaagacaactaaatagtgataaaaggaccaatctagcaagaggaaataacaattctaaatatatatgcacccaaaactggaacacccggattcataaaggaaagattactaaatctgaaaagaaagactccaatgcaataactgtgggggaatttaccaccttattctcagcactagacagatcgtctagaaagaaaatcaaaaaagaaacattgaagttagagtggaatttagaacaaacagacctaacagatatttatagaacattttatccaacaactgcagaatacacattattttcataatcatacagaatattctctagaacagaccatctattgagccacaaaagaagtctcaacaaattttaaacaagcaaaatggtatcaagtaccttctcagatcacagtggaataaaacaagaaatcaataccaaaaagaaacttggaaactatataaatatacaaaaattaaataacatgcccctgaacaaccattgtgtcaatgaagaaatttaaaaattttgaaactaatgaaaatgaaaacaaaatatatcaaaatctgtgggatacagctaaagtagtactacgagggaagtttatagaaataattgcctacatcaaaagtagaaatattacaagtaaataatctaacaatccacctcaacaaagtgaaaaatcaagaatgaaccaaaccaaacattagcaggaggcaagaaataataaagatcagagcagaactaaatgaatcagaaactagaaaaacaataaaaagcatgaatgaaatgtaacactagttttttgaaagtataaacaaaattgaaaacattaaaaaaaaaaaaaactacgagctagactaacaaagaaaagagaagacccaaataaactcagaaataaaaaggagacattacaactgatacaacagaaatacaaaagatcatcagagactatcacggaaaactgtatactaacaaactagagaatctagaggaagtagatacattgctagaaacatacatacaacttaccaagattgaatcaggaagaaatagtaaacctgaacacaccaagtagtgaaattaaatcagtaataaaaagtctcccaacaaagaaaagcccaggtctggactgatttactgctgacttctaccaggcctataaacaagaactaataccaatctttcccaaactactccaaaaaattgtaggggactgatttcttcctaacatattctataaagccggtatcattctgataccaaaagcacacagggacacacacacacacacacacacacacagaggtataggtcaatatctctgataaacataaacacaaaaaaccccaacaaagttcaagcaaactgaatttaacagcacatcaaaaaaataatacccaatgatcaagtgggatttacccaagggacacaaggatgttcaagatatgcaaatcaataaacatgaaacatctacagaataaggaataaaactcatatgctcatcttatagacaaagaaaaatcttttgataaaattcaacataccttcatgataaaaaaattctcaacaaactaggcatagaataaacatgcctcaaaaaataaagtccatatatgtcaaatccacaaatagcattatactgaatggggaaaagtttggaggccttttctctaagaactggaacaagacaaggatatgtacttccaccattcctaatcaacaaagcactgaaagtcctagccagagtaatcaggcaagagaaagaaaaggcatccagattcaaaaagagaaagtcaaattgtccctctttgcagatgacatgatactcatatttagaaaagtcaaaagactccaccaaaaaacccttagagttgttaaacaaattcagttacactacaggatacaaaatcaacatttttttaaagtagtatttctatacaccaataatgaaatagcaaaaaaaagaaaaagcaaaacaaaaacaaaacagaagaacagaacagcaatcccatttccactagctaccaaaaaaattacataggaataaaccaatgaggtgaaatatctctacaaggaaaactataagaatctgatgaaagaaattgaagagaacacatacaaatgtaaagacatcccatgttcatggatcagaaaaaaataatagtgttaaaaggaccatactccataaacaacctaaagactcaatgcaatccctatgaagacactaatgccatttttcacagaatagaaaaaacaatcctacaattcatttgaaaccaaaaaataaccagaatatccaaagcaatcctgagcaaaaataataaagctggaggcatcatactacctgacttcaaattatattacagggctataataaccaaaacacttggcattggcataaaaatagacacatacccaaatggaacagaatagaaaactcaaaaataaatccacatatttacagccaattgattgttgacaaagcaccaagaacatgcactggaaaactgaggttttcttcaataaatagtgctggggaaattgaacagtcacaggcaaaagaatgaaactgaacccctatctctcactgtacacaaaaataaactcaagatggattaaatactcaagtgtaaaactacaaactataaaactcctagaaggaaacataggaaacgcacttccaacagtcgtctaggaaaagattttatggctaagacctcaaaagcacagacaaatggaacaaaaatagacaaatgagactatattaaaatcaaaaacttctgcatagcaaaggaaacaatcaaaagagtaaagaaaccacctgtatgggagaaaatacttcaaactatctgacaatggaataatatccagagtatataagatactcaaacaattcaacaataaaataagaatcccattaagtaagaagtaggcacagaacattaatagataattccgaaaggaagacatgcaaatggccaacaggtacatggaaaaatgctcaacatcactaatcctcaggaatatgcaaatcaaaaccacaatgaaatattatcttactccagttaggatggctatttttttatttttatttttctacccaattgaacagagagtgtctattattaaaaacgcagtaaaatatcacatgctgacaaggatgtggagaaaagagaatgctcatacccttttggtgggaatgtaaattagtacaaccactattaaaaacaatatggaggccgggcacagtggatcatgcctgtaattgcagcactttgggaatctgagacgggcaggtcatgaggtcaggagattgagaccaccctggctaacacagtgaaaccccatctctactaaaaatacaaaaattagccgggcgtgatggcatgtgcctgtagtaccagctacttgggaggctgaggcaggagaatcgcttgaactggggaggcagaggttgcagtgagccaagatcatgccactgcactccagcctgggtgacacagcaagactctgtctcaaataaataaataaataaataaataaataaataaataaataaaaaacaatatggagatttctcaaacaaactaaaaatagaactacaatatgatccagcaatctcactgctgggtatgtattcaaaggaaaagaaatcggtatatcaaagggattcctgcactcacatgtttgttgtagcactattgataatagcaaagatatagaaccaaacttagtgtccattaacagacaaatggataagaaaacatgtggtatatgtatacaatggaatactattcagccataaaaagaatgagagcctgtcatttgcagcaacatggatgtcattatgttaagtgaaataacccaggcacagaaagacaaattattgcatattctcattcatatgtgggaactaaaaagattgatctgataatggtagagagaagaatgatagatactagaagctgggaaggttgactgggttggtagcggagggtgaagagaggtaggttaataagtacaaacatgtaattagataaaaggcataaattttatattttgacagcaaagtagagtgactatgctttacaacaatataatctatatttcaaagtagctataagaaaggacttcctaacccatagaaataataaatcctcacagtaatggacacttcaaaaactttgacttgataattgtgtattccatgcatgtaacaaaatatcacatgtaccccataaatatgtaaaatattatgtatccataaaaagtgaaattttaggctggatgcagtagctcacacctgtattcccagcactttgggaggcagataatgaggtcaagagatcgagaccatcctggccaaaatagtgaaaccctgtctctactaaaaaaaatacaaaaattagttgggcttggtggtgcacgcctgtagtcccagctactcgggaggctgaggcaaagaaatggctgaacccgagagggagaggttgcagtgagccgagactgtgccactgcactccagcctggatggcagagcaagactctgtctcaaaaaaaaaaaaaaaaaaagaaaagtgtgtttttaaatttctaagagcttcataataaatgtgatatatatatatatatatacacacacacacaagaaaaaaagaattcagaattacagggttgaaatgaatcctgctgatatcaattctttgtagaaataccttggacatggattgtattttttccaaatgaaattcctacaaattgccatttctggagtcttgacttcatacagtctataaacacaccattcaatgttgatatttctcaacggatccttagaagtaaacattgcacaaatatattctttactttataatcctcaagtttgcatgtaagtaacttattctgctttagttacaatcaatgacttttgcagcaatttttaatgctgatcacaaattgctcaaaatgaaactaataagatttgaaaatatatattaatatttcctcagtagctcttgctaaatgaaataggcccagtttcttacagatgtctcagtgaatcatcagttttttatcacttaatatttttttctatgaccactccagtttctccatatctctcacaataaaggagcatgtatgattctcaaatcatgatttgtttctaacaaaaggatataaatattctgtctttcatgtaggtctattatatgcatcattgatgatctttttgtttctttttcaaaacaagaagctatttttttttcaaaacaagaggctgtttttctattgttgatagactcttacagtgaattgtatctaccccctcttctggcatgcaactgtaggatgaattggttctagagaaatgctatgtttatttttcaacattgcagatatcgctttgattttttccatatcaatctagtcactgaactgctgttgtattttgagaaagatgatttttttttctttttttcttgagatggagtttcactccaccacacctggttaatttttgtatttttagtagagatggggtttcgccatgttggtcaggctggtcttgaacccctgacctcaagtgatccacctccctcggcctaccaaagtgctggaattacagacgtgagccaccactcccagccaaatttcatttttaaaaagaagtttgctatgccaagaatagctcaggaggtaggggggcagctttaactccttcaatccattaatcaaccactactacacctggtggtagttttacagccactccctgtccaactccaactctcatcttctcctgtacagaaaatctagggctactaggctatatatgtatatacatattcattaagaatgataattctacttggtcatgatgtttaaaagttttaaaaactttaaaatacgctgtcagataagatttgctttgtttttcatgatttcccattacatatatgtttatatgtgaagctggcctataatttttttcttctcctgactgctgtggatgttaaaattatactaacaaatttaatcatgttctttatatcgtatttagtcttaaaataatttgtaaaatatgggaataatatgtttcttgaatgtttggtagaatttgacagagcaggagcatcactgtcttggacaagcactatcattttaaagttccccttgatcaaaaaccacctaaatccaaagggcatcagcctaatggctaaggtcagcatgaacataaaccacaaatgacatctcgaaccagaaacattccaaccctaagataaatccctcccaaaccagagacatgccagccctgaggtaacctcctctctgcccagagagatgtttagccccaaggtaacttcccctctgatcagagacattacaaccccacaataaacttctccccgacacgaaaacattccaagcctgtgataagccctcttgccctaaacacttaaatactctcagtctgtaagagagaatgctcctcactgaaatcggccagaagcccctctcaggtttattctaaaaaataaagttgtctttggctgttgagctgctttttgtgtttctttcctctttctttaactcttacagaatttgcttgggaaaaacatccatgtctggtgtctttggccagggccaaaggtggaagagttaatgttgttattactactagttcaatttattgaccacttggcaacttactcaggttttctactttacttgtctattttattaagtatatttatttaagaatattttatttcatgaaaattgttcatttcatctaaattttccagtttattgaagctgcattcctaaggtttttcacagtattctcaaattctatttatgcactactttatttacagtatgagttctccttcacagttaaatattccctgtattaaaaaaaaattattcagtcctgcaagggctttgtttattttactaaattttcaaagaatcagctttaagtactccatatatttttgtttattttacattaatttcttcacaactttttatttttattttcttctactttttctggattaactctgttgttctttccacagttttcagagataaatgcctaaataactgtgtccctttttcttagttttaaattaaaaagtttaatactataatttccacagtcattgcagatttagacgcattcagttgcattccacaggttgtgaaatgaattctcattgtcttgcaatatatttctaatttttcattattttttcttttacatattagatatttataaataaatttgttttcacacataattttctgtatttttattgctgatatctaatttaattgtattgtgttgagataatgtagtttatagtgacctcacttttcgaaacttgaagagactttcttcctttgttacataatatgtagtcaactttcataacactgtgtgtgtgaagagaagatacagtctctgtttgctacaggggtattaattaagactttgggatgacttgttcaaatcttatatatcctttttaaaatttttatctgagctttcaatttctgatagcattgtactcaaatattctatcatgaggctgaggcaggaggatcacttaaatccaggagttcaagaccagcctgtgcaacaaagcaagacccatctctataaaaaattaaaaattaaaactcatttttccatcatgagtttgaacttatctatttctccctatgatttggttggttctgctttgttctgaagctatctacaaataattgtgaattatatactgtgtggattgttctttttatgaaaatatattgttatttaaaaaaatcctctatagatgtttttgccttaaattctttcttctgaaattaatattttgacacaagttttagtatttgcatagtatatctatatttaatttttctgtctttttaaaagatattttcctataagattagcagttagtttttttaatctaatataatacatttaatattttattagaaaactaataaatttacaatgagtatgattattgaacatatttaaactgatctctatgatcttgttttagtgttctgtttagaattccttctttattgtttttaggggaggatcttatttcttgcttttttgattttcatgtgctctcttttttccttttattaattgtgtaactgtacacacactcagatacgcataatttctgacagagattaaattttagtatgtcctgcctaccaactaaataagacaagaatcttagcatatttaaagtactaatggaaccttcctcttccttctcccaagttctttttcctagaattttagttttacctatatacacatttgtagttttaatgtgctacattcttcatataaagatatatatatatacacacacacacatatatacacacacatatatattcacacacatgctttttatcaaagtttaatgtatacaatgttcataaagtatacatctcacagctgtactgctctataaactttcacaaaccaaccacacatatggaaccaggactgagattaagaatacacaacattaccagctccccagaagctccttcgttccccatacagacccactgctctttttccaaggatgaccacatgctgacttctaccagcataaaattgttttttgtcattttgtactttatatcacttaatcatctacaatgtattttttgtattttttattcaacccattatgtttgtgagaataatttgtatcatatgactgtttcattcattttcattgttttgtagtattccactgtgtaaatgcaaggcagtttatttattaattcaactgttgatgaatatttactacttagagctattatggtcatttccgtatttgttctttttccaacttttggctagtacttgtcttttggtgcacatatatgctttctattgggtgtatacttggaatgactgtgtcatagggtactcagttattgttttaattatactgttaaagtattgtccaatttaacttgtttttaaaaaataaaactgtagatttatttaaaggtagaagtgaagtatattactgatacactttcaaaagctattgattaccgtgctttcttttttaatttactcttcttgctgaagaaatactttgtatttgtggattgtaaactcctcattttttgaatatttgaaaatgtctctattttgctttcactcttaaaggatagcttagctacaagtacatttctaggctggtagtgattttcacataaaacttaattgctttgttcttaagaagttaaaagccaatcttttttttttcctatgcaagcaatctgtttttctttctagtagcttttaaattgcctcttaccattaacttctttctttattccatgatataaccagttaaggattgtgtttattgacctgtttggccctcaatgaagtctttcaatttgaaagatcatcccactcttcaattctataaaattatcagccatatttcctctgtctttaaaaaaaaatgcttattctttgtgggattcctttgatacatgttataatttctcaatctcttcgccaaatactttattttttcatatatattttaaatctgttttttctctttgtgctatatatttcatgaattcctcatttatatcattcaagtaactaatattctgatatttcatttaaatttactttgtctattaatttctttaaattttagctttttagtgtcattctctcaaaggcccttttgtcaatatatacttttgttgatgttgtttgattttctatcaaggacttccagttttaaaaattgtaactctaccctttagttgcatacagtgtgctttgctccaatatccctccataactgagaaaattttgaatcatggaggtaaacacaagcaaaaactccacattggagcccaggatacctttggttctaatttcttctcactgccatgtgtttcttgatttttatccttgctacttattttcttttaaacttttttttttgtatttctatatggactcacagtactatcttggcttatattctgttagttgtatttgtattttgtactagccttcccctaagcttccttacggttggaactgtcttaacatctatagggtcagtatctgggcacttcaaactatacagtaggcactgaagaaagattagtgattagacaaatgaatttttgcaatgtgtataatgtgtttatctaactagaggaaatgtacccagttttctattggtaacatggacatttgaagtcatttatcatatttttgctcttgtaaacagaggtggaacaacaataagccatttcagcatatgagtgatatctgcactatgacataaatcctttatagacaagcaaatgctgagagattttgtcaccaccagacctgcccgacaagggctctggaaggaagtactaaatatggaaaggaacaaccggtaccagccactgcaaaaacactccaaattgtaaagaccatcaattctaggaagaaactgcatcaactaatgagcaaaataacaagctaacatcataatgacaggatcaaattcacacataacaatattaaccttaaacgtaaatggactaaatgctccaattaaaagacacagactggcaaattggataaagagtcaagacccatcagtgtgctgtattcaggaaacccatctcacgtgcagagacacacatgggctcaaaataaaaggatggaggaagatctatcaagcaaatggagaacaaaaaaaggcaggggttgcaatcctagtctctgataaaacagactttaaaccaacaaagatcaaaagagacaaagaaggccattacataatggtaaaggaatcaattcaacaagaagagctaactatcctaaatatatatgcaccatataaaggagcacccagattcataaagcaagtccttagtgacctacaaagagacttagactcccacacaatgataatggaagacttcaacatcccattgtcaacattagacagatcaatgagacagaaagttaacaaggatatccaggaactgaactcagctctgcaccaagcagacctaatagacatctatagaactctccaccccaaatcaacagaatatacattcttttcagcaccacaccacatctattccaaaattgaccacatagttggaagtaaagcactcctcagcaaatgtaaaagaacagaaattataacaaactgtctctcaaaccacagtgcaatcaaactagaaggcaggattaagaaactcactcaaaactgctcaactacatggaaactgaacaacctgctcctgaatgactactgggtacataacgaaatgaaggcaaaaataaagatgttctttgaaaccaacgagaacaaagacataacatactagaatatctgggacacatttaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggagatagagacacaaaaaacccttcaaaaaatcaatgaattcaggagctggttttttgaaaagatcaaaaaaattgatagaccgctagcaagactaataaagaagaaaagagagaagaatcaaatagatgcaataaaaaatgataaaggggatatcaccaccgatcccacagaaatacaaactaccgtcagagaatactgtaaacacctctacacaaataaactagaaaatctagaagaaatggataaaatcctctacacatacaccctcccaagactaaaccaggaagaagttgaatctctgaatacaccaataacagactctgaaattgacgcaataattaatagcttaccaacaaaaaaagtccaggaccagacggattcacagccgatttctaccaaagatacaaagaggagctggtatcattccttctgaaactattccaaccaatagaaaaagagggaatcctccctaactcattttatgaggccagcatcatcctgataccaaagctggcagagacacaagcaaaaaagagaattttagaccaatatccctgatgaacgtcaatgcaaaaatcctcaataaaatactggcaaactgaatccagcagcacatcaaaaagcttatccaccacgatcaagttggcttcatccctgggatgcaaggctggttcaacatacacaaatcaataaatgtaatccagcacataaacagaaccaaagacaaaaaacacatgattatttcgatagatgcagaaaaggtctttgacaaaattcaacagcacttcatgctaaaaactctcaataaattacgtattgatgggaagtatctaaaaataataacagctacatatgacaaacccacaaccaatatcatactgaatgggcaaaacctggaaacattccctttgaaaactggcacaagacagggatgccctctcccaccactcctattcaacatagtgttggaagttctggccagggcaatcaggcaggagaaggaaataaagggtattcaattaggaaaagaggaagacaaattgtccctctttgcagatgacatgattgtatatctagaaaaccccatcatctcagtcgaaaatctccttaagctgataagcaacttcagcaatgtctcaggatacaaaatcaatgtgcaaaaatcacaagcattcctatacaccattaacagacaaacaaagagccaaatcatgagtgaactcccattcacaattgcttcaaagagaatgaaatacctaggaatccaacttacaagggatgtgaaggacctcttcaaggagaactacaaaccactgctcaaggaaataaaggaggatacaaacaaatggaagaacattccatgctcatggacaggaagaatcaatatcgtgaaaatggccatactggccaaggtaatttatagattcaatgccatcccctcaagctaccaatgactttcttcacagaattggaaaaagctactttaaagttcatatggaaccaaaaaagagcctgcattgccaagtcaatcctaagccaaaagaacaaagctggaggcatcttgctacctgacttcagactatactccaaggctacagtaaccaaaacagcatgatactggtaccaaaacagatatacagaccaatggaacagaacagagccctcagaaataataccacacatctacaactatctgatctttgacaaacctgacaaaaacaagaaatgaggaaaggattccttatttaataaatggtgctgggaaaactggctagccatatgtagaaagctgaaactggatcccttccttacaccttatacaaaatttaattcaagatggattaaggacttaaatgtcagacctaaaaccataaaaaccctggaagaaaacctaggcaataccattcaggacataggcatgggcaaggacttcatgtctaaaacaccaaaagcaatggcaacaagagccaaaattgacaaatggcatctaattaaactaaagagcttctgcacagcaaaagaaactaccgtcagagtgaacaggcaacctacagaatgggagaaaatttttgcaaactactcatctgacaaagggctaatatccagaatccacaaagaactcaaatttacaagaaaaaaaaaaacccatcaaaaagtgggcaaaggatatgaacagacacttctcaaaataagacatttatgcagcctacagacacatgaaaaaatgctcatcatcactggccatcagagaaatgcaaatgaaaaccacaatgagacatcgtctcacaccagttagaatggcgatcattaaaaagtcaggaaacaacaggagctggagaggatgtggagaaataggaacacttttatactgttggtgggactgtaaactagttcaaccattgtggaagacagtgtggcaattcctcagggatccagaagtggaaatatcatttggcccagccatcccattactgggtatatactcataggattataaaacatgctgctataaagacacatgcacatgtatgtttattgtggcactattcacaatagcaaagacttggaaccaacccaaatgtccatcaatgatagactggattaagaaaatatggcacatatacaccatggaatactatgcagccataaaaaatgatgagttcatgtcctttgtagggacgtggatgaagctggaaaccatcattctcagcaaactgtcgcaaggacaaaaaaaccaaacaccgcattttctcactcacaggtgggaattgaacaatgagaacacttggacacaggaaggggaacatcacacactagggcctgttgtggggtggggggaggggggagggatagcattaggagatacacctaatgttaaatgaccagttaatgggtgcagcacaccaacatggcacatgtatacatatgtaacaaacctgcacgttgtgcacatgtaccctagaacttaaagtataataaaaatatatatataaaatcattgtattaatctgtgaaatatttttaaagaatgttcaacctgttaatatccagttagagcaaggatgtagaaaaactagtacaatattaaattaataaaaatatatcaaagcaaggaaaagtttgtgttttgatctagtaacttcattttttggaattcgtaaaataattctggatattgagaaatactttattgaagtatggtatttaataataaaaaacaaatttagaacaataaaaggttaagaaaaatataatttattcagttaatggtatagtttaaaatcttaaaagtgattgttacaaaactaaattgtatcaaaagctaacctactcatccagaagaaagccacaattaaattgcaacatgaaacaatacttttagtatacaaatattatggcactaaaacagcgatacgcattttttaaaattattattatactttaagttctgggatacgccaggtgcggtggctcacgcctgtaatcccaacactttgggaagccaaggcaggtggatcacgaggtcaggagatcaataccatcctggctaacacagtgaaaccccatctctactaaaaatacaaaaaattagccgggcgtagtggtggcaggtgcctgtagttccagctacttgggaggctgaggaaggagaatggcatgaacccgggaggtggagcttgcagtgagcagagattgcgccactgcactccagcctgggtgacagagcgagaccatctcacagaaaaaaaaaaaaaaaaagttctggtatacatgtgcagaacatgcagctttgttacataggcatacttgtgacatggttgtttgatgcacccatcaactcatcatctacatcaggtatttctcctaatgctatccctacccttgcccccaacccccaacagggtatgtgatgttcctttccctgtgcccatatgttctcattgttcaattcccatttattagtgagaacatagggtgtttggttttctgttcctttgttagtttgctgagaatgatggtttccagcttcatccatgtccctgcaaaggacagcaactcatccttttttatggctgcatagtattctatggtgtatatgtgccacattttcttgagccagtctatcattgatgggcatttgggttggttccaagtctttgctattgtgaatagtactgcaataaaaatatgtgtacatgtgtttttatagtagaatgatttatgatcctttgggtatatacccactaatgggattgctgggtcaaatggcatttctggttttagatccctgaggaattgccacattgtcttccacaatggttgaactaatttacactcccaccaacagtataaaagtgttcctatttctccacatcctttccaccgtctgttgtttcctgactttttaatgattgccattctaactggcatgaaatggtatctcattgtgggtttgatttgcatttctctaatgatcagtgataacaagctttttttcatgtttgttggctgcataaatgtcttcttttgagaagtgtctgttcatatcctttgcccactttttgatggggttgtttttctcttgtaaattcatttaagttctttatagattctggatattagccctttgtcaaatggatagattgcaaaaattttctcccattctgtaggttgcctgtttcctctgatggtagtttctttcaccgtgcagaagctctttagtttaattagatcccatttgtcaattttggcttttgttgccattgctttggtgttttagtcatgaagtccttgcccatgcctatgtcctgaatggtactgcctaggttttcttctagggcttttatggttttaggtcttacctttaagtctttaatttatcttgagttaatgtttgtattaggtgtaaggaaggaatccagtttcagttttctgcacatggctagccagttttcccaacagcttttattaaatagggaatcttttccccattgcttgtttgtgtcaggtttgtcaaagatcagatggctgtagatgtgtggtgttatttctgaggcctctgttctgttccattggtctatatatctgttttggtaacagtatcatgctgtttttgttactgcagccttgtagtgtagtttgaagacaggtagcattatgcctccagctttgttctttttgcttaggattgtcttggctatatgggctcttttttggttccatatgaactttaaagtagtttttttctaattctgtgaaaaaagtcaatggttgcttaatgggaatagcattgaatctataaattaccctgggcagtatggccattttcaagatattgattcttcctatctgtgagcatggaatgattttctgtttgtttgtgttgtctctgatttccttgagcagtggtttgtagttccccttgaagaggtccttcacatcccttgtaacttgtatttctaggtattttattctctttctagcaattgtgaataggagttctctcatgatttggctctctgtttgtctattataggtgtataggaatgcttgagatttttgcacattgattttgtatcctgagactctgctgaagttgcttatcagcctaaggagattttggggctgagatgacagggttttctagatatacaatcatgtcatctgcaaacagagacaatttgacctcctctcctcccacttgaatatactttatttctatctcttgcctgattgccctggccagaacttccaatactatgttgaataggagtagtgagagagggcatccttgcctgtgctggttttcaaagggaatgcttccagcttttacccattcagtataatattggctgtgagtttgtcatatatagctcttattattttgagatatgttccatcaatacctaatttattgagagtttttagcatgaaggggtgttgaattttatcaaaggccttttttgcatctattgagataatcatgtgtttttttttcattggttctgtttatgtgatggattccatttattgatttgcttatgttgaaccatccttgcatcctggggtgaagctgacttgattgtggtggataagctttttgatgtgctgctggattcagttttccagtattttattgagaattttcacatcgatgttcatcacggatattggcctgaaattttcttttttttgttgtgtttctgccaggttttggtatcaggatgatgctggcctcataaaatgagttattttatgataatttcttttctattgtttgaaatagtttcagaaggaatggaaccagctcttctttgtacctctgatagaatttggctgtgaatctgtctggtcctgggcttttttttggttggtaagctattaattactgcctcaatttcagatcttgttattgttctgttcagagattcgactttttcctggtttagtcttgggagggtgtatgtgtccaggaatttatccatttcttccagattttctagtttatttgcatagaggtgtttatagtattctctgatggtagtttgtatttctatagtattctctgatggtagtttgtatttctgtgggatcagtggtgatatcccctttatcattttttattgtgtctatttgattcttctctcttttcttctttattagtctggctagtggtctatctgttttgttgatgttttcaaaaaaccagctcctggattcattgattttttgaaaggttttttgtgtctctatctccttcagttctgctctgatcttagttatttcttgtctcctgttagcttttgaatttgtttgctattgcttctctagttcttttcattgtgatgttagggcgtcaaatttagatctttcctgctttctcctgtgggcacttagtgctataaatttccctctaaacactgctttagctgtgtcccagagattctggtatgttgtgtctttgttcttattggtttcaaagaacttatttatttctgccttaatttatttacccaatagtcattcaggagcaggttgttcagtttccatgtagttgtgcggttttgagtgagtttcttaatcctgagttctaatttgattgcactgtggtctgagatactgtttgttattatttccatttatttgcatttgctgaggagtgttttactttcaattatgtggtcaattttagaataagtatgatttggtgctgagaagaatgtatattctgttgatttgaggtggagagtttggtagatgtctattaggtctgctcggacctgagctgagttcacatcctgaatatccttgttaattttctgtctcgtttatctgtctaatatgacagtggggtgtaaaagtctcccactattattgttttggagtctaagtctttttttaggtctctaagaacttgctttatgaatctggatgctcctgtattgtgtgcacatatatttaagatatttaactcttcttgttgcattgatccctctaccattatgtaatgcccttctttgtcttttttatctttgttggtttaaagtctgggttatcagagactaggactacaatccctgctttttttttttttttttttttttttgctttctatttgcttggtaaatctttctcaatcccactatttttagcctttgtttgtctttgcatgtgagataagtctcctgaatacaggacacctatgggtcttgactctttatccaatttgtcagtctgtgtcttttaattggggcatttagtcaatttacacttaaagttattgttacatgtgaatttgatcctgtcatcatgatgctagctggttattttgcccattaattgatgcagcttcttcacagtgccgatggtctttacaatttgatatgtttttgcagtggctggtaccagtttttccttgccatgtttagtgctttcttcaggagctcttgtaaggcagacctggtggtgacaaaatctctcagcatttgcttgtctgtaaaggattttatttctccttcacttatgaagcttagtttggctggataaaaaattttgggttgaaaattcttttctttaagaatgttgaatatcagcccccaccctcttctggcttgtagggtttctgccaagagatcccctgttagtctgatgtgcttctctttatgggtaaccccacgtttctctctggctgctcttaacattttttccttcatttcaaccttggtgaatctgacaattatgtgtcttggggttgctcttctcaaggattatctttgtggtgttctctgtatttcctaaatttgaatgttggcctgccttgctaggttggggaagttctcctggataacatcctgaagcgtgttttccaacttggttccaatctccctgttactttcaggtacaccaatcaaaaaagtttggtcttttcacatagtctcatatttcttggaggctttgttaattccttttcattcttttttctctaatcttgtctttatgctttatttcattaagttgatcttcaatctctgatatcctttcttccacttgatggatttggctattgatacttgtgtatgcttcacaaagttctcatgctgtgtttttcagctccttcaggtcatttatgttcttctctaaactgcttattccagttagcagttcctagggagacctaggggaatcttttatcaaggttcttagcttccttgcatttggttagaacatgcttcttttgctcagaggagtttgttattacccaccttccgaagcctacttctgtcaattcatcaaactcattctctgtctaattttgttcccttgctggcgaggagttgtgatcctttggaagagacattctggtttttggaattttcagcctttttgagctgctttttcctcatctttgtggatttatctacctttggtctttgacgttggtgatctttggatggggtttttgcgtgggtgtcctttttgttgatgttgatgctattgctttctgtttgttagttttccttctaacagtcaggcccctcttctgcaggtctgctggagtttgctggaggtccactccagaccgtttgcctacgtatcaccagtggaggctgcagaacagcaaagagtgctgcctgctccttcctctggaagctttattccagaggggcacctgccagatgccagccagagctctcctgtatgagatgtctgttgacccctgctgggaggtgtttcctagtcaggaggcaccgggttcagggacccacttgaggaggcagtctgtcccttagcagagctcaagctctgtgctgggagatccactgctgtcttcagagccagtagacagaaacgtttaagtctggtgaagctgtgctcacagctgccccttcccccaggtgctctgtcccagggagttgagagttttatttataagcccctgactgtggcttctgcctttctttcagagatgccctgcccagaaaggaggaatctagagaggcagtctggctacagaggctttgctgcactttggtgggccccacccagtttgaacttccaggtggctttgtttacactgtgaggggaaaactgcctactcaagcctcagtaatggtggatgcctctcacccacaccaagctggagcatcccaggtcaacttcagactcctgtgctgacagcgagaatttcaagccatggagcttgttgggctccatgggggtgggatccgctgagctagaccacttgactccctggcttcagccccctttccagcggagtaaatggttctgtcttgctagcattccaggtaccactgaggtatgaaaaaaactcctgcagctaggtcagtgtctgcccaaacagctgcccagtttcgtgcttgaaatctagggccctgggagtgtaggcacccaaaggaatctcctgatctgtaggttgcaaagaccatgggaaaagcaaagtatatgggccagagtgcactgttcctcaaggcacagtccctcatggcttcccttggctaggggagggagttacctgaccccttacacttcccgggtgaggtgatgccccaccctgcttcgggtcaccctccatgggctgcacccactgtgtaaccagtcccaatgagatgagtcaggtacctcagttggaaatgcagaaatcacccaccttctgcattgatctccctgggagctgaagaccggagctgttcctattcagccatcttctattcctcatgatacacatttttaatataatggttgtaatctaattataactttataagataaaatacttataaagaaatacttcataaagtacaatatatcaaatagtactatttgtatttgtataatgagattataaatttatattttctaatctttttcttaaaaaaaggatactatttacatcatcacaacaatgaccctatgaagaacacacattaaaaaagctgataggttagcatgataaaaaataaagatttgaattttaatcacaaattttgtagagagtagttgttacctgaggattatgatacagaggttagcatgtgcatatttctgtagattttggttttcagattctctgacttgtgatctcaaagattccttatgataaataaaataattaagcaaatgaaaaatgaagcaaataaaaatggtaatataactttttacatagcatgtatgttacacattagatatagcataatagactatttcagaggaatatccggctaataaatcaaaatagtaattatataaatggtttaaattaggtcactggagggaaaaataaaaatcacaaaatagattcatttttacctcaacaataaacgagttcatcaatatgttacactaggttatgaaggactattagatcatatataagggctgtttataaaatgtcaacaaaaaaatcaaatcacaggtttttagaagtagaagctggtcaatacctcaaagaaaatctgtattacaactgaaataagaattaatattcttcccattaaatcacaaagcctttttatttcattcctataaaatcacatgaatgtgtaattgaatatcacaatcctttataacctcaggcaagcttcttaatgtctcagaaccatactctgttatcagtttctcatattgatagcatttatgttattgccagcttgggctattaaaacagtattccaataaatattattgttcacatagcttttgcaattatatctccactttagatatttgaaggtgaaattaatgcgagccaaaatgggctcaatgtgactgtcaggaaaaatgatatctttgtaatataatcaatttttctttgattattagtacagttgagcatatatatgtttatttatataaatcagggcatttcttaatatattcattttctatttcagatttgcctatttttctagtgaaatttttttattgatttgtaatattttgtatataaaacctgaaacactttaaacaccatatgtgctatatgcatggtattttctctgtgtctgcagcttatcttttcacttaatgtttatgttatcttcttcatatcaagttttaaatgctgacaaaataaaatctgtcaaattttccttagggcctcaagctcttacgatgatcaaaatgaccaatctttagtgacttttgtaactatacactacccatctgactccagattatatgcttttaaccacttcactattcttgtttgaaacttgagaatagggtagtagttaaaagcatcaaatctggagccagattatgtaggtttaaatcctggggcaccctcatctgactagctctacgacatgaaatgagttactcaactttcctgtgtacagtttcttgtttatcagttgagtaaatataattaaagagattagattagggcctggcacacaataagtgctaaataaacatttgttattatttgttccctccaaacatgtctgtttctctaagtagatgtttttgtataaattccaacaatgtgatgtttatatcaagattttattccatttttctcatttattaataactgtaagtgagttcctactatgtacttctctggcaccaagccaggcacaaaaaacagagtaattaataaatattagggttgggtgccatggctcacacctgtagtctcaacacctgggaggccaaggtgggagcattgtttgaggccaggagtttgagaccagacttagcaacacagcaagaccctgtctttacaaaatatttaatcattttaaaataattttaaaaaatcaacactaatggttgcttttctgatggtgcttgctgtctaatacaagaaagtaaaattgtaatgtgacaattgacagaaaagaaagataaaaatgttatgatagattgatctgttcaagactggtaagttgctttcctgaagaaataatgcttaaattgaaatataaggaataaataaaaatttctctggagaaaagggaaaggaagttcatttgtacaaatttagcaaggtaaaattaataaaattacattttcaatttattttgaaattagccttgcaaatacgaagtaatttttaagcaaaagttctaaatattgctttgctattccaagactaaataattaagaactcttccaattccagttatttgtgtgaattacataatgcaaacatttgtaaagaacagattgcttttagaaagtctgatcttgaatttatttttcttcgtttactctcttgcagacatatccattgtatgctttcaaaacattcttatatttttccagaatataaaaacactgtgtgcaaatgttcaatatacatgtagctggaaatagataacatttgggtggatggcaatctaatgtatacaaagagtagattcacagctgtgtatttgccagattagaaataaggctagacttctgatttctggagaattttggtaaagcaaaatataagagaaagaggtttagacttgttcagtgctatctaaaatagaaactcttgcagaaaaagaattacatttacttaatccatcctttccataattattcacactgaaactactgaaatagtatgtaaaatattaatagtacattgtttgaaaacctatacagtcaaccctctttctcctggggttctgcatccatggctgcttctgtattgaacacgtacagacatttttcttgtaactatttcctaaaaaatatagtataactatttacacagcatttacagtatattagttattataagtaaccctgtagcaatttaaagtatacagggagatatgcataggttatatgccaatagtacactattttatataaggaacttgaacatccatggattttggcatctgcagaaggtcctggaaccaaccccccatggataccgagggatggctgtataatatggattaggtttttttttcctaaagttcttcaaaagctcttgacctcaagctttttaaataaaacctacataaaatattctcaattaaaataactgtaaatatattttggagcagtacaaattgcttggcattttacttttaaaacctaaaggctgaattctatgttaatagattacaacataaaacagattcacttatatgaaacaagcaagttttttctcatattgtttgcaccaaagaaagttgcattgatgaatagaaaaaaaatagctttattcccctacttcctcaacacaataagaatgaaagacaactaaaattaaacttgtggtggagccaagatggccgaataggaacagctccggtctacagctcccagcgtgagtgacgcagaagatgggtgatttctgcatttccatctgaggtactgggttcatctcactagggagtgccagacagtgggtgcaggacagtgggtgcagtgcaccatgcacgagccaaagcagggtgaggcactgcctcactcgggaagcgcaaggggtcagggggttccctttcctagtcaaagaaaggggtgacagacgtcacgtggaaaatcaggtcactcccaccctaatactgcacttttccaatgggcttaaaaaacagcacaccaggagattatatcccgcatatggctcagagggtcctatgcccacagagtctcactgattgctagcacggcagtctgagatcaaactgcaaggccacagggaggctgggggaggggcgcctgtcattgcccaggcttgattaggtaaacaaagcagcggggaagctcgaactgggtggagcccaccacagctcaaggaggcctgcctgcctctgtaggctccacctctgggggcagggcatagacaaacaaaaagacagcagtaacctctgcagacttaaatgtccctgtctgacagctttgaagagagtaatggttctcccagcacgcagctggagatctgagaacaggcagactgcctccttaagtgggtgtctgacccccgagcagcctaactgggaggcgccccccagtaggggcagactgacacctcacacggccgggtattcctctgggacaaagcttccagaggaacgatcaggcagcagcatttgcgggtcaccaaaatccgctgttctacagccactgctgttctgcagccaccacggctgacacccaggcaaaaagggtctggagtggacctctagcaaactccaacaaacctgcatctgagggtcctgtctgttagaaggaaaactaacaaacagaaaggacatccacaccaaaaacccatctgtacgttgccatcatcaaagaccaaaagtagataaaaacacaaagatggggaaaaaacagagcagaaaaaccagaaactctaaaaagcagagcacctctcctcctccaaaggaacacagctcctcaccagcaacggaacaaagctggacggagaatgacattgatgagttgagagaagaaggcttcagacgatcaaactactccgagctacaggaggaaattcaaaccaatggcaaagaagttagaaactttgaaaaaagattagacgaatggataactagaataaccaatgcagagaagtccttaaaggagctgatggagttgaaagccaaggctcaagaactacgtgaagaacgcagaagcctcaggagccgatgcgatcaactggaagaaagggtatcagtgatgcaagatgaaatgaatgaaatgaagtcagaagggaagtttagagaaaaaagaataagaagaaacgaacaaagcctccaagaaatatgggactatgtgaaaagaccaaatctatatctgattggtgtacctgaaaatgacggggagaatagaaccaagttggaaaacactctgcaggatattatccaggagaacttccccagtctagcaaggcaggccaacattcagattcaggaaatacagagaacaccacaaagatactcctcgagaagagcaactccaagacacataattgtcagattcaccaaagttgaaatgaaggaaaaaatggtaagggcagccagagagaaaggttgggttacccacaaagggaaagccatcagactaacagtagatctcttggcaaaaactctacaagccagaagagagtgggggccaacatttcacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaagcaacaaccggtaccagccactgcaaaaacataccaaaatgtaaagaccatcaaggctaggaagaaactgcatcaactaacgagcaaaataaccagctaacatcataatgaacaggaccaaattcacacataacacttaactttaaatgtaaatgggctaaatgctccaattaaaagacacagactggcaaattggataaagagtcaagacccatcagtgtgctgtattcaggaaacccatctcacgtgcagagacacgcatgggctcaaaataaaaggatggaggaagatctaccaagcaaatggaaaacaaaaaaaggcaggggtcgcaatcctagtctctgataaaacagactaaaccaacaaagatcaaaagagacaaagaaggccattacataatggtaaaggaatcaattcaacaagaagagctaactatcctaaatatacatgcacccaatacaggagcaaccagattcataaagcaagtccttagtgacctacaaagagacttagactcccacacaataataatgggagacattaacaccccactgtcaacattagacagattaacgagacagaaagttaacaaggatacccaggaattgaactcagctctgcaccaagcagacctaatagacatctacagaactctccaccccaaatcaacagaatatacattttttttcagcaccacaccacacctattccaaaattgaccacatagttggaagtaaagcactcctcagcaaatgtaaaagaacagaaattataacaaactgtctctcaaaccacagtgcaatcaaactagaaggcaggattaagaaactcactcaaaactgctcaactacatggaaacggaacaacttgctcctgaatgactactgggtacataacaaaatgaaggcagaaataaagatgttctttgaaaccaacgagaacaaagacacaacataccagaatctctgggacacgttcaaagcagtgtgtagaggaaaatttatagcactaaatgcccacaaaagaaagcaggaaagatccaaaattgacaccctaacatcacaattaaaagaactagaaaagcaagagcaaacacattcaaaagctagcagaaggcaagaaataactaaaatcagagcagaactgaaggaaatagacacataaaaaaactttcaaaaaattaatgaatccaggagctggttttttgaaaagatcaacaaaattgatagaccgctatcaaggctaagaaggaagaaaagagagaagaatcaaatagatgcaataaaaaatgataaaggggatatcactaccaatcccacagaaatacaaactaccatcagagaatactattaacacctctaagcaaataaactagaaaatctagaagaaatggataaattccttgacacatacaccctcccaagactaaaccaggaaaaagttgaatctctgaatagactaataacaggctctgaaactgtggcaataatcaatagcttacaaaccaaaaaaagtccaggaccagatggattcacagcggatttctaccaaagatacaaagaggagctggtaccattccttctgaaactattccaaccaatagaaaaagagggaatcctccctaactcattttatgaggccagcatcatcctgataccaaagcctggcagagacacaaccaaaaaaggtaattttagaccaatatccttgatgaacattgatgcaaaaatcctcaataaaatactggcaaaccgaatccagcagcacatcaaaaagtttatccaccatgatcaagtgggcttcatccctgggatgcaaggctggtttaacattcacaaatcaataaatgtaatccagcatataaacagaaccaaagacaaaaaccacatgattatctcaatagatgcagaaaaggcctttgacaaaatccaaaaacccttcatgctaaaaactctcaataaattacgtattgatgggacgtatctaaaaataataagagctatctatgacaaacccacagccaatatcatactgaatgggcaaaatctggaagcattccctttgaaaactggcacaagacagggatgccctctctcaccactcctattcaacatagtgttggaagttctggccagggcaatcaggcagcagaaggaaataaagggtattcaattaggaaaagaggaagtcaaattgtccctgtttgcagatgacattattgtatatctagaaaaccccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaagggcctcttcaaggagaactacaaaccactgctcaatgaaataaaagaggatacaaacaaatggaagaatattccatgctcatgggtaggaagaatcaatatcgtgaaaatggccatactggccaggtaatttatagattccatgccatcctcatcaagctaccaatgactttcttcacagaattggaaaaaactactttaaaggtcatatggaaccaaaaaagagcccgcatcgccaagtcaatcctaagccaaaagaagaaagctggaggcatcacactacctgacttcagactatactccaaggctacagtaaccaaaacagcatggtactggtaccaaaacagagatatagatcaatggaacagaacagagccctcagaaataatgccacatatctacaaccctctgatctttgacaaacctgaaaaaaacaagcaatggggaaagcattccctatttaataaatggtgctgggaaaactggctagcgatatgtagaaagctaaaactggatcccttccttacaccttatacaaaaattaattcaagatggattaaagacttaacatgttagacctaaaaccataaaaatcctagaagaaaacctaggcaataccattcaggacataggcatgggcaaggacttcatgtctaaaacaccaaaagcaatggcaacaaaagccaaaattgacaaatggggtctaattaaactaaagagcttctgcacagcaaaagaagctaccatcagagtgaacaggcaacctacaaaataggagaatattttcgcaacctactcatctgacaaagggctaatatccagaatctacaatgaactcaaacaaatttacaagagaaaaacaaacaaccccatcaaaaagtgggcgaaggatatgagcagatacttctcaaaagaagacatttatgcagccaaaaaacacatgaaaaaatgttcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtagtgattccacagggatctagaactagaaatatcatttgacccagccatcccattactgggtatatacccaaaggattataaatcatgctgctataaagacacatgcacacatatgtttattgcggcactattcacaatagcaaagacttggaaccaacccaaatgtccaacagcgatagactggattaagaaaatgtggcacatatacaccatggaatactatgtagccataaaaaatgatgagttcatgtcctttgtagggacatggatgaaactggaaaccatcattctcagcaaactctcgcaaggacaaaaaaccaaacactgcatgttctcactcataggtgggaattgaacaatgagaacacacggacacaggaaggggaacatcacacttcaaggactgttgtggggtgggggaaggggggtgggatagcattaggagatatatctgatgttaaatgacgagttaatgggtgcagcacaccaacatggcacatgtatacatatgtaacaaacctgcatattgtccacatgtaccctaaaacttaaagtgtaataataataaaattaaaaaataaataaataaataaaattaaactttaatgaccttttgatctactctcatttaatctgcttttatattcctcatatttggcagaacccacaataatcagatgagattggctaagagtaaatccatatgtctctttctttttgaaagatttactagttcacatttttaaaaagttagaattagaaattttagtcattagaaagtaatgaagaaataatgacacccattggagtaattatataaaaaaagcaaatgtaaaaatcctagaaaatatatgcccaataaaatgagaatgcttaaaaaaatgaggaaaaaatgccgagcaaaatgagagatgagggacataaattacaaagtaaaggtgctggggggacattcatctacattgagtgctgaatccacagattacgggaaaaatcactgaaaactgcattatccattttttggtgtttcttggtgctgactggaaatctgtaatgtatgtagatgccaaccaacaaagaaacaagatgggagaagagtaagggaacgaacacgtcaaataccacaggcacggtgctggatcctttacagacattataatgtggtcaaaattacatgaaacaaattgtcattttgttttccaattgtttgatttttggcatttcaatacttgaaattaaaaatgcttttttattgttaattttagcttcataaataatgttagtaaaatatttcaaatgagtgcctttggaaagctttttcaattccaggaaaggctatgattttttgccttctataaattataaccttcagcaaaaggtagtaactactgcattaccaaagggcactcatccagaaaatctggattctggagaacaccatcatcttagaaaaaccatttaatgactcaaagtccggcaatatatcttttaaaataataccacataataaagaatattaatcagacatttttctagcaagaatacatgcatttcttttgatcttctacatgaaaatgcacatactggatggacaaatgacagtaaaatactgaaaattctaacttcaaaatgggtttcatttatcaatagaacataatattggctttgattttcagattgcctactggggaataaaattaagttatcatattctccatcagagatcttagtctaagttcataattttttttgaggtaattgtttcaataattatttttttaactgaccttcaaaaagtgaaatcttctatcattcctaacttccattctgcagtttagagagtaatgaaagcagttaacatccccacttaccccagataattgtctaaaaaatcccagccaaatatgtgaaaaggacaagccatttttagaaactcatgtaatttaaatttattttctcatttgatattttgcagttatgtttaagtcacatgctagaagagttttggtattttttccagaaaataaaaacactttgtttggagtactaacataaatatagctgggagaaataacctgtaaactgaaagcaaatctaatctatataaatatcagtttgttgttctgtttcccttgtataatatagtaaggctttagacctcactttactatactgatgttaaggggtcaccatacagcaaaacactaagcattttacatttcagctttttcagaaataacgttgtattcatttcacagtgaataagaagataaggatgatatcaaagaacatcacagaatataacaagaaattgcattttacaataggtaagaaaatgttccctagaatatttacacttaaaagaaaaatcttgctccattgatataacatctcaaggaagaactagcaatagaagaaaattgtgctaaactttagaccctgttgtagcaatatttaaaatgctgcctcatttcctcacaagctagagatgttactttgctccaacttattatttcttctttttcaagtaaatgttgctgaaatagatttgtaaagatttctgattaacccaattactttaaccccaactcactcttcaagacacaagtctaacttttttgaagataaagtaacataagactacaaacatttttccggttttagcagttgccaaaattgtgatcatgggccaggtatttgttctttccatatctcagttgcctccaatataaatggaacttaacaatagtagatatcatctatagcttttgagtggattcaatagcacgtgtacacacacatacacacacatacactcacatacacttaaagactatgccttcacatagtgaaggcaattgccttcgtgtgatagtctttaagtaaatctaaccaatgcttgattgcaataatgattaatagtggtagttttagttgtgtgagttaagacaagatgatcacgtaagtagctataacaaatatttagtgaacagttactatgtgcaagacactttttatgcttgacacgtgtcattttatttaatcatgtaacaacacaataaggtaaatgttattataattatccccattttatggataaggagagctgggatacagagattgagacagacaaatgaatataacaccagagagaaataagagagacctgttttagaaggcaagaaaacaagttaggaaataaaaacgtatctttcagatgctatataaaaatggtctagattcgaagcaatttgttaatcaagtgtaaaacataagggtaattaatgaaaataatattttcatcattagttttaagtttttaaaggtttttaagtatgttaagtattaagtatttttagttttaagtatttcaagtagttttaagtatttcaagactttaagacaagactgattttttggactcctagatacataattatgtgagttaaaattgggattatccatttttataagaaactactcaaaaattaaaatataaaaattttggctgctagccaatccaaaaactttcaatccttttaccatgtcataaagcaaatgctaactcctacttcctaagcatcccgacagggccaaactcttcatgctttcaaggatgttatctataagcatggtccacaggatagtttaaaatttctgattctgcttccaaatttgaactgcactcacatctcactcactctcatctcattttccccagcactttcttctccctcatcttcctatttctgaatggttccctggccagttctccagccaaaaagcctttggttacctagttttgctaaggactttcacaactgaggccaagtggcagtgtaattgcctgatgggtttgtatgatagttacatttcttctatatttttattttcaacttcagtagcattgagaaatttcatattagtatatttatgtgcaattggcattctttatattctattcatatcccatttatattatttcgtgtactgtattttttccattagactttttgtcaaggcagcctgaaacctagtaatgataataaatctgtgaccccaagagggtgggatgaacctatattacttttatttctcttgtgtcttcctggtgaaattgcctttacaaaaattatgacagtgaaataaatctgacctaagtgactccatcttgcttctaacccccaagctgcccttgcacattcctgggtgtgggcctagctaactacgggagaaacttagtttatggcctaactttggaacaaagatgataacagctccttcttggacaaaacccctcattgcttggagatcagacttcctttgtaaaactaacaaagtagccacaagattagaaattatttctcagaaatcatgcagccagaggccacaagattcctaacttctctgttcctgtgaataacattattattgtaaaacttaaggttgatttttgaggtattttttaggccctgccttctgatggaccaggtggtgccacccagactggtaaaccaacttacctgatctcacggcccccaggaactgactccatgcaagaagataagctttgactgcctataatttcatccctgacccaactaatcagcattccccatcccctagccctgtgtctgccaaactactcttaaaaatccgagcctctggctgggtgcagtggctcatgcctgtaatcccaacactttcagaggctgaggcaggcggatcacgggttcaggagattgagaccatcctggctaacacggtgaaaccttgtctctactaaaaatacaaaaaaaaattgtcaggtgtggcggcatgcacctgtagtcccagctgcttgggaagtataggcaggagaatcacttgaacctgggaggcagaggttgcagtgagccgagatcgtgccactgtactgcagcctgggcgacagaaggagactctgtctcaaaaaagaaaaaaaaaaaaactgagcctccaaattttcagggaggctgacttgagtaataaaactctggtctcttgtttagctagctctatgtttattaaactctctattgcaataacactgtctcagtagagcagcttttctgggcagcagacaagataaacccattgggcaattacactgccacttggcatcagttgtgaaagtccttagcagaaccaggtaactaaagccccagctttttggctggagatccggccagggccagggaaccatcagaagtaggaagatgagggagaaagaagtgctagggaaaatgacactgcaatgttgattgtgaacccctggcatcaactccaaaccatgcttatgtggatctgaatgtaatcagcctaatcgaaggaacagaccacctctcaggtcagagactaataaccactaacattggacacattggaataacacagcaaatgctttaaaaattgaactgacattggaaccacagacaataggatgctagatgtaattatcaactgaacttaagcatgttgattgcctgataaaacaacaatataagcattctccatagaaggtaaacaaagcctcttaatataatattaaatacctgtagatactttagtaggcagaataatggctccaaagatacccagattgtcatcctcaggacctgtgaatatgttaccttacatggcaaaaatggatttgcagatgtgattaagctaaggacctaaagatagggagcttatcctgaattatctggatggatccatagtcatcacaggtgaaagagagaggcagaagagtaggtcagcgtgatgagttgtgagaactcaaccagccattgttggtttggatgatggaggaaagaggccaagagccaaggagcacacaaaagtgggaaaaggaaatagattcccccctgcagtctctaggaaggaacacagccttgctgacaccttgatttagtcctgtgtaactagacttctagactgcagaactgtaagataataaatgtgtattattttaaacaactaagactgtaacttattattgcagcaataaaactgaaaagtcttttaaatgccactaaaattgataagactctagcaagattgtcaaagaaaaaaaggagaaagccaaattacaataatatgaatgaaatagggaattatcaccatagcatcataggcattaagaggatactgagagaaaactagaacaattttatggccataattttacttcttaaataaaaagaaccaaacactttaaagacacagattaccaaaattcaattaagaagaaatatatactctgaatatttttaaaaccatgaagggacttgaattcataatttaaatcttctcaaaaatgtcatctttggtgatgatgtcaattgttagtttctaccaaacatttagaagtaatgccaactctacaaaatctcctccaaaaaatagaagaggtaacactttccatttcattttatgagaccagcattacactgatatcaaagccaaagatagtataaaaatgaagatgaaggaggaggaaggagaggaatgagaggagggagaggagggggaggagggggaggaggggaagaaagggggaaaaggcggaggagaggaggaagaggataaaaaaatataaacatcatatattagcatgtgtgtatgtatgtctgtaccacaaccaaatgggatttattctaggggtacaagtctggccaatattttggcatcaatgaaatctgtattaatagtctaatgaaaaatgtaataattatttctttttttcaggaaaaatatgtaaaattcagtgttcattcattatagaaattctcagcaaagtaggaatggtaaggaacatcctcaacctggtgaagaacatctaagaaaaacctgtgactaatatcatacttaatgataaaagaatattggcttttctcttaagattgggaacaaggcaaggatgttcactctaacttctcccattcaatcttgtgctagaaattctaactactacaataacaattttaaaatataagaaataaaaacttaaaatgaagaaatataactgtccctatttacaagtgatatgatcatctacatagaaatcccaagaaatccacaaaagactcgtcaacccaatggagtgcagcaaggttatagtgaggtaggagaccagcaggacttattcctggtctcaacaggatgaagtgaagaaaccagcaagaatcagtagatgacaacagaaccaacctctaggtgtccccactgctcatcagcataagacactcccaccagtgccctgacagtttacaaatgcccagcaacacccagaagttactggccgttttctagagagttctgagtaacccactccttaacatgcatgtaattaaaagtgggtataaatactactagccaatagtccacatgctgctactgtggatgctcaggctctgggttagtgctgctccacaaggagctgtcattctgcggtacactgacacttcaataaataggctttctttcaccactagctcactcttgaattatcttctgagcaaagtcaagaacccttctggactaagccccaattttggggctcacctgccctgcatcaacaggatacaagatcaacatacaacaaaacaattttatttctgcacaatatgaatgtaactataaactgaaagtttaaaagaaataccatttacaacacctcaaaaatttggtataaatctggcaaaatgtgcagaatctgtatgcagaaaacaacaaatgctgattaaaagatatcaaagggccaaataaattgagacatatgatgttcatagattgaaagactcaacatagtaaaatgccatttcttcccaaatttagatttattgaaattccaaacaaaatcccagcagaactttatagatatagataagccaatttgaagattaatatggaaattcaaaggaattatcatagctgaaagggttttgaaaaagaagaataaaattggaggaatcaccctacctaaatttaaaatttactgtaaagctactgttatcaagacaatgtggtatagatcagctgatcaataaagcagaagatagtctagaaatatatggccaagtgaattctgtgcaaaataatccaatggggaaaagacagtctttgcaacaaatgatgttggaaaacctgaacatttatatgcagttaaaacaacctgacctggagtttgagaccagcctggccaacatggtgaaatcccgtctctactaagaaaaattagctgggcatagtggcacatgactgtaatcccagctactcaggaggctgaggcagaaggatcatttgaacctgggaggcagaagttgtggtgagcctagatcacgccactgcactccagcctaggcaacagagcaagactccatctcaaaaaacaaacaaaaaacacaaacaaaacaacaacaacaacaacctgacctaaacctcactttatccaaaatttaactcaaaaaacattatgatgtaaatatgaaatgaaaagccatggaactttttgaaaaaatcagccaggggtggtggctcatgtctgtaatcctagcactttggcaggccaatgtgtgaggactgcttgagcccagaagttcaagaccagcctgggtaacatagtgaaaacccatctctacaaattttttaaaaattagctgggtgtggtggcatgcactggtagtcccagctacttgggaggctgaggtgggaggatctcttgagcccaagacgtcgtgtctggaatgagctttgattgtaccaccccactccagcctaggcatcaaattgagaccctgtctcaaaaaatggaaaaaacaaaacaaaacaaaaaaacctttacaacttggtgttagtctaagagttcttagagataatagcaaaagcacaatcaataatttaaaaacagatcagttagattttgtcaaaatgtaaaacttttgctttacaaaagacactattaggaaaatgaaaagctaaacttcaaaattggagaaaatattttcaaaccacatgtctaacacagaacttgtatccagaatatataaagcactctcgaaactcaataaaaagaaaacaaacaactcaatttaaaaattcatgataatatcaaaaggctggtgagaatgtgcagtgactagaacactcctacattgctgttgggcactctcttgtttacacttcccatatgcctcagcaatactattcctgggaatttactttagaaaaataaaatttatgttcacagaaagatatgtacatgaatataaacacagctccattcataattgctgaaaaacgaaaacaagccaaagttctagcaatcaaagcctgacacatttgactggttaaaaaaaaaagtttatgttatatttagacagtttattacttagcaaaataaaatgagcaaaaatgccagatacccaagccccttatctcaaaggatgacactgaaacaaaaatagcgagtaatgtgatgatgtatcatcagtagtgggagcaacctgctgctgcagatccaattgcatcttgcagataagcagctttatactttgcagttgtgcccaaataacagagaggcagagagcctcaggcctcttcaaaacccatgaagtgatgagtaactgtctcatggcagcctccttggaagataggtagagggggtaggctcttcaaagcctcccacactctcatgttccaggaatatctcagagcattttaccaaaacttagatcagctgtagttaagccttggccaaatagcctctctagagacatgcagggaagatgtttatcataagcccagaaacccctctcctgggattagagagaccttagggagtgaaaaatgttgatcacacaaaacaattgtatgtcaatgtttgtaatagctctattataatcacacaaactgtaaacaatccaaatgtctttcaacaggtgtatgaacaaattttggtacattcatatcatggcatactactcagctctaaaaaggaaagaattattgatatactcaacgccataaatgaaatcactgtgttgtaaattctagatttgtatttcatttaatataatttcttcacttttaaaaagtgttaaacttatattttcttttgactattgaggtaaaatatacgtaacacaaaatttatcatgcaagtcatttggatgtgtacaattcagtggtattaagtgcattcacattgtttcacaaccatcatttctattcctcttcagaactttttcatcatcctaaactaaaactctgtacccattaagcaacaactttccattctcccctccccagatcctggtgaccactattctattttctgcctctacggatttaactattctaggtgtgtcttattagtagaatcagacaatatttgtccttttgtgtctggcttatttcacttagcataatgtcttcaatgtttattcatgttgaagcaatcagaattttattctttttaaaagctgaataatagaccattgtatgataagccatattttgtttaaccattcatcccgtgaagagcatttgggcggtgataatcttttggatattgtacataatgctgctgtgaacattggtgtgcaaatatctttttgtgtcctggctttcaattattttgctcacacagttggcccttgaacaacatgggtctgaactgcatgagtccacttatatgcagatattttcaataaaacttacactgaccattcctgtccctcctgcctccccttccacttcctcatcttctcccagagacagcaagaccagctcctcatctttgtcctcctccttagcctactcaacctgaagacaacaaagatgaagacttttgatagtccatttccatttaatgaatagtacatatatgttctttcttattattttaataacattttcttttctctagctttctttaagaacacagtatataatacatacaacatacaaaatctgtgttaaatggctgctatgagtaaagattccagtcaacagtgagtatgtgtagctaagttttgagggagttgaaagttaaatgcagattttcgactgcacacgggtcagcaatcctaacccctgaattattcaatgatcaatcatatacctagaagtaagatttctgatcagatagtaatctatgatgctttttacagtggctgtactatttttcattcccactggcaatacccaagggtttcagtttctcgacatcctcaccagtactttattttcttttctttaaaaacaaaataacagccatgcatcacttaatggtgggaatacattctgagaaatatgttgttaggtgattttgtcattgtgcaaacatcatagtgtgtacttacacaaacctggatggtatagcctgttgcttctaggctaaaacctgcatagcatgttgctgtactaaatactggaggcaactgtaacacagggtaagtgtttatgcatttaaacatatgaaaacatagaaaaggtacagtaaaaataaagttttataatcttatgggatcattgtcatatatatgttccatcattgacttaaacactatcatgtaatgaatgactgcatttagtaattatttatttatttttttaatttcttatattgttattgaaacaaaattttggttctttattttaaatggaactcactttttgttatgatgtaaatgacagatctaacatttttttcttccaaaatagacagccaattgccaaaacaaatatattatttttctagaattatccaaaatgctacctaaaattcctattccaaatggatctgattatacgttctgtactgttttccatagatctatttgattatttttgtgtcagtactatactgttttaatcatgatggcttttatgcttagtttaatagctggtacagcaagccttcactcacactcttctgtccaattgttttaaacagtttaatttaatgctgccctcaggctgagaaacttgtgccagaatgtaaattaagtacagcacttactataccatctactttacctgatagcaagacttttttcacaaattaactggtgcattgacctatattctgacacattctgataatgaactagttaaaaaataaaacagttcatgtaagttgcgatgggtggactgcacttgagttatattggtttagacttcttggctatgggtaatctaaagccagggaaccatgcttgttctagaaggttttttccccctgccctcctacccctcctaactttctatagcatgcacatccctgcaagtccctttcttgcattttctctctagtgtttctgatgacttttctcttcccatgctgcagcccatagagcgactgagcattaggactttctgaagggcttaggcagcatggaatcccataaaatctctggtatcatctctcacttaccaactagttaaaatttcatcttcttcctgagtggtgcaaaaactattctgaaatcaaattatgcattctttcttgctttattacttatagtttaaactctggctccttggaactcacaaatcttttttttctctcaagaaagttcactttttataataaaggcttgttttagactactgttgtggttattggcttaaaacattattcttgtagattttttaattcctgaagtttttctcagtcttttaggaaaaaagaaaaaacacaaaaatgtgttcaatgttagagtctgcttcgatctctacttatggttgaagtaatgaagacagagaagttgtagcatgggaaaataattatagtctggtaaaaactggtcattagaggagcctggagttgagggaaggaacaagagaatacaagtacaaagtagacatgcttgcaggatgtgcgcatttccccaggaatcactggaaacatttttggagggtatctgataaagactgagcattgtgtactcataatagatgagttatggatagtcagaccatgctagatgagcccgaaagggaagggtgactcctcagggtaaagaagttacagatatttgaattgcatgggcagtagaaacttacatgcagcatattattttaaaacagttcatttattcatagctattataaattgcataataaaaagaagtaaaaagtgaattggaagtatgtttctgagtgattaggtaatatatttcctacgaaattaacaactgatgagtagaagaggactcaagtagtttcggatccatccctgcttcttgggtagtgcgtcaataagactcttggcaggacacttcttaagggattattaggtgtcggtgcttataatcagcatcttatataataaggagatatcattatttcacatgtagagcttcagtttgcactcacgttatatatatatgtatatatatatatatatatcaagtggaatatattagtaatatttcaaaagtactgcaaatatttcctcatttcaaagagtgctcttctcttccttctactgctgaagtaatatccttgtatatctccaattttttttttttttttgagatggagtctccttctgtcacccaggctggagtacagtggtgtgatcttggctcactgcaacctccgcctcccaggttcaagcaattctcctgcctcagcctcctgagtagctgggattacaggtgcgtgccaccacacccggctaattttctatatttttggtagagacaggtttcatcatgttggccaggctggtctcaaactcctaccttgtgatccacccacctcgtccccccaaagtgccaggattacaggcatgagccaccacgcccagccatgtgtctccaattattaattctagaaaaagataaaggcttattttatataaattccctccatatagataacctttttatccctcagaaaatgtacttataaaggagcagaaatggggcaaaatggtttcacatgctacttattgacaggaaaagacttaaagttggggtggaaaagaggattcaatatcatgttacacaattcttcataagatttagtttgctttttcttggaagcacagattaatttggagtcttttacctttacatatggatttcaataacctttttttattcttagtgtataaaattgcctgccatttccctcccacaagtaatatcattataattttaatctaattagtttgcctacatacttgcattccttcatcttcttcctattccatttattaatatcattctttcctctctttattacctattttgtcataggaatatagttcaatatcaagtcagcatttacctgacaatgatactaaaaataataatacaacatttcttgaggacttattagctcccagtgtatatgttaagcatcttacaatcttacacaaattatttcatttcattgtcaaaacaactttataatatagatactaatagtatatttcatttatgaggaaactgatatttaatgatggagtagtatcatcaaggtatcacataacttgaaatggaagaatcaggatatgaactgtctcagttcacagtatcattataaatttaagtgatattttttaacttaaaagtaacatttatctcctataaacctttttattttctgaagtgtttttaaggatagttttctaaaattaaagttcaaaatgaaataattcatttacattcttggaggaggaatgaacgataggcagtttattaaattgatatttcctatcaaaattcttttagcttccatgttcatcttcttttctgcattgctattacttctaaatgatatagtcgaaatgatattctttcaaatttgaccgagtttagctatttatccactgaaaaatctcttgttgaaatttgatgtccaatgttggaggttgggccttgtgggaggtgttgagtcatgggggcagaaccttcatgaatggcctggtgcccttctcaaagtaaagactgagctcttgctctattagttcctttgagaacggattgttaaaaagaggctggcatctctctccctttctgaaaccatgtgatgcctgctccccttcaccttcctccacaagtgggggcagcctgaggccctcaccaaatgcagatatcagtgccatgcttcttgtacagcctgcagaattatcagctaattaaacctctttctttatcaattacacgctctcacatattcctttatagcaatgccaacagactaaaacaaaattgagaaacttcccaaatagatcactctgggctaagttgtcagtagaataacatgcagaaaactttaccagtaaaactgcatagaaattaccagaaaaacaataatatatgaaaaatcatttccatgactaaagtaagctacaaaagttatgagactcatgtataccctctattctggaaagaaatgaaataatcccctatactgatagggcagatcaggagaatcagccattccctcccttgctgcagcctcgtcaaaaataggtctaatgtaggctttgggagagcttaaagtcagaacagagaacgatgctctggcaaaagaggcaaaccatgtggtctgaacagagggagcagtcactttccaattttttttttttttttacaaataagcgtaagaaagaaacaagtttcaaagacagtagggaagaggaatggatatttaatagcttggtctcaggaccactcaggttccatctacaaattgtattgttggcatttgattaaaacttacttattactttttaaattaaatgactttattaatatgtctattttagatactcccaagagttacgggaaagggaaagtatgttcgttaggcaaaattccatgaaataaatccctagggaactttaaactttgtttcagttttttccaatgaacatgtattattttacaatggaaaatttcaactaaaattatttccagtaagatcataataagtctaaatttttcaactaaagaatctaaatgtagttgttattcagcaactactcttcctcctgctaggtttaatgctactggatcaactcaatcttttccacaatattgtcactcatacttgcttctttctgtgagtctttattcccttgacatagttgctatttcctcctccacagggagcaactgtatctcaggcagttacaaaatcaaaaattttctgtcaaacagcaaaatagggttgggcacggaggctcacacctataatcgcagcactttgtgaggtagagatgggtggatcactagaggtcaggagttcgagaccagcctggccaacatggtgaaaccccatctctactaaaaatacaaaaattagctgggtgtggtggtgcgtgcctgtaattccagctacttggaaggctgaagtataagaatcacttgaacctaggagacagaggttgcagttagctgagatcatgccactgcacttcagcctgtgtgacggagtgagactgtctcaaaaaataaaaaaaaaaacaaaaacacctcaggaaaataagattattaaactggaattaacaatttgtctcttacaggctaattggaatggagaatttttctgaagttggcggccagcctcattaaaaaaaaataagatctcaacttttaaacataagctctctattcagctagattacaaatatgaacttgtaaagtggtaatgctgattttcttccttagttccatatggtaattagtaatgagagtaaatgaaatagggtgcggacatagacaaatgatagcaaaatttcagaaacaagagactgcctaatgattaaaacagattttaaagctacagctataccacaaataaattgcctgttagaagctaacaaaatgtcccaatagatacattgtaaaacttaaccacacatagaacatagtgtgtgacaactcattttaagatttagtgtaacagtgactgatcaccaaacctaatgagtggtacaccatgaaatatccctcttgggggatcactgtgagtgtccttaaagggaagaaaatctcttctgagacttgtagttggttataaaattttcaaatgtttgaatcagtgttcagacttaggatcacttttgatgtgacaaaatacattaggtctatctttcagaaattacccagcactttgacccatgccataaaatttctatatcacattagaaagtcccattaggatacattgcagtgagaatctggttaagacctgcactgaagcgtgtttttcaatcttactgtacatgagggcaaatttttacttccttgcctctgcaatgctgaggcaagttaatttttacagccaaatctcatgtcactggtctactggttgagaatcagactcaggaagcacatcctgtgcattctggactgacctgctacaagaccctggtgacttgccatctcctgatgggaaaggaaacatcagatggatactcagaacatcactgggcattagtgtggttcctaaccagaattttgttcaatctgcacatggtccaagagattatctgatagggatcccacagaattgtgagattttaaaactgaaaggaatattagaaatcatatagtttcacccaaatacattatagatgtgaacaaaatttattgaatggagatagtacaatgagacaacatatctacatgtcctttgtgatggttaattttatgccacagtactcagatatttggctaaacatgtctggatgttgctgtgaatttatttttaaattgaggttagtttttaaatcagtacacttgagtaaaacagataaccctccatgatgtgaatgagcctcatccaataaattgaaggctctagaaaaatgactgacatccccaaggaagagaaattttggccaaaagcctgccttcacactggagctgcaacatcaactcttccctgggtcttaggctaccagcctaccctgcatattctgggcttgccagtctccgaaattgtacaagtcaatcccttaaaataaatttttctctctccacccacctacacccacacacacacatacacgcacccacctatacacacacacacacacacacacacacacacacacaatctattggttctgtttccccggagaactccgaccaatatactttcatccctgcaaggacctctcatcacagtaagtcattgaaaatccataacgtgacctataaattcctcatgatctgactgctggagacccctctgacttagtttactaccatttcccccctcactcattgtgtccagcaacactgaccttctgggtcagtttctatgttgagcttttgcatgtaaccctctcctgtggaatttccttccccagcaagagcacactctttcatttcactgaggtctctgttcaactctcactctaaatcctcacaacacaagtgggatttatgagctagtagcattgacatggcccaggagcttattaaaaataaagaatttatcacagatcttatcctagacctactgaatcaaaatctacatattagtaatatgccaggtgattcatgtgcatgtcaatgcttgaaaagaatagatgtaaagtgtcacctcccattgctctttggctctttgcctgcttcttcttcatggcattcattactaattgacattatattattttttatttacctgttgattgactgtttctctcactgtaaatcctaaatggcagggattctaatctcaagactggaatctgacctagcacacagtaggcatgcaatagatatttttactaactgaagaaataaatgtcaggcttggcagaatcttctttctcattgtgttttatgtctatagcattctttatcaactctatgttcctttaactcctacttagaatttaggtctcagtcaaggcagtgcttcttttgggaaagtcttttttgatccctccggtggtgactgggccctttggtgtgcattcatgcactgactcatcacagcacttaaaacacaagagagtaggtcctccatgaagaattaatgagtgaattcatgctggtcataacaaataattcttgactgaccactcaacatcctctacttgctcctttctatgcaatgactgatttttgtgcagatatctaatatcctccaatatgctgtgctacaaaccatatctcttacccactcccagggagtatgatctgacttgcccaagacaaaaaatggcagtccccttttccttgccagtgactggtttaagaacgggcaagtgctacagttctcattaaggagagaggagaccatgcccaggttcttagggagaggcacaaaataaggcaactcttttctccctctgaaaacttttgttgtgtatgtgtgatatcagattactataaccatcatgctaatagctattaagatgaagccaacccgcataaaagggtttagaaaaaacaatagcagagaagtgaaatcagaacttagattgtcctgctcttggactttgtatcatagcgtatggtaagtgaaattagcattgagttatttgaacctggaagcatcattttactttggtgatatgagtgtaaacttaaaaactacctccatagtggttgaaaagcaaaagtaattattagtctctgttaatgtacatattttcttttttttccccaactagaaaatttaatagtagtaggaggatcttcttagcgtaatagtaagtaacagacccttaaatttataaaacttatttgttactagacattaatcaacaagcatttactaaacgtataactattatactataatagagaaaatagcgattttaattttgaagcaaatcaagaaattcttatttgttgttggctgtccgaaggagcatgtttaggtcacttagttaaattctttaaacagtgatagaatcagtaaagatgttgaaatatccaaaatctatgatctccgaactcccaaaagaaaaaggaattaattgcgatgtatttcaaaaagtaagtgtacagagagattacaccaatttgttatctgactaaattgttgcaggactctgtgtaggaacagtacatacaacaaggcatcttttaaaggacagagtatttcctgaactacatattaatgttatttagacagattttttaaaagtttgatatgtacatcaatataaaatttaaaagggagtcatgggtgggggaaatgggaaaatgctggtcaaggtgtacaaagtttcatttaggtagcataaagaagttctggagatctaatgtgcagcatggtggctataattaatgatattgtattgtatctttcaaatttgctaagagagaaatcataacttctcagcacacacatgaaaataataactatgtgaagtaatgtatatgtttattagcttgattgtagtaagtattttacaatgtatacgtatatcaaacatcatgttatatactgtaaatataaaaaatatttgccaattataccttaataaagctgaaaaataaataataagaagcacttataacgccacagtccagagataatcacagtcgaattttctggtattttttcaatagttttatatgcatattttatgactttaagtataaatctaccacaatttaatcttcccatattttttgatatatattttgtttgactattataaatagtactgtaatgaatatgctttgcataaaactttaaaaaataaataaaacagtaaaaaagaaatataaatgaaaggagagtcaataaaaacctggatccaatgcacaaatgcatggtggcatctattaattcatttaatatttattaaatagtttgtgccaggtattgtacttgacacagggagtacaatggtgaacaaaactagaaacagtctctgaccttttggggctcacatattcaagaaggaaaacacttaaatagtaacacaaacatatgtttgaaagtatgaaaaaacattactggaagctgtcaaggaattttcaatgagtgcagaatatttgaaaagcttgagatataaaagatgaacagaagttgtaaggtgggagaagagatatctgagacaaagggtagagaataagcagaggtcctaaagtaggagcatttttggagtcttgtggaagtaaatgatttttttcgctgtaacccagagaacaagagtggcacaagaaaaatatggaagtatagtaggatattggaccctgaaattgtttgcaaactatgttaaatgtatgttatttatcgttaaaaaatagtgagatatctacttatattaagcagagggtgcaaggggtgcataaagaggtgagactgaagtctgtgcatgagaagttcaaatttgcattttagtataccctgcactacagacactgaaatacagataagcaaaaatggatgtaggtgcaccagttgagggctgttattgtgattaaggtgaaggataatggaagctttaactatgatgatagtaaaaaatgagagaagtgaacagaagagaaagatatctaggaagtagaatcaataaaatctggagatgagtttaaaagcagggtagcactgaatggaggcagatacgagacttaattgaaaacataaaacaggaagagaggaaatgagggtagtatcttttcttctatgaagtttgactataaaataaaaggagaaagacaatgagatagcttacatctaaaggaaattttgtttaagtgagggagacttgtgcatgtttaaaatattttgagaaggatccactttaagtagtaaaacacacatgacatataaaaatataatgaataaagtaagatttttgagaccaaaaatcaggaccagagtaagctggaaacatgggctttggataggaggaacaacaattcctctattggaactggaagaatgcagaatatattataagtgctagattttattgagaatattgctgtttgctgttgtttttaatctgtaaattaagagacaaggccatctgtcaaacatgaaaggggaacgcacgaacaggaagtttgaagactgtggagaaggtttgaaattgtaattgcaaggagtcaacatgatcagaatagacaaaatatctataggatttgtagataagatgaggttcaaatgagattggcaagcattaatttatagcaatgtcaatctgcctgttgtgctttgtctcttgaagctcttggccacctggctctagacatggaaaagtggatagttggaatcatccaagatggaagcatttgaatgaagcattctaaagcagttataaacatggattttggtggaaacctgaggcattcattgtattactcaaggagaatgggtagactaataaagaaaaaggaagaatatattagagttggacaagccagcaaaagagacagataagtaggtagaagtaggaagaaagccaagagagcctattatcatgcagaatgaaggagagaaagcaagaaaggtcactagtcagccgtgtcgatgtgaaagggaggtggaaaccagcactgaacatttagtaattaaaatgtcattaattctcttgaaaagaatagactgcatgaggtaaaaaaatatgtatatctgaaggactaaagtctgagcaagacaatttcaagaaacttgtactggaagaaaaaagtgagagaagcttgccatcaacttaacttttaccagcttaaaatggattgtttgttattcttccatctgaaaatttaaggatccagataaaatggaaggagaaaaaacggtcatcatcaaactgctaataatgataaattctggagaggaaatggcgttggaaatatgcaacatcccccattgtttattgtccatggttctctgttccttgaaaactgtcattgaaaaaagtagcattttttgtaattataaagtcaattaaaaattctagaatgcttctaataatttgacactttatttctagtattatctctatcatatttttataatgtatatctatgtcttacaacatatatcaatgcatatctagtattattatatctttcttatttttacaatgattcataaagaatacagctatagtaggcattccttcaaattgctcaagactgttttgatttctaacttaaatttaagttttcaaaagttcttcagcatattgagatgtttttgtcttctttttagcacagctaaaatattgcaaaatccctttctaagctaattttccattaattttccatgtggatatgagtcttttatgttttgttttattttacatcaacaattttcacgccagtgaattaaatacagctttttatttcactgctgaatgttcttcagttgtctgtaaaactgaatacattaaataatttattataatttaattaacaacatatgcttacctagtgacatcacatataaaggtcggctccaccgtgaaaatgctccaacttaagacatgctcagaagtcattttaaattttggttgtttttattgttgtttgactattcaattctgggtgataaataaaacgctttcccatgctgtccttacactgattatactcaagattgctttctacctaactcaaacaaaaccccccaaaacttacaaatatatattggttgctgaaaatgctcatacactcaatttgaaaatattccaaatcttttatgggttagacttttgtttcttgctcaatttcacactgacgtgtgtaaaagtattataagcatttgctatttagttcattatgggcaaaacagcagattgttttgtattttgaaagcatcctccctgggcttttaactaatctctcaatcacatgagaaaagctaaagaaagaataagatgctagcctatatacacatcatagaagcttgaaattggccaagtaccttggcagaaagaagggtgcttttattctagtgaacagaacaaagtagaatgaatttagatttttttttttaggagagaaaagtgtgatttacacaggaagagccatttcgtccaggtttgttgagatttgggcagtgtgttctacagcaaagacatctcccctgtagactctggaacattctgtattatcctataacagatgatcagccatatggtgaagggggaggaaaatcagggatataagaatctgctgtactagtagatgcatgaatgagaaaacaaaggttaaagccaaatttggggactgtggctggttttctcattttattttagagattttttattgagtagcacttcttggcatatgccaatatatttttaaagttatatttatgtattaagttttcttataaaaatatttttaaagttctctacaataacaaaattgagataaagtctcacaatttgttataatttggatacctctgaattattaaaattaactataaaaactcaaaaagtctagcgtttcagagatgttataaaacattttgaaatacttacatgaaataatctaattattccagtatgcaagttcctgctggtagtaggttagtaagttgttttagaaatctacagtaattctttcaaaacacaaaaatatagtgtggtagtaactcatgtaattttacctcagctgtttaaagtcaaaccaacttcaacactatctcaatatgttatgcaatcattcatatagcctaagagataaaaaaaagttttataaaatgacattggtagaaaagagatctgacacttgcctcccactttgcaaactttctccatgtttttggtatttatttatttaattaacatacaaattgtagatatttatggagtacagtgagctgctttgatacacatatatagtgtaataataaaatgagagtattagcctatccaacactttatacatttatcatttctttgtggtgagaacattttatatgcttaggctttgtgtccccagtcaaatctcatcttgaattctaatccccataatccccacatgtctagggagagacctgatgggaggtaactggatcatgggggcagttctcccatgctgttcttgtgatagtgagtgagttatcatgagatctgatggttttataagaggttcttcctgccttgctcctcatgcttctctctcctgccgacatgtgaagaaggtccttgctgcccctttgccttctgccatgattatagttttctgagacctttcaaccatgtgaaactgtgagtcaattaaacctctttcctttataaattatccagtctcaggtatttctttccttttttattattatactttaagttttaggatacatgtgcacaatgtgcaggtttgttacacatgtatacatgtgccaagttggtgtgctgcacccattaactcgtcatttacattaggcatatctcctaatgctatccctcctgcctccccccactccacaacaggccctggtgtgtgatgttccccttcctgtgtccaagtgttctcattgttcaattcccatctatgagtgagaacatgcggtgtttggttttttgtccttgtgatagtttgctgagaatgatggtttccagcttcatccatgtccctacaaaggacatgaactcatcattttttatggctgtatagtattccatggtgtatatgtgccacattttcttaatccagtctatcattgttggacatttgggttggttccaagtctttgctattgtgaatagtgccacaataaacatacgtgtacatgtgtctttatagcagcatgatttataatcctttgggtatatacccagtaaagggatgttatagcagtgtgagaatggactaatacaactttcaaaatcctctcttctagctattttgaaatgtgcaatacaatatagttaatcatagtcacccgtctgtgcaatagaacagaagttattctgtctatctaactgtaactttgtagccattgacgaacgtctctttattgattccttcccctctacactccctagcctctggcaaacactatgtctatgagatcaacttctttagatttcacatatgagtgagatcatgcagtatttgtctttctgtgactggcttgtttcactttatcttccagattcattcatgattttgcaaatgacaatatttcattttttgaatggctgaatagtatcccactgtgtatgtataacacattttctttacccattcatccactgatggacagttaggttgattctaaatcttggctattgtgaatggtgttgcaataaacatgggagtgcagatatctttaacactgatttcttttcctttggatgtatacccaatagtggaaatgatggatgatcccatagctgtatttctaattttttgagagacttacattctgtttttcataatggctgtactaatttagattctgagtaacagtatgtaagtgttctcctttctctgcatccataccagcagttgtcattttttgtcttttagataataaccattctgaggtgaagtggtatctaattgtagttttgactgaatttccctgatgattagtgatgccgaacattttttcatatacttgttagtgatttgtatatgattgtatatggtgtttcttttgggaaaactctttccagatcctttgctcaatttttaattagattgttttgttttgctttgttttttgctattgagttcagttgagttccttatattttctggatattaaccccttgtcacaagtgcagtttgcagacatttactctcattctgtaggttgtctccttattctcttgactatttccactgctgtagaagagacttggatacccatgtcttctagtttcatgtaacttaagttgttgatttgtttttgttgtctgtgcttttgaattcttgaccaaaccaaagtcataaggcatttggaaaagtacagtctcttcaataaacagcactgggaaaactggatatccacatacagaagaacaaaactaagctcttatcttttaccatatacaaaatcagctcaaaatggattaaagacttaaatttaggaccccaaaaatataaaactactagtagaaaacataggggaaatgctttatgatattggggtcatttattttttctcttgtacatttgtttaagtttcgtatagactctggatattagacctttctcagatggataggttgcaaaaattttttcccattctgtaggttgtctgttgctctgataataatttattttgctgtgcagaagatacttagtttaattatatctcatcaatgaacccattaaaaagtgagcaaaggacatgaacagatacttctcaaaaaaagatgttcatgtggccaaaaaacatatgaagaaaagctcaatatcactgatcattagaaaaatgcaaatctaaactacaatgagatatcgtctcacgccagtcagaatggcaatcattaaaaagtcaagaaacaaaagatgctggcgaggctatggaaagatagtaatgcttttacacagttgatggaaatgtaaattagttgaaacattgtggaagacattgtgacgattcctcagagacctaggacaaaaaacactatttgacccagcaatcccattactgggtatatactcaaagaaatataaatcatcctattataaagacacatgcatgcatatgttcattgcagcactattcacaacagaaaagacatggaatcaacgcaaatgccatcaatgatagactggataaagaaaatgtggtacatatacatcatggaatactatgcagcaatacaaaggaatgagctaacatcctttgctgggacatggatggagctggaagccatcatccttagtaaaccaaggcaggaacagaaaaccgaacaccacttgttctcactcacaagtggaagctgaacaatgagaatacatggacacagggaggggaatgacacatgagtcttatcagcaggaacgggggatgtggggagggagagcatcagaaaaaatagctaatgaatgctgggcttaatatttaggtgatgggttgacaggtgtgacaaaccaccatggcacatgtttacctatgtaccaaaactgcacatcctgcacatttaccctgaaactgaaaataaaattaaaaagtgagagacagaacacaattgacaacagatttcaatagtatattttattacatttttgcaacagcattcttcttggcttttccttcaaaaatgattttccaaattttgtactgagataattaaaaggcaattgagttttttctaaaatagttgattaaaacttgtttccattagtgtttatttttgttatgtatttatcttatttgttaaataatgaaaactatttactttttatttttaatatgtattattttataacatactgcagaaaaatatatttcatcttcattttataattcacaatgttatataaaacctctctaccaagttctgtcataaatgagctgaaaaatatcagaacatttgaagctgtcttctgctatgtctaatcttaagcatccttagaattgattattctctaactagtttgatattaatgactccttagagtggcagatttttctttgtgttatttcattgatatttgtgtttggtgtcaaattagcaagaaatctagatatttttctcatgtcctcctaagtcacattccttgtcactgactatcaaacattcaaaatgtatccattatttatgttaatatttaactctttctccaaataaattcctgctttgatatagtctgatattttattacaattggcttgcagataactttttgttgattttatcattcatctttataaattatatttcataatctatgacattaatgtcagtactctgttatttaaccaataaaagtaaagatgatgaaagataatatatttgatatacatcaatttttatttctacaaattttcctttgtgttatttgaatttagaacatttcaactaaaatggcatttctgggccttatcaatagtttgactaaatttttgaaatcttgtttgtatttgggtttatcttttgaatcttttatataatatttcagagcttttaaaatgttgatgtatctatcatgcaaaaattggacagaaggggttgtttttgacagaatctggcttagaggaagtaaatttgggaatgcattaagtttaggtttagtgagttctacttatgtggttgacagtaatttcaatgaatgatgtagaaatggcttccaggaatatttctacgacccactctgaaaattcactcaaactcatggcaggagagtacagaaacacatatcgtattgtaatatgaatgcattctacaaccccatcaactccagcaaacacaaaggaatgtgttgatggaggggaaggtatagtttatagtcatctttataggtctgcagaagcatttcttgcctggatcttagggcaatacaaactataacttcacacatcaggaggcccttcatatcacaaatactcacataaaatatttgttagataaattatgggcaattctcaaccaggatctacattcacagctgatatagtgcaactcctaactttaaacatccactctcataagtaacatcaacaggccccagggaaatacttctcatatcttgccttaacttctcgaaacaaaaggtagttaattttgaatgccttcaagacttgtgtgagtcagacactgcttctaagttcataaagtgtttgaatagataaagcatttaggtaaaagaagaaacaaattaaccaaatagtcaaatcttcctttcaagtagcaataatgcaatagattcttacataatgcagcattattttccagcaatgctccagcatgcacttttattctttgttctatgttccaatttgttgtttctaggtattcaaaaagttgtgcagtatgcccaagatgcaggctaagaatgatcttacagtattaaataatggacctgaatcttaaatttatgtacatgtgagtgtctattggtagtatgtgtgaagtatatctttacactgacaatgagatggacactaaacatttgaattgcaaacagattttacacttgaaaatatttaatcagatttaataaaatcttcaagaatattaagcatgttcagctttattaagataatttttattgaaaattttgaaatacataattggtatttttaattgaataaataattgaaatattttaaggactatattattttaaacatgtgtaaactaatttcatatgtaaacaaatttcactgtatgaaatttaaatttttgatgaaaaaatatagctaattttttaaaatttggaaaataatcatgcttttaatcctttagatcattattagtaataaagcttaacgctattacaattttatttcaacaatgtaactagtaattttgcaaatataatgtaattaaaataaatttcatgaaatatataattatttagaaatatctatgtcattttattcctcacccaacatccactggcccatctactgtactcccagacatgcagaataatgataatatttagtaattggtattctgcagatttttagttatatataattcatagctgtacacctgtgatttcttgctaaacagaatttttcaattttaaggtagatgaatttaccattttcccccttatagataataattcttatgtctggttaagaaatttttttcctaacccaaggtcataaagatattcaccttttttatttcctaatattatatagattttgtttctttatttagatctttatgtagaattcgtttttgtacagtttttgagatttgcatctagttacattttttaatatttctagaatcatttattgtaaagcctaccctttcccaacatctcataagaaccacctctattatctatcaagtctctacatatacttgtatctatatattggctcttaattctctttcattatctatattcatattgaagtctatatcctcaatttgtatgccagtaccacacttccttaaatactaaatctcatgctggctggtagggcaaatatgttcaaattattgttctacctcaagagatttttggcttttattgactctttgtactttcatataaaatcttagaataagccaatcacttttcacacacaaatcaaaaacatattgtgatattaatttaaaattctttaaatcaatacacaaatttttggaaatgtgacatctttacaatattaaatattataatcatataacatggtctattagcccatttattttttaaatgtctctaccagcaccccttagtcacaaataattatattttctttcaaaagtgtattaaaattgtgaatcataagtactttgaaattaaataaaattcaacacatatgttgatctcatactatattgtaagtgttgtggtaagacaagagtacggaaccaaggaaaggcatgcttattatgacagtgttttttaggtgtgtttttaactgcatcatttttgagtattgtttattctttttcgaaatactttagctgaatttgttatctggtttgtgttttatgtgccctacaagatacttatatcaatcgaacatctttctgcacattctcatcaagagatcaacagaaagacttcaccacaagataattaaaaataccaaagcattcacacacacacacacacacacacacacaccccagaactttcaactcagcccagattatgcaaattattaagtaaagctaatgaactgaaatctaatatcaatctggaaatgacaggctaaaactgaagctgatttagaaaacaatcccaaatggaaaatagatctgtttcaagacagttttcatttccaaagctatttactccttgtttgagtaaataaactagagaaattcaatttcttctctatttctatagctcatttagctatatatctcacagttgtagtcattttcaaactataattctggaggtggcaagatagaacagtatgttcctaactatgacttacttatttaaatttaagatttatacttttcttggaaattatgaaaagaagtaaaattatttatttgctaacttgatgttcccagctcctctaatcaatcatgtatttctgtgtcagtgtatttctttcagtacttttcatttgctcttttaattattcattcacttatttaactagtcatttattctttcgacaaataggcactggatatatgtcattataaaacagaaacttagcctctgtgatcagagactttacaatgactccaatgatattacataattttcagatgttggcaaaataatttatttatttatttttttttttgagacaaagtctcgctctgtcacccagtctggagtgcagtggcgcaatctcggctcactgcaacctccgtctcacaggttcagctgattgtcctgcctcagcctcctgagtagctgggactacaggtgcgtgccaccatgcccggttaattttttgtattttttagtagagatggggtttcactgttagccacaatggtctcgatctcctgacctcgtgatccactcaccttagcctcccaaagtgctgggattacaggcgtgagccaccatgcctggcctaatttaaatattttctaagtatacttaagtattattgcagaggcatgtcataacctttgaatttcatactaattcatgaatgaaaactgacttctaacaaattcatagattaaaaactattctcaaagcatacacagtgagtaaataaaggagaacaccaaaattagaagagaacatagaaaaaattccatgcagttcacaaagtttatatgtataaattggtaggcgtaaaggtatatgtctgtatatatgagtatatgtgtgtttgtgagagagcaattttcactacaaattcagggttactgtattaaaaattcatagcactgagagggtatttaaaaataaaatacactttacagttttttaatgcaagtttcccattaatttgatttgctgtagattatttaaaaatcagatattattgacaaaactaaaaataaatgaacaaattcattattcatccattcattcaacaaatacttactaattattataagtatatgctgttttaggtattgggtatacagaaacaaagcaaaaaccttattcccttgtttcttttttttttttttttttttttttttttgagacggagtctcgctctgtcgcccaggctggactgcagtggcacgatctcggctcactgcaagctccgcctcccgggttcacgccattctcctgcctcagcctcccgagtagctgggactacaggcgcctgccaccacgcccggctaattttttgtatttttagtagagacggggtttcaccgtgttagccaggatggtctcgatctcctgacctcgtgatccacccgcctcggcctcccaaagtgctgggattacaggcgtgagccaccgcgttgtttcttgcattaaaatatcaaacactaaaaataataagtaatagttgttatataatcacgacatggtaggaacgacatgtgttggtccacgttggtccattttgattttatctttaaacagcacagcaacacaggtatttgtatacccatgttagaaagatatgaggatgatagtttttacatgcttgaaagaaaaaaaaagagagacatgagaaaataaatatcaatagggatgttatttttcatccaaattaggtctaaatttatgtgtatgtttttgtatgtattgggggaggaagatatattctagctgaaagtaagatttttgttaatagtttgaaagaacttcaaaatgctaacaatttttaacatctaagactggaacttaattttatgtctaacgcagactgtccctttgtgctggaaaaccaacacagttgagcatatcatattgaaaacaagtattcattgtttttggagaaaaaccaaaaacaatgtaacacgaaattctgactgaaaacttaactgttttgttttctaaatgtaaattgagtatgactatctttaactaccagtacctctaataactaaggcttactgagtgtagggcattttactgaggctttaaataaaatgcctcatttaatcatgacactatccctccacagtttttacagacattggatagatgaagaaaccaaagcttaggggaatttcagtttatcattggccgcactgcttttaagtaggagatttctgagctgatgcgttaaaccaatatattataataataatattcttaagataatatttcctttgtacaaagtatgcactaacaattcagtttacctgtatacgattgcttttttttaagtaaatatatatgtgtgttcttgtctgaacatttttcacaggaaaatggacatcacagtagtcaaaaacttcagcaaatgtacaggcctagtttgttttgttttgttttgtttttcagtcaactgaagaagaaattgtaaataaattagtaggatttggtataaaaacacagctcagttgggattgttgatgatatttaaacacagacaaaaaagcttttgcaccactttcctttgtgcaatgtgggaattaaggaggagggcctggtccaggggttgtttcatcctaaactgatggaaatcccaggaaagctaagcccaatggaatagcactctcatgatgaccagcatccagtgtggagcacaggagaggttggagataaagaaggacgttttcctaagccaatgagacagcactgtcagaaacagtctgcagtagctgggggaagacttggaggctaactatatttttcaacagacttgatggttattctaatagttaagaggacagattctgaatttgcacagcttgaatgcaaagtcttccctacttattattgtatatccttgggcaaattaattaatattttggagaagcagtttcttcaactcaagattgtggaaaacaagaatgtttatttgtactcctgagagaattaaatatcctgattttgataaagtaattagcatcgcacccaacacagatgaagtggccaagaaaacttggctttttttttatcattattatagatgtacatgtatgatttgtggccatgagctgcagcttggcattacatagaattgagggcaaaataaaaatattcatcctctggcgatcttcatttaactaagttttacttattaaaaaattatcaactacaatctcaaaaataggttcccttacattttagtctggctgataaaagagtaaaattttaaaaagggtctttatttgttgtctttacctcctacacctctattcagctttgagagatagagatgtaatgtacatgatattggagacatggacactggtttattggaggaactctgcagttcacggaattcttgcatatgttatagatcaggaatatgttaatttgtccctgaaattactctaacaccaatggcaattctcatccccactcacccttagaaatcgttaagactaagccagatggggctaatgaacactagtttccattgccaagaattagattaacttaaaagaagagaaaaaaacttaaaaaaataagatctatctgaaaaagtcactatgatattaaagactactctaatttcctcgtcatactgtactacaatactttttccccactttagtttattaaatgatgaaaaaggtaaaaaatgagaactacctctccaaggaagtaatattactctattttccttgtggttgctataagtatattagcacccttggagaccaagttaagcaaaataaaataaacaaataaacaaaaaccatgttgctaatgcaaccaaagctcctggaacttataaaagaatctgtgtccaaaattttgtgttcttatacttggaaaggaaaagcatgaagtatcattttaaaatatttcagtttatttttcttcttcaagaagcaaactacactgctagacattttttttcaaaatgttcaaacaattaaaactgttccaaattttctttgaggaagtaatttcagtttaaagttttaaaaatagccaaagaggataagtgaatgcattggtttacaaaatttcattttttattttatatatttgaaacttgtatattttaggatataaaaaagagaaaaagagaaagaataaaggagtgtctgaaaacatgcatggacatagtgtagtcccttctgagaagcaatatgataatgtgaaaagtataaaacagagaaagatatgcaatcagaaaacatgggattggttcaagaataacccttactgggaatcagaaaaactatataaataaaacctgagtgatagtgactacaacatgatgaactgcaactcctttaaatcagtaaccgaaaacctcccaaaaaagaaaagctaaggaccaaactcgttttacaaggctagcattacccacataacaaagtcagaaaagggcactgcaagaaaaaaacatatataggccaatattcctgataaatatacatataaaaatcctcaacaaaatactagtaaactgatttcaaaagctaattgaagggatcatgtgctatgataaagtggggtttatccctgggatgcagatgcaaggatgattcaacctatgtcaatgaatgaatgtgctacaccacattaacagaatggaaaacaaaaactatatggttatatcaataaatacagaaaatcattgacaaaattcaacatcttttcatgataaaaatactcagcaaattatgtataggaggaatgtaccacaacataatataggccatataaaagaagcccacaaaccccataatcaatgaggacaagctgaaagcttctcttctatgatcaggaataagaaaagtgtgcatacttttgccaattctattaaacatagtactggaagttgtatttaaggcaatcaggcaagaaattgtttttaaacaaaaggtatccaatttataaaggaagaagttaaaatatcactgtttatagataacacgattttatatatggtaagacctaaatttttcacacttgaaaacaacctgttagaaataaaaaacaaattcagtaaagttacaggatacaaaatcaatatacaaaaattagttgtgtttctctacgctaacagggaactatccaaaagataaattaagaaaacaatgtcatttcaacagcatcctaaagaggaacatacttagaaatatatttaaccaggaaggtgaaagatctgtttactaaaaattataaaacattgatgaaataaattgaaaaagacacaaataaatggaaatatgtaccatgtacatgaattggaagaattaatattattaaaatatccatactactcaaaataatctatagattccatgcaatttctatacaaattccaatggtatttttcacagaaatagaaaaagcaatcctaaaattgacacggatccacaaaagaccatgaatagccaaaggaatcctgagtaaaataacaaacctagaggcatcacactatctgacttcaagatatactacaaagccatagtaaccaaaacagcatggttggcataaaaacacatggaacagaagagacagcccaggaataaacccatgcatttacagtcaattgactttcaacaaaggtgtcaagaacacacaatggggaaagaacagtctctctaacaaatggcactgataaaactgcagaagaatacaattaggcccttctctcacaccatatacaaaaatcaactttgaatggattaaagacttaaagttaggatctgaaactttaaaactaacacaggagaaagctctatggtgttagcttaggcagtaatttttcagatataaccccaaaagtataggcagcaaaagcgaaaatataaaaatgggattacatcaaactgaaaatcatttgtacagcaaggaaacaacagagtgaagagacaactgtggaatgaaagaaaatattttcatatcatacatctgttaaggagcagatatccaaattacataatgaactcactgaactcaatagcaaaatacaaataagacaatttttaaaatgtacaaaaaaatgaatgggcatttctcaaaagaagacaaatggctaacagatatatgacagaatgctcaacatcactaattaaggaaaggcagatcaaagccacgataagatattaccttacacctattaggatggctgttaccaaaaagacaagagataagaagtatgggcaaggccatggaaaaacgggaagctttgtacactgttcgtgggaacgtaaagtgctacagccattatggaaaacagtatagaagtcaaaaaaactaaaaatagaactaatatatgatcccacaatcccacttctgggtatatagccaaaggaattaaaatcagtattttaaagagaaatctgaactcccatgctcattgcagtgttactcgcagaagccaagatatggatacaaccactcatcaacagacgcatggatgaacaaatacacacacacacacacacacacacacacaaaatgaaatatcagtcagtcttaaaaaaagaaaatcctgccatatatgacaacatacacggacccgaaatacattatgctaagtgacataagctaggcacagaagggcaaatcttgtatgatctcacttatacatggaatctaaaaaagtctaattcatagaagcagagagtagaacagcgattgccatgggatgggataaaggaaatgaggtgttgcccaaagggcataaactttctgttataagacgaataagttcagggaatctaatgtacagcatggtgacgatagtaataatactctgttgtttacttgaaatttaataaaagggcagattttttttttttttttttttttttttttttttttttttgagacggaatctcactctttcgcccaggctggagtgcggtggcgcgatctcggctcactgcaagctccgcctcccgggttcacgctgttctcctgcctcagcctcccaagtagctgggactacaggtgcccgccaacacgcccggctaattttttgtatttttagtagtgacggggtttcaccgtattagccaggatggtctcgatctcctgacctcgtgatccgcccgtctcggcttcccaaagtgctgggattacagacgccccaaagtgctgagattacaggcgcggagccactgtgcccggcctaaaagggcagattttaagtgtccccactccccagccgcctggcccaaatgctaattacaggtggtaatgaatgtattaattaatttgattgtggtaatcagttcacatctacatgttatcaaatcatcatgctttaaatcctgaatatatacaatttattatttgtcaattaaatatttaaaaacaaaacaaaacaaaaaaccttgcaatctcctgccaacagttaaacaacacaaactattcttcaccagtgtgttcaaatttattttgataacaagagactaaagtaaacgttaaatttacttaagaaatacctgaaaagagattttggtaaatactctttaaaaagcttggtggctgtctcaaaatccatctggaaaatcttcagaaacattttaccaggaattagcaaggtaagtgccgtaaaccaacctcatccaacagaagtatttgtgtatatgggtagaaaatcactgccatcagcagtcagtctgtgctcatcctcccatagctctgacacaaaattatactttaaaaagtttcccttcgaattctgccacccctccacatacttattaatatttattagcaagcaagcaaaagtcacttatacaatctttctataaattgacaaattcacagatctctgtcttttgatgcaattagaccataccttgtatgataaatcacttgaaataactatagcaatattccaaataaatgatttcattacctttatagttagcgataagaacctagaaatctccctcatgcatggacatagatgagttagagataaagcctaggcaaggctatctttgcgatagtctaactaatctatataccttgaattccacttattttaccagtgagagcccacttctaaaatccattatactaattaacaggccactaatttcaccaatgaaaacccacttctttcattttgctaattgtaaatgcctttggtgttgatcaaagataatgataatggaatggctattagtagttcctatggagtgagcatttcctgattagaatgccagtgtgaattcctgattaaccaaatgattgtccctacagtgcagcataaaccatttatacttaaatatcactgtctttaagttgaagtttttcaaattaagttataggcatcataataataaaaatattttaaacagctgtctaatagattatatatgagtaactggcacatgggaagaggtcatatgaaacatcataggagctagagatttttttttaattgatcatgcctctccaaaaaagcctagagcaaggtaggggaaagataaaattaagaagacctaaaaaacattttaagaactttacatgcaaggacatatgatctataaaagtagacttttttttttggtgtgtcaaagataaaagggtagatagggaataatggattataaatcattgagaagtaagtgaagttcctattgaaagttgaagaggagagggatttcagtcattgtggtttatccaggaaaaattaatttgatctttggagccgagaagacagacgtagtgaatcaaagactactacatacacagggtgcattgacgaaccaaggttagatcactcatcagaactgactgatatctactcgagagtttgaaaaaatccagaggtcagattatcaaaattttactcagaagctattaacctagctttataaacaatcaatgggacagagtaaaagcagctgtcaattcatctcttgtccataaacagttcatgagagagtttcagttacatttctaaatattccttggataaaaggacgttaggaattgattgaaggacagctaaatagctcaagtattctgtgtgtttttgggttgtaactcatgaaaatagatatcatggaagaagaaaaaataaaggaatggccaactggaagaattacagaaattataaaggggaggaaatttaacgcttaaagaataaaaactagtcactatttcttcctcttgatactccccaacgttatgtacacacacacacttgcgcatgcacacacacacttgtgcatgcacacacacacgtgcacacacacacaaacacacacagagctaaagaagcttcctaaatgaagccttccctctcctttactctttcatgaggctttaggtatacttatctcatgcaagttatgaagaactttgctgtgctgagattcaactagatacttcaggaaggagccagagtctccaaacccactggattctttgttaatgactggcaattacaggatgctggggcaagggattatgaaagtcagacgtagactaccatcacctactggtccaacttgtcccaaaaacttggaaaacttggccaaaaggccttctatttattgaaaaatgcctgcaacactctgggcatagggaatgctggtttccattttttgagtaaacaatgttggcgaaggcatattattgtcagcatagagtaaagccaatttatttcgatagtttctatcgagtgggaattagaaaaacggatgacccctttgtttaacacatttatatggataaacatatctattcaaattctagactaactttggtgcctcattttgtggggtctcttttctgactttggacacagccataacctctgaagcctttaccatttaacttcttaattttatattttctgaattttagctatttaccctactagaatgaattatataatattttttcataatatttttcacatagcaagtatgtcacatttgtttaatacacatcatttcaagtttgtaagacaaaagttgaggagcaatatgacatcaatctttaaaaataaatatgatgaagaagagacaagaacttgttctctcaatttgtaatgcttgaagccttttaacctgaaacagatcatcttccaacatataaaaagaagactatttaaagatagtgtaagcaatgcatgagcttatttttctatgatcttatacaggttaaatctgtaaccctattatcagagaatttatataagttcatgaaccagagataatttattagtgaggcaacaggagatttggggaacatttctacagtatcattagggcagttctcaaatgtgtcagttctctcagatgacatttctctgcccacttgaactcatgtggtagcagggccatgggaaattaaatgcagccaaaatagcaattcctagcagaagcatgtgtgtagttcgcatcttctctttacctggcctctatgcatgaggaagcaagtttcaagatatagtcttcatcagtatgggtctctgcgtgactaatacatgctgacaccccttgctgacctccaatgaacaacgaatatatgatgtagtgagaaataaaccttttcacttttcattttaagctgctgacatgtttcattatttgctaccaatcctttaatccagcttgtcccacatgatacaattctccaaatcttatgttactgatatcttgaaattcctcaaagccctttaggccctcaagtaaatggctgagggtaacagagaagaaatgcaattgaagagctgttccaggaccttagacatctagaaactcaaccatagccgctgcactttaatctattttatatagatatttatgttgctctcaatccatctcctccataaaaaattgtacaccactattgctagggatagatcttttagtctcggcctataatagcatatcatgttttattcattctacacatatttgataaggcctattgcaaacaaagataggttataaggtactgtagaaaatacaagaagaaaaaggtaacatttcttgttctccagaaccatataatccagctgaaacagtttacaaaatttctttcaaaatttctccagatggagtggaagaagcctatgaacttttaacatatttatttattcccaaagaaatgcacagaattaaatgtaatgaccattttatttttaaaattaatattctctgaaaaaaccctacatatttgcccatgagaaattagtactaatttcagatctcctatatgaagtcctttttatttcagaatccttttgcctgctcttttggtaaatagacatccttaaatggattagggaaaaatttgtctttttgtatctgaaggaggcaaaaggaattaaaataggatttcaaaaggtagccaatttcaaaatcaggcaggctaattttgttataaatagagtaattaaaaggattagaaaaagtgcttccctttgttagactgacactcttacaataagatgtgaacacacataagggcaaggaagtgtgtcataagtaccattagtggccatgatatcagtctctttgttttggatatcctttttcttcatccccattttagtcttctgagtagaatctatccatcatttcaaattctctctttttttaatgtttcctaatcaatccaccagggattgttcttattgtccctctgtacatatgaacacttcagtggttccctagttgtttcatgtgttttagcctcctttcctcaaacagaaattgatttgttacaaactcccatttcctacttttctcaatgtttcccacaagaaaatcttgactatacctaacacattgtaatcctctacacaccatccttttttgcataattcccttcatctcttaatctagaaacccagagaagaaaatacacttattataggaggcccaatttctagtgaattcatcatcttctttatgctttttgtttttgttttgagacaatgtctcactctgtcacccaggctacagtgcagtggtgcaatcatagctcactgtaatcttcaactcctgggctcaagcaattctcccacctcagcctcctgagtagctgggactacaggcgcacgccacaaggcccagctaatttttttttttttttttggtagagacagggtcttgctatgttgcccaggtcaccatcttctttgctgttcatgctcataaatgatttaaacttctattgtggaagtctgttgaagttcaacaatgatagcaatcacttatattttccccatttttttgacaacaggaagtggattttcctttcatttctccagcaccattgttattccctgtggttctgcaaaaataactgaaaatagttctacatcaacatcttccagttctctcagaattctggaatgtgatttgtctagcctagaggcttgaagtcatttaaagcagcaggtaattttactataccaccaattgggctttgattcccttaagcatagttattatactccatctagtttaaagatcattctccttgatagagaaggaagaaacaaaataggagttgaatggttctgcatttttttcctgtcatctgatttctcaccatctggcctaaacagttgggtttatcccttccttgttcttctttgacatgaaaggggactttcatgaattgtgttgaaaaaagaattgaaaactactgtgaacataccaaattgaattgaaaagcacagatcatatctagggaaatgtagtgagaatattactaattgctagatcaaatttacaaggaataaggagacaggaatgagacaaggagatgaaatattcatctggaacaattaaaagatcaatggtgatacaattacaaaacaggaaactaatgttctaaccaaagcatgttttcttcttcaattaataataatacagtgtgctgcactatataaaacagctttataatgtcagttgcatttcttttgcaaaaccacaatgcaggacagaccaaagagatggatgatttgcaacaaaggcaatgcactgaaaacaggagcttttaatagctttctaaactcataagagctgtaaaaatcctcttgaacctacatccatctactctcccaaagaatatgctaaaaaggttaagaaagcggtaatttaagtctcccttgtcatttaattctttgggagtctgtttgtgaactttcaaatctacctggcacttttaatttttttgttgttgttggggagaagggttggctaacatttaactacagtattttttttttttttttttttgagaccgagtctcgctctgtcgctcaggctggatggagttcagtggcgtgatctccggtcactacaagctctgcctcccgggttcacgccattctcccgcctcagcctcccaagtagctgggattacaggcgcccaccaccatgcccggctaattttttgtcttcttagtagagacggggtttcaccgtgttagccaggatggtctcgatttcctgacctcgtgatccacccgcctcagcctcccaaagtgctgggattacaggcgtgagccactgcgccggccttttttttttttttttttttttgagactgagtcttgctgtgtcacccaggctggagtgcagtggcgccacctcggctcactgcaacctccgcctcccgggttcaaacgattctcctgcctcagcctctcgagtagctaggactacaggcatgtgccaccatgcccagctaatttttgtatttttagtagaaatggggttttgccatgttggccaggctggtctcgaactcctgacctcaggtgatccacccgcctcgacctcccaaagtgctgggattacaggcgtgagccactgcgctgggccaaactacagtattattaatgcaaaaagtcccttcacggagacctgaagacataatttgttgctcaatagaaatccagcattttaaaaatccagaaaagaaaacttggtccgattaatcagttgaagattaaagtaatgtgtagcagatactgccaggtggtattccagggtattagaccctgttcattccatactttcacagagacagtagaaaacatagtaaaatttccaatatcataaatttcccttgtagaagctatggcttatcattcttttatttctactaaaaatattcacaagattgtgtctaagttttgtgcttgcattagcaaagaagtatgacattgggtaataggccacccacagtaatatcttccaaactcttaagactggtagcagcaaaggagtagaagatagaagagaaattgtctcacctgacacagaaattgttgagagtttggaagtttaggacataggaaatgtaatgactctacagaatggaaaagggatcaagccatttatttttaaataattttgatttagagtcaaccaataccgttgggaggattctatgccacagtcactctgttatgcactttcacaaccactgtctattacatttcaaaaattatcctgtcacttaggaattatcactcccattttacagaagaaggaatcaagggatgttaagcaattttcccaaggccaaatagttggtgagagagcacacacgatagaatgtgatttcccttgccagttgagggactacagctccccctcattgcgtattgaacgcagaaaatgcagaggggaatgggtgaatggtacccacatttcatgttgtatcgccaacccaccaatcagtgccaaatatttgccattgcacaccccatcagcctctagttaaatgtatctatttatcagtatattaacatattcaccacagtagcatggcatatgcataaaccactatgacttagaagaataaaattattctttggctagcccataaactctcagagttctttatacatcccaccgccttagcagccaaactccgggattattttataagaggagagaaaagaaaccaaattttatctgaaaaaaatcagattaataaatgtaaaggaagctgatattaaactttattttaaagatcacatatagccataacgagatataggcttgaacttggtgtaatcaaagaggcattaatttaaaggaactatggctaagggaaaaaaaaattctattgtttatatattttgttagtatctggagatacaaagatcaatgtagtaatcaatgacatagctgtgattccttacagctcacttatcaatatcataacacaaaagtatctacgtaattgggaagtttagctaagctttattgtagaaaaaggaaatacatactggaagtcattttggggtgttgttgttgttgttgttgttgttttgagacagagtttcactcactctttcacccagcctggagtgcagtggtgcagtcttggctcactgtagcctctgtctcccaggttcaagtgattctcctgcctcagcctcctgagtagctgggattacaggcgtgcaccacaacaccaagctaatttttgcatttttagtagagacagggtttcaccatgtgttggccaggctgatcttgaattcctgacctcaagtgatctgcctgccttggcctcccaaagtgctgggattacagctgtaaaccaccactcctggcctggaagtcattttgtttagcttatttatagaaactatttccaccatgcagtaatgacaacaatctaaggaaatgtcctaacaaccatattagcatagagtgatagataaaaagatattatttttattttctatatcattttcacattctccttcagttaactgaacatttagctgagcaatatatgtcatgtgtcatatattgcatgattaaaaccttttactctaaggaaacaggttttagtatcaccatatcgaacatgaaaatcattctaataccaaaatgtcaaccttgattttttaaaattccgtagtataatctgattaataggtgtcataaggaaatgactgaactattgggtacacaaaataatgttctaaaagttgtattttaaaacgatatatctacataaagtgtgacaatataattatttccagtttgattaaatgctataatcactatctcattactagaataatgaagaaaaaatatagaaatattatcacatgatccatacgagaattaaattaagtagacattacataaaccagaagattcttacgcaatttcaaagttgtcacaaataaattcaggtttgaaggacaataaagaagtaatgatgggaaggaaagcttgataattatagcatggttgctatttatttattcagtgtaaaggatcaaagaaggaattgtcttagtattctcctacttcactgaaacaaaacttttagttgacagtgaacacacgacaaaggaaatcaatttaacgacctttattgaagcagtactggatacaaggtattgtgctaggtcgttcagaacaacggtgaataatagctatactagtttgtcagtgcattcataacacagtatcactgattgatgtggcttaaacaacaaaaattcattttctcacatttctggaggctagaagtctgagattaaggtgttgaaagggtttgttttctctgaggtctctctccttgactgacagatggctatcttctccctgtgtcttcacagggtttccctcaatacatgtctgtatcctaattccctcttcttgcaaggacatcagttatattggattgaggctcatcctaatgacctcattttaacttaattacctctttaaagaccctatttacaaatacagtcacattctgagttacagggggttacgatgtcaatatataaatttgggtggagacataattcagcacataataaagcgttcttgccctccaagactttcaacataatagagaagaaaatatataaaaataactatcatagaaggcagaaagtgataaaagttatagtgcacagtcaaaattattaggatggtgcaaaagtagttgcagtttttgtcatcactttgatgacaaaaactgcaattaaatttgcatcaacctatataaaacatagaaaatgactggataattaagaaaggtttaatggagaaagtagttttctaggatgagatttcagcatattgagataaatataatgaaaaagataggaaacaacaaattaaaagaaaacactgtatagggctaatttttcatttaattataattcatttcaccatattgagataactgtagtggaaaggataggaacaaacatgattagaaaagagcactgtatagggctaatgtttcatttaattataatcaaactgtactctgattgacatggcatattttgtatttaagacaataaagatcatttgactgctgatagaaaagcagaaatagaaaatcatgttttcttcagttttcaatgtaaaatacaccacaggccaataaccagacaaataaaataattctccaccatcttccaacatatcatttgtatttatggacatttttcagaagaaataaaatagggagaaaattagaattgtaccaatcataagccagaagaagacatagataataaaagtccactagcgattggattgtccttttaggaaatctatctatcaaaaatctatgcttatagctctttgttcagagggtcagttcccaaatttatgtgctacaacagtattttaaattctttcctgtaataaaatgtcactgagattttttttaagtagaaatgtgatattttatcaccatggagtacaatgtaagtttagctgcctaactcattattcttagtcctgcttgaaaagtaaatcatatttctgacaatgacaacgaaatctcaattttgattacttctgttttaaaagagcataggataatagtaaggaacctatacaaaataccattttaatatttatagaggggaaaatactgaatttttatggaattataataaatatatacttccttatgacttcttacacgtgggtcactggcagataaacttaatatttacttactacctaaaacatatgacaattcaatggtgctcagccaggttatattaacagtgtggcaaaagtaaaggattttccttttgttcatacaacttatccaatggcacattcaagtttttctcctctactattatggcaataatttaggttcatgtcagcaaatgtttgaaagacatataaatcccacatttcgtatcacttgttagtgtctaattaagcagaaaattttgagttcagtgaattacaaaatgaaatttaaaacacatcagattttacattaggtaataaagatcttggcacgtaaacctttagcactgtgggaaatgagcttcatcttttacattggtgaaaggtgcagagtgatcattctgtgcaattacacagctagaagaagccttgatttggaaacagtgctataccaaggagaaaatcacgttgcatagttgtgcttaatttttgcagtctaactagaatagttatgctacatacatacatctggctttgctctaaagcctatgttgggcatctctgaaacataaacagagtaaattttgcccttgatcactttggacgttactcctgtaaaaatcatatacaagtttatttgagtaaaacagatttaattaaacaaatgtttattaggcatctgcggtataccatatattgtgtaaagcactgcaatgaagtaaaacctaaccatctgtacaaatccacagttgtcggttcttctctttctttgacttcattttttactaatctgatgttttgcttgtttccccctacccattcccacatgtaaattttcttctagaatcctactaacttctggtgggagaggaaagagcctcatttgccaccaaaaccatatataatctaggtcaaaaggatttttatattgccttattaaatcatgcaaaattatccagctgtgtttgcatggacagccaaagaggaagggacttcagcttttgttcattatttgatttaacagctgaataagtaacaaataaaaaactaggcttaacagtcaggtaaatatttttcctgatttagaaaggttccagatggaaaaacttagaattatgatctaaacatggcatccatattttgacattaaaaaagatacagaaattaatttgagaggaaaaacaatttttttttgacacagggtctccctatgtagctcaggctaaccttgaactcctgggacgacagggaaaatcaattttaatagagaacaataggctgaccagactagaggatatataaaactaatatcattgttatttattgtcttagagaatttgagcaattaaggaattctctgtgacagttaatattatgtgtgattatactagccaaataccttccaagtggagcaataaatgagaaaatatctatggaactcctagagatcttgggataaatggttccacacattaacagttgcatttccttttttttttttttttaacagagtatcactctgttgcccaggctggagtgcagtggcacgatctccgctcactgcaaaatctgcctcccggcttcaagcaattcacctgcctcagcctccggagtagctgggattacaggtgcccgccaccatgcctggctcatttttgtatttttagtagagatggggtttcaccatgttggccaggcttgtctcaaactcctgacatcatgatccacctgcctcggcctcccaaagtgctaggattacaggcgtgagccactgcacccggccaatagttgcatttcttaagaaaaaaagattttaaaagccacaaacaaaagtaaaaaacaaaactcacacatacactatttattataaatccataaaaaattcagctattcaaaccaaaaaaaattgatactagcaaattataaatttatttagtgaaatagtgatagtataaatatatatcatgctttaataaagtattttaattaatccagtcaccacacatgtttttgctaaatatgacagacagaagataataaaataataattggcttaccaccctagataagttttaattattccatggtagttttacatactttgaatatgatgttagcttaaaattcagtggttgaaaacaccttacagaattttaaataagtagattttctgatctagtttaagaagaaagggtcaagtcacaaggccaaggctgaatatctctaccttcatgaaatttcccatatagttaggtgaagagtatttatatgtaatttaggtatgaaacataaagtacataaatcactatcaagacagtgaatgcatatttgcaagtaaatattaaatcatggcatgggaatttaatgttgccatgtcaaattatttagatacacaaaaaggacgtatttttctttcctcccatgaccattttccacatacagtattacaactgtgcctgaaaactatgtttcacctacaactgaaagtctctgaagttgattaaattataaggttatgggggattgtagggtagttggtctggatgtcagtgaatattttaaaattaatatttataattaagacagattttatgaagtgtcaaatatatcattttttctggtttagaattttaatagttatattctactgttagcatgtggcagttactgccctaatgcgatgaaagcctgaaatctcaaagccactgattccctacaagaaaatctgacagagaaaacaagcatttgcaaaattatttataaatgaatgtaaagtgttaacttatttataaattcctggtaattacacattttacaaacttatgaagaaccagattgaaatttgattattatacatctgtaattactatagagatgaatgaaatctatcacagtgaacatggattatgttttgcatcttatttggattgtcatgtaagtctttataatgagctactaattgccaatatatgaaatagtgatcacaaattcaaataacaatgaagaatgatgaggtttcaaagactggatgtcacagaattactttgttgatagaaagatagccttggtgtctttcccaacagaacctattttaacacactgtaattatcaggtgagggcttgtttcccccattagactatagatctcttgtgaataagtccagtaggctttatccaccatttcatctctagagtgaatagtaattgctcaataagtatttgttgactgacacaataaatgattaacttgtcaacacgaaagtgttcactgggcacttggcttcaaaggcattcattccccccatactatcaagattgctataaagatggcagaacagaatatcatttaaatcttgttgtcatgcgcctgtgagaaacttttcagctttagctttgagttttcatatactcagagtaagaatattctattgcctgagggagattctgattattttgatgccctaaatctcctaatccaatagatggaaaatgtctgtcatgcagatttgcttatgaaggggcaaaggctttcatcaaaatctttagtactaaaaaagaaaaatagtaaaaacctgagaaaggtaacacaggggacatcaattatacatgtaataacaagtatgagaaaagttaagactcagtaagacttcaccgtaagattacattgtgattctatatgctctaatcttttatggatgcttgaaatatttcagaataaaagtatttttttaatctagctatcctttcctcacactcaccaacaaaactggaatgaaaaatgacataaaacttcagaaagtattattctattagagtctgaccctgggtgataaaggtttaggtatttttcattttcacaaagcattttttaaactgtattactgagattcacagtcaagtgaaagaatataggataatcacaattcttaggtgagtttcaggtactgatatgtgttggtctggcatgatctctctgttccccaggcacagactcatctatgtcacttggctttgcaccctgacatctacttctcctattcaatatgtattttttattataaatgtttaagaaaagtagagatcataaaatatagaaaataatctatctacctcaataataacatgcactttttttcccattggattttgctctaatttttaaaggataaagcattgtagataacactgaagtcctatatgaactcttcctcagtctcgtacctccctctctaaagttaatcactgttatgtatttgatacacatggcatttatgacatcctactgtccataaaacttgctcatccactcaatattactttgaaaatttctctttttaacatatgaaactagctcatttgtcttaactactgtgtttgctgctatttgctcatttccccattgatggaaaaaaaaaactctataatgatcatacttgtaccgggttttccttatgaatatgtgcacaagtttcttcaataaacctagagggggattcctggcaacataacccaggtgccacatattgttattttgttcttcactgagattgtaacaatttacattcccagaagtattgtatgagcatactcttttaagtatatcacatctaataattgaaattatcagattttttttacttttaatatctgatagtcatgcaccctagctcttaagataattcttcagttattttggttaactatatagtctattattgggacaggttgaacaaaagtgctccttaaagagatttatctttctcatactggtttaaattttaacactggcctgccaataatgttagtaataacagttatcttttactaggccactcaatatgtcctagacactattcaaaacatttaaaatatgtaatttattcaattcttccaattgtaaaagaatgtgagctctaaggatgcagagagttttgtctgttctactggttgttctatctttaaaacagtcctatcacctagtaggtgctcaccaaatatttgttaataaatgagtacatgaataaataaattatataattaacattttcaaagaggcatttagggagtctgagtggttatttcccaaagagcatagatttttgtaggaaatgacagaattatctatcttcaagcatacataactccctccaaaaacagatttttttttttaagatggagtcttgctctgtcacccaggctggagtgcagtggtgtgatctcagctcactgtaacctctgcctcccgggttcaagcaattctgctgcctcagcctccctagtagctgggattacaggcacatgccaccatgcctggctaatttttgtgtttttagtagagacggggtttcaccatgttgaccaggctggtcttgaactcctgacattgtgatcctcctgcctcagcctctcaaagtgctaggattacaggagtgagccattgcgcctggcccagatttttctttttctatgttccacgtagtctctaaagagaaaattcactatcttcctgtcaaatctataagaattactttagcggtgaaattttagtaagaacgataggcagtttgtaagaacataattctttttcttttaaaattatttcttttttaattaacaaatattagttgtatatatttgtggtgtacaacatgatgttttgaaatatgtatatattatagaatggctaaatcaagcgaattaacatatacatcacctcacatacttaatcatttttttatagtgagaacatttacttgttctctcagcgattttcaaactgacaatatattgttattaactatagtcagcttgttgtataatagatctcttgaacttattcctcccatttaactgaaattttgtatcctttaaccaacatctccccagtcctctccctttaccagcagtccttggtaaccactattctactccctgcttctatgagttagactttttaggacaatgtaactcctagatgcattttaaaaacacgtagaacttgttcacagcacaggctctggagccattctccaagcaaaggtttttaccggtttgttaaaattccccaggatgctttctaagtccctaagtctattgcaacaacaactcgtaaaatcagatacatgattcctgttttcaaatttcctatctagacccacttggatagcaagattgatgctgttctcaccagcctaaagccccttcagctctagctgaaatctttgttctctcacaatgcccaggaacatgtcttgggctcattggtaggtaggaacgtgctgtgtggcaaggagaaaatttccctgtaatccttcatctaatctataaaatatcctaaaggattcaccatattaacgatttttcctcatccaatttatactgattataggtggttagagttgagatacacccctaaataactgaatacacataaaattgtgagacttcctttgactctctattgctttgttgaaagtctttgtcaatatatctggccattgaaaataatatggtttattaacaatgcacatacactcactgagacaattctaagcaaattgtttataaacagtatattttatcattcacagcctttgtcagtacatagcacatgcatctgaagtatttagaaactattatattgttatgcaagtctaaaatgcaaatccttagggctatttactttatcagtaagattattaatcattactctagctataccttaaagttatagcaaaaattttcaaatctgacttattaagacagtcaaaaaaggactcccagttatggcttttctaaagatctaagtcataatactcaaagaacagtcctgcagtctacttattgtttattcaaatgaaagcaccttaagtgaacttacctgttagtacatgaaatgatgtgtgataaattccagttgacatgcccaaactactcttcagtcatgtaagtacaggcagtaattcaaaacataattaccaataaagcaataatggattactttggggaagcctattcaatcatttctgaatacacactttctctctgtctttcaccatgacctacataaagccatgtgtacatttctcttcagtctccacaatgatccctgaacaatatactgtaacatgaaaatgtaatcacagatgactcaggggaaaaaaatcttacagctatgaaatcactgtctcttaattttagtcaatgttatagaagatcctggctgcaagtcatcactggcctgtcctgacaaggaagagcttcttttctcggtaaatggaaacctaggttattcggcttgagctaggatgcagttatcaaactggttctcaccttcctattgtaacatcttgaatgtgtcagtcatgtgctttcattttttggagatagaatggagaaaacgagggaacacctgttttatattggatttactttcatttctaagggccattaaggattatttagcactacatcacttacttctacaagaagttggcgtctggagatggtgttctaaaaactgataaagtatacaacgttactatttaaaatttcagatggcttactgtcttagcctgtttgtgttgctataaaggaatatccaaaactggataatctataaagaaaagaggtttatttggttcacaattctgcagactgtataagaagcatggcaccagcacctacttctggtgagggcttcaggctgcttccactcatggcagaaggtgatggggagccagcatgtagagattacttggtaagggaggaagcaaagggtgcggggtgccaggctctttcaaataacctgcccttgcaggaataaatagagtgagaattcactcattaccaagaggattgctccaagctgttcatgaaggatccacacccaaggcctaaacacctcccattaggcactgcattcaacactggggatccagtttcaacgtaatatttggaggggttgaatgtccaaaccacagcacttgccttttcctatggaagttcaggaccctatatgaagccatctgttgactttttaagctcagtaccaatcctgatgtagtctgtgcttcttttatactggccaacttgctgtccctcaaacccaccttgaattttcacagtttttccctctttatgggaggcttttccaattttctaaaggttcaattcaataatccagctgaacagctgtttctttaaaaatatttcctcagtatcctgacagtacagcagcattaattgtaaaagattttgtttacgtaacaaatacaattcttttgaaatctgattcatatacaccagattgtgagttctctcaaagcaaattctgtgtatttttcttcattgtattttctttcattccccagcatactgtcttgcacataatagatactcagtttaattttatcaaaatcattttttcaggaaatgattaacaatctccaatttaaaagatatatttgtattgaaccacttcatggcttgatgcttttaatcaaactaaattttgactaggtataggttgaagaataatgtataagtgcaatgtatggtaataggaaattggttataattatattgtataattaatatttgcatagatacatactatattggtcatcttttatcccaactcctattaaataaatatcatattgagatttaatagtgcttagttttgatgcagttaattttaacattttgctcttgctaacattattatgtgttttttggcatcagcttatgaaagaacatggaaaatcaatttattttccattttctttgtcaaatttagattaaaactttgtagaagccaaaggtcatgctcactatgatgtcatggacaaaaaggcctttgttattacattttgttcatttttctctttttttctttcaattttacttgacacataataagtgaaacatatttatggggtaccaagtgacagatacatgtatacagtgtgtgattataaattcagggtaattaaaacattcatcacctcaagtcattatcatttgtttaatgagaactttcaaaatcctctcttctagctttttgaacatatacaataaattattaactatattcaccctacagtgccatagaacactaaaacatattcttcttatctaactggaactttatatgcattgaccaacctccctctatcctccttctcccttactgttcccagcctgtaataaccagagttctactctttacttccatgagctcattgttttgctcctacatgtgagtgagaacatgcaatatttatctttccacgtctgacttattttacttaacataatgtcctccaggctcatccatgttaccaacgacaatatttcattttttaaatagctgaacaatattctgttgtgtatatatatatatattacattttctttatttattcatctgttaatggacatttaggttcattccataccctggctattgagaatagtgctgtaataaacatggcagtacagatatctctttgctatgctgacttcctttcctttggataaatacccagtagtggcactgctaaatcatatggtggctctgtttttagcattttgagaaacctcaatagtattttccataataaatagctgtactaattaacattcccactaacagtacataagaattccccttactccacatccttgttagcattttttttaaatcatttcctttcatttagattctgtggaagagtttcttgggtttgtttcttaaataactaataaaattatattagtgatgttgagcataataaattcttacaatctgatccaatctttgtccaattaagagtgtggtggtgcaggagcagctcttgttttttttttttgttttgttttgttttctgttttttttttttttaacaatttcgttgactctcagagtctaagacttcagggctgggacctttgtccagcctgcacggtagagtgaggctgcctctcccaccaggcattgggatcctatttagaaacggcgttcacttcagaaggtactttttaactgctcagtttttgactattttaaatagtttgctgaaaactcctgataacacttgcagctcttgtttttaaagttgctttcagtttgagtatggtcttaaagacttctgttgccacactcctggtgcaacagcttccctatatgagccacaattttggtacttgccacttttataatgtataaacttctgggactttgttatatataattttatactactttaactgtggctattttccttttttaaagctttcatatctgagtgagaagatatggtgtttgactttatttttctcttatttcacttaatgtcatccagttctatgcatgttacagtgaatgacaggatttaattatcctttatggctgactagtattccatgtgtatatataccacattttctttatcaattcaacctgttgttgaacacgtaggtttattccatatcttcgctcttatgaatagtgctgcaataaacatggggttgcagatatttctttaatacaatgatttcccttctttgggatagattcccagtagtgagattgctagatcatatggaagtcctatttgcagttttttgaggaacctccacactcttctccatagtggctatactagtttatattcccaccaacagtatataagagttccatttcttctgcatcaacaccagcgtttgttatttatttttgtctttttgataataggaattctgacttgtgtgagatgatacctcattgtggttttgatttgcatttccctgatgattagtgattttgagcatttttccatatatttattggctatttgtatgccttcctttgagaaacgatgtccagataaatcactcatttttaaattagattattgtttctgtgctgttgtttgagttcattatatatcatggatagtagtcccttaccagatgaatagtttttaaatatcttccctcattctataggctgtaacttaactctgttgactgtttcatttgctgtgtagaagctttgtagttttatatagtctgatttgtctatttttgtttttgtggtcttaaccataaagtctttgcctggatcagtgtcctgcaacatttcctttatctttttttactagttttatagtttcagtctgatatttaattctctaatccattttgagttgattttttaatgtagtgagagatggtcttctagtttcaatcttctgcatatgaatatccagttttcagagcaccatttgttgaagagggtgtcatttttttcaatgtatattcttgacatctttgttgaaaatgagttgactgtaaatatatagatgtatttctgggttctctatcttattccattggtctgtgtgtctgtttttatacccataccatgttgtttttgtttttgttactattactgtgtattatattttgaactatctatattatattttaactaactatattatattttgtactatcgccagttttacccttttggcttggtattgcattgggtatttggggtcatttgtggttccagacaattttaggatgtttttccatttctgtaaggaatgacagtgttattttgataaggattgcactgaatctgtagactgccttgggtgaaatggtcattttaacaatattaattctttcagtccaggagcatggaatgtttttcaatttctttttatcctcttctatttctttcatcagtgctttgtagttttcattgtagacatctttcaccttggttaaatttatttctaagtgtctttttttgtagctactgcaagtaggattgcatttttaaattctttttcacctagttcattactggtatataaaatactaattatttttgtatgttgattttttttatcctgaaattttaatgaattcatttgccagttttaagagtattttggcagagtcattacatttttctatttatgagaacatgttgtttgcaaagagggacaatttgacttcctcttttccaatgtggatggcaatttcttactttctttttcctaattgttatgtgctaggacttctagtactatgttgaataagagtagtgaaagtgagcatccttgtcttcttccagttcttagagaaaaagcttccagtatttcttcattcagtataatgttagccatgggtttgtcatatatggtctttattgtgttgaggtatattccctctatgcctaatttgttaagaattttttatcataaagggatgatgaattttattaaaagatttttctgtctattgagataatatgtttttaaaattttatattgttaatgtgatgcattacatttattgatttgcatatattgaactatccttgtatccttggaataaattctacttgattaggttcattatgtttttgacgtgctgttgggttctattttctagtatttggttgagggtgtttaaatctatcttcatcagacatattggcccatagttttctttttttgttgtgcccttgtctggttttattatcagggtaatgctagcttcacagaattaattaggaagaatttcttaatcctcaattttttggaatagtttgagaaaaaatggtgttagttatttaaaagtttgctagaattcattagtgaatccatctggtcttggacttttcttttttgagagactttttgttactgatttaatcttcttatttgttattggtctgtttgattctgttcatttttggttcaatcttggtattttatacttgtgtctaggaatgtatccatttcctttatgttttttaatttgttggtgtatagttgttcctaacagtctctaatgatcctctgtatttttgtggtgtcagttgtaatatctcattgttcatttctgatattatttatttaggtctttttcttaatctatataatagtttgttgatttggtttacttttcaaaaactaacttttttcatgaatcttttgtttgcttttttgcctctaatttgtttcattctgtgctgatctttattatttattttcctctattaactttgggtttggcgtgttcttgcttttctattttttgaggtgtatcactaggttatttgaaatctttttttttttatataggtgcttattcctttaaacttccctcttgtactattttttctgtgttccataggttttttggtatgtcttgtttctgttttcatttctttcaagaagtatttaaaatttccttcttaatttcttcattaactcatttgtcattcaggagaatgttgtttaatttttatgtatttttacagtttccagtgttcctcttgttattgatttctaattataatccactgaaacctgagaatacatggtataattgcatttttgaaaaaattatttagagttgttttgggcctaacatagggtctaccctagagaatgttccatctgctgatgagaagaatgtacattttgtagccattggaaaaaatgttctgtaaatgtctattaggttcatttggtataaaatgaagcttaagtacaatgtttctttgttgactttctgtatagattagctgtgcaatgctgagggtgaggagggtgaggtgttaaagttctcaactattattacattggtgtctctatctctctctttaactataataatatttgccctatatatctgagtgctctggtgttcggtggatatatattaacaattgttctttcctcttgctgaattgattttttaatcactatataatgacctctgtgtctttttatctttttatttttaataaaagtctattttgtctgatataagtttgctacttttgcacactttttgtttgcatttgcagcaaatatcttgtttaatctgttctgttatagtctatgtgtgtttttaaatgagaagtgagtttcacaagcagcaaatagttgggtctcagttttttaattcagccagtttatatatttcaattagggaatttaaacggtttacatttaaggttgttattgataagatgaggatttattcttgtcattttgttagttgttttgtaattgctctgtatagccttagttcctttcttcttttattatttttgtggtttggtggttttctgtagtgataaaattttattcctttctttttctcatttgcatatctgctttaccagtgaattgtatactttcatgtttttccttaattgataggtaacatctaccaatgatatagacacatatctgcttttgcttaattgatagataacatcctttcgctttcagaggttggagtcccttaagcatttcttgtaggttcagtttaacagtgattaattccctcagtctttgtatgtctgggaaaattttatgtctccttcatttctaaagaatagctttatggtttatagtattcttagttgaaagttttttcttttttttattccagcaatctgaatatatcatcctatcctctcctagcttgtaagtttcttctgagaaatctgctgttagtcggacaaagataccctcatatgtgacttgatgctttcttttggtgtttttagaattccctttttgtctttactttgacaatttgactatcatgtgcctcatagaagacctttttggatttaatcgatttgggaacatttgagctccctatatctagatgattatctcccaagagttggaaacttttcagctattgtttcattaaataagtggcctatttattttctcactgcttttccttctggaatttctaaaacaggaatagactatttgtttgcatagtgatatcccatatgtcatgtaaacttttttcatttttattcttttttctctttttgcctaattcgcttatttcaaaagatctgtcttcaagatcacaaattatttcttttgctttatctagtctattgttaaacttgagtagggtgctttggctttgtttctgggagaatgcagtactgtagtcaccatatgatttcttcagcattagtccaatcagtagtatctatggcttcacagtgtcttatgctctagttgttcctgaaagctgtgatgtgactttactggagatggggcctccaggcaagcagtccttggatccctggggagtgcacacgcacctctggtggtacacattgcatggaccagttctcaggatcctgggtggtacacaaaggtacatagtggccctgttattgctgggccaagtttgctgggttgtgatggtggcacatcccagacagggcagtccttaagccctaagtggcacgtttggggatcagtgttcatggcagtaggtcacaagcaagctggtcctcaggcccctgggcattgtgtgcaggcacatgatggcccaattgctgcagggaacaaggtcactgtcatcagggaaggtggctctcaggctcttggaagcatgtgctttggatttctatgtcctggggagagcctccctgacgtgcaggactgcctattccctgggatttaggtctctgtgtgggctcaggtaacagagaccctgtggcaccattaggttcagctggtaatgtaacactgcaaccttctgggatggtgtcgggggatgtaggctgtgcacctgtgatgtggagatgcagcagcaattaggccccagggcaggatgtagtctggtgtgacacttgttagtgcatttttgatggcattgaaagttaccttggtgttactaagccaaggtcaaagaacattgtgatgattaatgctgaaagttattttttcataatttgaagattttttaaaatattaatcctggggccaaacacattaaaggaattaagaagaaataaatctggaaaattaatgtagacacagaatttaaaatgggaataaatacttttacacattcagcaaatacctattaagagacttcaggcaaaactatggaagtaagaggtcctattaagattctacagcaacttagggaaaagaaagttacttgaactggcgtagtagcagtgaatatgggggaaaagtgaacatatttaagaaaaatttaaaatatagaataaaacacatcttcaactatccttcaatactacagttcactaaaggtcaatgtgatattataatcagaacactccacaataagggaataacattgctaattctaatttagaagtggtcaatctctttttcagaaaatccaaaaaccattgtcaatcgcttccaccaatcctcatttgatctccaccaccacagttcttttgcaagtaatctcttccactaccttttactcattgttcaatttccagtacctttcatgggatttagcactcataattatggaatattaaataaataaacgaaggaataaataaaagaaaggttgtatttttacaaacccttatatttaatcagttcttagtaattgttgaatagttcttatggtccaaatcattcatcccttctatcaaagtttgtagctcatgatgagtcagtttatgcaaactgacctctgaaaatatatgtttaactatcatgagacatttgttgatggtatgaataatttttaaatgatcattgaaaaactttcagttttaaatatataactgcaatggataaacagaagacatttgtcattagagatacccttatttcaagaatctttagtcaatattggaccattgaatcatactaaaacataattataagcaaatattttaccacatgtgatcttcctctgtggtaataacaaaaaaatagtttaaagtctaagagtcctttaccattgattttaaatttttatttgtatttacattttaatgtagagagagctgatattctgagaattcacacgttttcacaaatgattcagaagaaaatggaaatctgttttggacccttattccctatatctatctatctatctatctatctatctatctatctatatggaaaatagtctctccctctctgtctctctctctctctctatatatatatatagtattagtattgactcctgaaagaaagcccatgagaggttaaatgcttataaaaaatttgaaagtaaaattttccctaagtaattcacaacacagatacgctaagaactaacttgtcaattgatctacctgacaaaagaggaaccagaagtctctgaatacaaaacaacatatcactctaaaagatcattgtattagtccattctcatgctgctctaaagaacttcccaagactgggtcatttataaagaaaagaggtttaattgactcacagttccacatggctagggaggcctcaggaaacttacaatcatggtggaaggggaagcaaacacatcctttttcacatcatggcaggaaggagaatgagagcccagtgaaggaagaagcctttataaaaccatcagatctcgtgagaattaacctcactatcacaagaacaggatgggggaaaccacccctgtgattcaattatctctacggggtccctcccacaacaacatgtgggaattatgggaactataattcaagatgagattttggtggggacatagccaagccatatcaatcattcttcacaagtaccagataagttatttgctattaaacacatctgtaacttttctaagaaaatctgtcccctacagaagatgcaagattgtgccaattctcatcacagctattcaaactatgattaattatctggaaaaaaaaaaaaaaaaggtaacccatctattcattggttttattttggacctacagcatctaggctggtacaaaaaagatctagagggccagctagattctttctcttttgtttgactgggaaaattctgagagaagatgccataatctgtgggagcagatgttgaaaaattatgatgttacaaaaagatcactggtaaagaatcatggctaaactaatataagataagcttatgaaggcacagaaacttgagagagcagtggaaaccactcagtattttaggcaaacatgtctgcttgactgtttaatggccatttctctttttttactaacaaatctctgattttgtttgtgtagtaagtgactagtaataaaggttaaattgtggctggtctaagcctagtgttcaattagaacctgtttattccagctcacaagagccgattctatgcatttcgtaccaactcagagttcagtgacatcacattggtagcttaaaacctgcaaaggtgggggtatttatgccacagaaataaacaaatgctacaaattaggactaccactccctctggcttctagtcagttgttaatcacttatcagcaccctctaaactcatcttggaaatctaattttcttttgccggtaattggctcaagattgagagaggaaccaagttttgacctatgacaagtaagagaaactgatgaaaatcatctgggaaagactttcttctctaaagttaaagctgcaagccagcttctttttccgttttaaattgtgttgtgtaatgtttggagatgcaatgctttaagatgcaaccaagagggaacatgaacagaattcagagatgcttacacattaataaccttgaactgggccgggcaaggtggctcacacctataatcccagcactttgagaggtcaaggcgggtggatcacaaggtcaggagttcgagaccagtctggccaatacagtgaaactccatctctactaaaaatcaaaaaaattagccaggtgtggtggcacatgcctgtaatcccagctacttgggaggctgaggcaggagaattgcttgaatccgggaggtggagttgcagtgagccaagattgcgccactgcactcaagcctgggtgacacagagagactctgtctcaaaataaataaataaataaataaaataaccttgaactgtcagaggcatgtgaatcagaacaactccatcttgaataggagcttggtaaaatgattttgaaacctactgggctgcattcctagacagttaatgcattctaagtcacaggatgagataggaggtcggcacaagatataggtcataaagaccttgctgataaaataggtttgcagtaaagaagccggctaaatcctaccaaaaccaagatggccacaagagtgacctctgctcatcctcactactacactgccatcagccccatgacaatttacaaatgccatggcaacatcaggaagttaccctatatggtctaaaagggggaggcatgaataatccaccccttgtttagcatatcaccaagaaataaccataaaaatgggcaaccagcagttctcagggctgctctgttaatgaagtacccattctttcatttctttactttctcaataaacttgctttcactttgcattgcagacttacccccaattttttcttgcacaagatccaagaaccctctcttggggtctagaatgggacccctttcctgtaacagaaatattaccaaccagggcaaccaaaatgcagaaaatcatgagcagtccaccatgggcatagaaaataatgtgcgttttctgtacagaatttaaaaataataattaaacatattaaccatcagtctactttttattatcctcctgtacggacaattctaaataatgttagccatgaaaatatccctctccacatagcttaactgctcctacccaagtcctccgtttgctagggctagtaaccctaaagccaagtatatcaaacatctaggtatatgagataaggaagggtttttgttatttaagtaacctttacatgagttttctgtttcttgtttatgttttgaactgcttaagttgtccatgaaaagaagcagatccagaatatcggtatatcaggttaatctagcactaaagggaaaaactattaattcctgctttaaggacctacaatatccctggatcccaggcctcccccagctctaatcatgcaaagattggtaaattatggttccccttgttgcatgtccagagtattctccctatgtgctgtcagtattactatgctaaactacctctacattgatgaatgtaagtaggttcctttgccttttaaccaaaagaaccgagaaacagaacctactattcaacagtcaaattacaaaaggcttttccaatataaggtgttgactgaatttactttgtgaagtctatatgaaggagatagcaaatagacaaaaatatgcttaatgttgttcataataattaaaattactgtttaaatgttaccaaaagagcacataaatgaataagttcttgaataatatacaatcatgcagaaatatgcagccaaatatgtgtaaaaaggcaagtaacataaatatgcatatatacatgcatgatacacatttgaaaatataaatatatattagaaaaatggtgaaaggaaaaaaaatcagttagcagtgattattattcctgagtagtggaatcaaaggccattaattttttttcccatacattttctatatttccaaagattttgattctataaaaataaagtagtttaaaaatatgtaattagcatacatttcattttcactaatgtatcatgaaaatatagttggtttctggaataatttttcattatgagaatgtatacatacatgaaagtaatgaagtcaataggttagactggaacaaatcaggtaactttaaaaaatgaagttggatattcatgagaatttgcattttataagaaagaatattatcacattccaagaaaatccttctcttacaaaaaaggaaaaatgtatatataatttattttagacagaggattactttttgagagaataaaaaagacgaaaatgtgttcacttctttgttcttacaacacaaacaaaacttgaattatgcttctgaggatattgatttatgagtatcttcacaatcctgtgggatattattctaatttgtgatgagataataatctgggcttcacatggaatctcaaccttgtctgttgtagttagatatttagacttgtttgtttaattctttagattagcactgtcaaatacatataatggttgttgaattatcatattgcatctgtgaaaggaaaataaatcttggagccccaaaattactaagccaaagggaaaagtcaagctgggaactgcttaggacaaacctgcctcccattctattcaaagtcatctctctgctcagtgagataaatgcatatctgattgcctcctttggaaaagctaatcagaaactcaaaagattgcaaccatttgtctcttatctacctatgacctggaagcccccttcccatttctacttgtcccacttttgcttcaatttgttccacatttctagactgaacctttgttcatcttacatatgttgattgatgtctcatgtctccctaaaatgtataaaactaagctgtgctctgatcaccttgggcacatgtcatcaggaacttctgaggctgagtcatgggtgcgtgtcctgaactttggcaaaataaacttcccaaattgactgagatctgtctcagattttgtggttcacacatttcaaatcgatgatgttttctcactaatatgtttttttccatgaggggagaaaaatttggttggaaaagaagcgcagggaaatcaggatttatttgaaaatctaggaaaaacctaagattctaggtattattttctaatatgttttggccatgaataggagtttcttttatagactcagtgtaaattgttaaatttaaaaagattacaagaggtcaggctcataatcccagagtagaccatggatgacacaactgctgctaatacatagcaacatattgcatccaaaaatacaatcaattaaatgtttactggattaaataaaattaatcttatttagtattattcttttttttttttttttttttttttgagatagagtctagctctgttgcccaggctggagtgtagtgacatgatctcagctcactgcaacctctgcctcctgggttcaagcaattctcctgcctcagcctcctgagtagctgggattacagacgtgagccatgacacccagctaatttttgtatttttagtagagcgggggtttcatcatgttggccaggctggtatcgaatccctgacctcaagtaatccacctgcctcggcttcccaaagtgttggcattacaggcatgagccaccatgcctgtcccagtattattctattttataaaattgacaagagaaaataaacaaattaaaagaataaaaacataccagatacagcaaggaagtcatcaatgcttgtaatgtcatctacggcttcagtgaggacatgtatatgattctcccatgtacgcttgtacatttccatggtgtttttgaccgcttgacttttgggtcttgcagccaaagcaagtgcagcattaataatctataaagataaggattgaaaaaattacctattggttgcaatgttcactatttgggtgatgggcacactaaaagcccacacttcaccactatgcaatatattcatgtaagaaatctgcacttataattcctaaatatataaaataaataaaaaatattaaaacaataaaataaaattaattaaattatactcattcatgttaaacataaaaaatggaatttaaaaaaatctgtaaagatgtagaacatttactcagtgatttatttcaatacattaagtgtattaaaattagattatttaaattaaattatggttaaatacattcatcatcgacaataggaaaaacagtaaaatgtctccatatatacagtttatattgaaaagtacaaaacgttttatatttattagtataaattatataggtataaataataatttttatttttaaaattttcctactccctctattattgcagagtgagttttttaaatataaactttgttaccataagctccatcaagttcaagacacttttctaagtgatgatatcaggcatttaatcaatccttaactgatgattctggtaatttaaacatgccaatccagtcttttttacattattaactggtgagaaatggatgcctttaacagatttttttttcaaattagtaaacaaaaagaaatcagaaagaaccaaattaggactgtaagttgaatgcccagtgatttcccatggatattcctgaaacattgcccttgtttcaggagagaaatgagcagaagcactgtaatggtgaagaaggacattctgttgacacattcttgggcatatttctgttaaagttttggttaattttgtcaaaccactctcaaagtaagcagatgttatcattctttggccctccaggaagtcattaagtaaaatgcctttagcatatcaaaaaactgttgccataacccttgttcttgactggtctgtttttgctttgactggatcacttccaactctcagtagccattgctttgattgtgatgtcttcagaattgtacttgtaaagccgtgtttcatctcctgttacaattcttcaaagaagcaattcaggatcttggtcccacttatttaaaaattccatcgaaagctctgctgttgtctgcagctgatctgggcaaaatggtttggatactcattgagtggaatgttttttcaactttaattttttagtcagaattgtgtaaactgaaccaattaagatgtctatggtgttggctattgcttgtgctattaatcattggtttccttcaattagagcatgaataatataatatttttttaatcacaaatggatgtggatgggctgcttctgtgagcttcatcttcaacatcatctcatctcttgttaaaataagttatcagtttgtaaactgaagatttatttggggcattgtctctatgaatattttttaaagcatcagtgatttcatcattcttccactcaaactttgccataaatatgatgtttgttcttcaattttagcagagtttatgttgcctttcataggggtttgatatagtttggctgtatttccactcaaatctcatcttgaattgtagttctcataattcccatatgtcatgggagggacctggtgggaggtacttaaatcatgaggacggttacctccatgctgttcttatgatagttgagttctcacgagatctgatagtttcataaggggattttccccttttgctcagcacttctctttcctgccgctacgtaaagaaggacatgtttgcatccccttctgccatggttgtgagttttctgaggcatccccagccctgtggagctgtgggtcaattaaacctctttcctttatggattacccagtctcagttctgtctttattagcagcattagaacagactaatatagggctcttttcaaactgatgtctctgatttttaacccgtcaaactagatcctgtccacgcacgttatcacaagttagcacaagtttatttttgtgcaaaaatgttgaattctatgcataattttttcataaaacacattttcagtaaaggttttgaagacctctcatacaatgacaacaataaaaagaagctttttctactgaatatcctaaagactgtaccttaagtcacttcctgtcaccacattattggaggtagaagacggaaaaaattagttgcctgagaataatatatttaaatcctctttttttgtttcttttctacaaaagaggaacatattaaattttaaggaaacacactaactttagaaataactactgtgcagtatgccttgacttcagttttagagttttattaacctattaacttacaatgtaccttcgtgtatactgcagtggctctggtccctggtgtttcattgttcttgcaattggacagctacgtacacatgtggttgtactgaaattatgccttcacagcaaagtatacttttaaagtactggtgtaaaaccctcagtggagatatgaagttatgaatataagacaggctacattttataagaatattttcagttctgctgctgatccaatttatctgattcaacactgcacactatgaagaagctttatcctacttgactcttgtgatatttagcttaaatctaaaagaagacacaattcagaagaattcttctaaccctctttagggcagaaaaatgttcatcccaatgtcacactcctagaattttagccatatatctagagaaaataaaataaccattcttaaatcttcttcacgtaaaactaaagcttttttttaaaatgaattatgttgctttctgaggcattttgtttctttaaattatggttgaaatatttacatgtcggtcacttgaccctgataattatctagtctgtcagtttacctttgaaacagtctcttttgagttcgggccttattatatcttaactgggccattctagtagccttgtaggtttctacttccagtctctatttgctcttagacattctccttaatgcaaacacatttctttctcaaatgccgaagtgatcatgccccccacttgctgataacctttgataaaatcctagttgactaaaaacaaacaccatatttcttttcagtaattcatagtctaaaaccgtccccaggttggtccttacctacagttcattctgctgtaataatcttactcattttagtctttgttccagccacagttttaagctccatttccttatcacaccactcatctttgtacctctgtgactgtttttagagctgaatctgccttaatgcccttgctccatccctttttctgctctactccgtctcaggaaacatttttcatacttaacatatccatggaaatatcaccacatactgtgaagcctgtttaaaaaatattttgtccatataaataaatagtagttattctattgcatgattgctcgtacacatgtctattcctgggtaatgagctccattataggagggactatgtattattcatctttgcttcttggtatactaaacatgttaattaccataaatgctatacttacaaactgtccctaagagaaactattctgctcgcagcccacactgagaggacagccacaggagggcaggtttggtattattttctcccacttcaacactatttaggtcataggcaggtacccaattcaagaagagttaatctgttggctggctggtgatggttatgaggtttgacataaaaagttgtgttgtgttaatcaatcttgaaaatttgaactagaatttatggagaaatcattagttagcagtcaagatcaaagctgaaagtttctgtaaagagcagccatcttataaaatcagaaccagagggggccaatggaactgaggctacaaggaaactagagccaaagtgcaaggaagaagaaactgtaaatagactgaacctataatgtttaaaaagaaaaaaaaataggccaggtgcggtggctcacgcctgtaatcccaggactttgggaggctaaggcaggcggatctcctgaggtcaggagtgcgagaccagactgaccaatatggagaaacctcctctccactgaaaatacaaaattagctgggcgtggtggtgcatgcctgtaatcccagctacttgggaggctgaggcaggagaattgcttgaaccagggaagcggaggttgtggtgagccgagatcgcaccattgtactccagcctgggcaataagagcaaaactccatttcaaataaaaaaaagaaaagaaaagaaagaaagaaagacaaaaataaacaggcaaaagcaaagtgtggagtaaaataagccagtgggtggcaagaggagaatggggaaaatatatcaagagagtcaataacatcaacagagagaaaatgatactcagataaaagaaaaaaaaagaactaggagttgactgtttttgagagtatcctattttggattacaaggccacagaaatgctaataacgataataataaaatactaacaaagtccatactttgcatcatgcaccactgttccaaacactttctacatattcacctaatttttttaacctaatttttacaccacaatgaggtaggtaggtgttgtcatctccattttcaggtaaggttaccaagttattaaggagaagttgtcaacttgacctagacttcatgctcttaattgccacactgtactctcttctataacaatattatactaatttatgatgctgtgagtaagtgatgatccttgaaaccataaagccatcactgaaggaaacattacaatgcctggtgtaaagaaaaacaaaagagagagagtgtgtgtgtgtgcatgtgaaagagagagagaaagaatatatatataaaattcgctaagttaaccatttataaaactcagtggcattaagtacattcacatagctgtgcaactatccatctccagaactttttagcacatcaaactgaaattctgtactcattaaacaatagcttcccattcttccttccccctagtacctagtaagctctattatactttctacctcttttgttgactattctagatacttcgtataagtggaattatacaacatttgttcttttgtgtctggcttatttcccttaacataatattttcaaggtttattcaagttgtagtatgcatcagaatttcattacttttcaagattaaataatattctacagtatgtacatactatgttttgctcacccattcatctgtcagtggacattgggttgtttccatattttggctgttgtgaataatgctgttatgaccattgttgtacaaatgcctgctcaagtcttggcttgcaattatttggggtatatgcccagaaatggaattgctggattatatgacaatttttttaaaaaggggtctcactctgtcacctatgctggagtgtagcggctcaatctcagctcacagcaacttccacctctcaggctcaagcgatcctcccacctcagcctcccaagtagctgggaccacaaatgcgcaccaccacacccagataattttttgtatttttgatagagacaaggtttcgtcatgttgcccaggctggtctagaactcctgagctcaggtgatctactggcctcagcctcccaaagtgctgggattccaggcgtgagccactgtgcgaagactgacaattctaaatttaatttatgaaatggccacattgttttccacagaagttgcaccattttgtattcatatctgcaatgcccaagagttcctattttttcatatcctggccaaaacttattttctcttttgttttttcttttaatcccaaccatcctaatgggtgtgaagtggcatctcattgaggttatgtttgcatttccctaatgattaatgatgctgaacatcttttcatgtgcttattgacgaactgtttatcttctttggagaaatgtctattcaagtattttgcccatttttaaattgttttttcttgttgacttttaggagtcctttacatattctggttattaatctctgatcatatatatgatttgtaaatattttctcccactctttgggttgcctcttccctctcttgctaatgtcctctgatatacagaagttttaaattttgatgaagtccaatttttttttccattttttgtgcttttggtgtcatatgcacattgccaaatctgatgtcacgaagtgtcactctatgttttcttctaagagttctatatttttagtcactatgtttaagtctttgattcattttgagttaagttttgtatatggcacaaggtggggcaaacttcattcgttgccatgtacttgttttcccagcaccaattgttgaaaagactatcctttacccatagaattatctgggcagccttgtcaaaaatcatttgactgtaaatgcaagggtttatttctgggatatcttttctatgccatttatctatatgtctgtatcacactgatttgattattgcagtttgtaatgaattttgaaattagaaagtgtgaggcctccaaatttgttcttatttttcaagattattttggctactcaaggtcccttgagattccatatgaaattgaggatgtgtttttttctatatgtgcaaaatacattgttggtattttgatagggattacattgaactggtacattgctttggttagtattatcatcttcataatattaaattttataatccatgaacatatgatgtcttttctgttttttatgtcttctttaatttctttcagcaatattttgtagttttcagcaaaaactacaaaggaaaagacattcaggtaaaagtctttcacctctttcgttaagcttattcctaggcatttcatttcgtatgatgctattattaagtgaaattgttttctcaattcccttttcagattgttcattgttcgtatacaaagacacactgatttttgtgtgttgattttgtattctactgaattctgttattagttttaagatttgtgtgtgtataatcttcaggattttctaaatataagagtatgtcatcactgaacagtgataattttatttcttccttctcaatttggataccaccaaaaaaatatataagtttttttattcgtttaaagttggattttgtcaggcaagtaaaaagaaaggaattaattggattgattgaggttataggaggagtacacagaactccaaggaactgctgaaagcactcaccagcctccttttaaatggggcttctgttattccaaggacattccctgcccacgctcgctcataagggctgtgtttgatcctcatttctctttcctcatagaggcctgtccaaattagctcctgttagaccctgtgcattaggttgtctgacaccccagaccaaagccagtttagttagcttcagctggtcccattctatcttctttaggcttctccccatttttactggtatatatggccaagacctcaacatgcttcaggctaagcttcctcatatttttctattaaatcagatagacaacttttactacattctaaactcatttaccttgggaaacccttgaacatctaaactacgttcagaatatttaggattttcagactgtctcaagattttctttgtgtccctctaggtattagaagcttgtatttacaggcatctcatttgtacagacgccttctaagacccataagagactctagaaatgtgttcacattgtcatttattctagtaaaacctgccacaaatagttttgggatccagctaaggggaagttgagttgaggatacatttagtttgtgtttagtgggtaatttcaggtgttttacagtcacttccctatattttttaccaccttcatacttgtggtattgacatcggatcatgatagaaccaatagagactttgcctgtcctaattatatgtgctctcctttctgaaacaccccccaaacaaactatgctaaaacaaagactgaattatcttctcagtttctacatagaaagtgacattacaaaataacttgttgtcattttagaggtgatcaagagtgtgcagtgaaagacagaaaaaaagaaaagaaaaaagttttatgagggtgtatctgacacatcatttatacaaatgtattatttttctggattttgctatattttgatatttgacagcattttaaaattagtatctagttggtttttgttttctaaataaatattcactttttcttaaggccctcaaaactctgtatactttaggctccacacagcctggcctatcacaatcaatgtattatttatttattataatttttttgagacagagtttttgctcttatcaagcagactagaatgcaatggtgcgatcttggctcactgcaacctccacctcccagattcaagcaattctcctgcctcagcctcctgagtagctgagattacagatgtgtgccacagtgcccggctaattttgtttgtatttttagtagatatggggtttcaccatgttgggcaggctggtgttgaattcctgacctcaggtgatccacccgccttggcctcgcaaagtgttgggattacaggcgtgagccaccgagcccagccaaacagtgttttttttttgttttttttttttaataaaaaaacctatcttctgaaatgataaaatgaacacatattcaactgcaatatttttattctttacagagaaaaatgacttctttcccttcaccttccttttgatgtgacagtggttttcttcaaaaaagttattttgcttttactatatgtgtaaaaatggaagaatagtgtaggagttataaaaataacattactgaggacctgcaatgtgccgggcatgtttctaattacttgatttgtattgtttttcatcccctgagaaagatcttatcagtatctccaatgtgctgacaagacaatggaggcacaaagagatgaaataacttgcccaaaattatagaagaaactctagattggaagccaagaggctcaagttaaagtttcactttgctttaaactgattttatgcccataaaaaaagtcatattacctctccaggacctattttcacagaaatacatgtatgcatacactgaggtggggtgtggagacagggtttgaattagctcatgccttagaggttcttcagattttaacatttgatttaatgctgatgtatatacttctcttgaaagatttctaaaaacaattacttaaaaggtgaaaataaatctacgtaatttaatttttcccagagatagttcaatattggcattgatacaaataatcttaaaaattttacttaatataacaaaagcactttgtggattaaaaagatgatttatatgtagtatctataggtctgattacctcagtggcacggcaagtagagaaaattaaaataactagatatatgatgcctcgaatacatctaaggttgtatgtgaggtgaatttatgtaacaaccacttaaattggtaacatcatcataatttcagaattctagcaactggagtaatggcatcaaattcaatgctctaactctgttcatccttttctcagttgcttaaatgatgttctactactaccaaatatttctcactttctacgtagtttttccacatttctttattttgataactttttctattttacctgctctcatactatacttcatctatggcaaattacctttacacttcaaattacggcatgtaatacttcccaccatgaatctccatgtcagaactttatgttaaatgataaaagcatttcagagtaggggagggtgtggtgctgaggagacctaacctgccatggactccaggtttacaattaatgaaactgcattcaactttggcctcacaaccttttttgtaatcttcttactccatgaagggatgatccctgcatgatgggatcactcacacggaaacttctcacaagactctcatttgccttggataaacgtataagaaaccaagctatcctattctaggggttaaaagtattttttaagaggagaaggggacaaagtttatttctgggaggatagagctttctgtgaaagtatatgccagtataaattttcgtatctcataaaacatactgctgaagaggaaaagttcaacctaggactatttcggttatggaaaatgtaataagtgggaaaaataatgctcccgggaggtctgtaaaaggcaataattccacatgaaaatcaaaacatttattttactgtcttttacactaaatattaagattggacaaccttccaaattaaataagtaaaagaggaaaagaatataaaatgcattgcttgtgatgataaaacaaaatcaccaatacgtagggtttgtagactaataaaaatagaatttggagtgaggactcccattttaatccagctccagtacttagttttgtgtggttttagacaaattgcttactctctgagcctcaatttcctaatctgtaatgatcattaaaatgcttgttacaaaggttgttggtagaattaaattagattatggtttgttcgtttgtttgtttgtttttgtgagatggaggcttgctctgttgcccagactagagagcagtggtgcagccccaaaaattcaagcaatgctcctggctcagcctcctgagtagcttggatgacaggcacttgccaccatgcccaactaatttacaaatgattgcttctataaagataatttgaaaataaaatacaagaatgctttagggatttaaaagaatactatacacaaatatatatacacacagaatttacaattttgttgaactcaacaatcattttaatattccaatttttttaagtctgagttaaataaatataaataagaaaaattgaatctacacacaattttttagggttttcctgtaacataaaactaaaataagagaaaaattgccttaaaactatctgataccaataacacatattacagtttaaagtaataaaaatactttaactggcaatgatgaaaaaataaatataggcaacagagattttttgatccattataatttgctactcagagatttaataagtttagaatttggagtggaaaaaaattggtactatctcccaaatcatttcagttcaaatggagaaatttaaaatgaatttaatatttttgccaaatctcctttttttaaaggacttttatgtcagaaacatctacaaagtttctctttaatgtaccatccaatttcatatagacataaagtcaaaatgtaagctattcattaattgccaaagtgtgtttcatataataagaggttggcaaaagttaaaaagaaaaaacaaggcctggcgcagtggctcacacctgtaatcccagccttttaggaggctgagggaggtggatcacaaggtcaggagatcgagaccatcctggctaacatggtgaaaccccgtctctactaaaaatacaaaaaattagccgggcgtggtggtaggtgcctgaagtcccagctactggggaggctgaggcaggagaatggcatgaacctgggaggcggagcttgcagtgagctgagatcgcgccactgtactccagcctgggtgacagagcgagactccgtctcaaaaagaaaaaaaaaaaaaaggcatgtatttgaaatgcctgacagcttgggattagacatattctttgtagacttggattcagctttggttttagcactaagaagagttcacataacattaagaaatttaactttcttaattgtcaaatgatttttgctctgtgtctaccatttatctaagttagagagcataagacaggagaaactcagaaaatatttcactttaagtgttctaagggagaaaagtcacgcataaatattcaataaaggacaacacgtatatgaaatctatgtaagcaatgttttccctgagttgcaagggcatgttaagaaaatatgagtacaaggtacaaatagggtcgaaatagttagggttgacttctctttctcattcctctctcattgttcatgctcttgcatggtctccttctctctccttctgatgggttcctagaaattttattaatatccttgacctagtattttgacctccaagatactatgtccactgccacaaccccactctacacgatcattatctctcagtgacaactgaggtagctttagttctgttcctagccactctctacaaagtgatatttccaaattactaatttcacaaaattcctgcctcctcttttatcataggatcaaagtcaaagtacttaatttagcctaaggccctgaaatatttggcccctgtttatttctctagcattatttcctatcagcacccctcgatttccactcttctttgtctaggggcatttgtctatgcttttctttctgtagggatttacctcttgttaggtaactccaatttatccagcagggctcacctaaagcattattttctcacgaaaactttattaaatctaggtcagtttcctagattgtcacggttgagcatttatcacactacctcaaatatatcaaatctaggtcaggttcctggattgtcgtgggtatttatctcaatatctcaaactttatcaaatccaggtcaggttccatctagggtgagtattgatctcactatctcttctcattaacgagatgttcattagagtgatcatctgatgaatgactaatctctactttccattgttataaaaaagcagtgatcttaatgtctttatgttattttcccagggtacgtggaaagtgccaaatagaatccctcttcccatgtaaccagggctccagtctaaggctccttctactttgcaagcctactaatttattaaaggcttttcccaagtgatcaagtctatccctacagcgaactcttataccagtagctatggtgatgaaaatatgtctatatggtcaggtatggaggttcacgcctataatcctagtgctttgggaggtccaggtggaaaaatggcttgaggacaggagttcaagaccagcctgggcaacatagcaagaccccatccttacaaaagagttaaaaaattttttaatgtacgtatcattttattttatttataactctgcagtcacaaaaaatagggccactactaaagtgcatattcaacagcaaagtgttcatcaaatatccatattaagctattctaaagattattccaagtgaatcaccaggctttccttgttgatccatcctgtgctcaactctagtgagtctcgagttagcaaaaggtaaacattaaagtgtgatttcccccatggaactgttatgctcaaaaactgaccattttgctatttcttcagattttaattatattacttggttagctagaggtcagaacaggaaaataagaatgaattcaagctggaaaggccatttagaaatactgtagcaattttaccacacatttaaggtaagaaaagctctataatctatttaaattgacctgaaacaaagttctttattaccagtataggtggtagattaaaaatagagtataataaaaatagtcagatgctactattaaaagagaatattggattttcccaactaggataggattttataaaaatcatatatatatatatatatatatatatatatatgtatatatatgatttttatcatatgtatctataaatcatacatttatgtttatatatataaaagagaaataaaattccctgagaatagaataatgtctttcttaaattagaagctttgtctatagtttgggcaacccaatctttgtatctttttattttaatcagtcaaattggtaatatataaaattattcagtaaattatatcatttataataatttaataaattatagtatttactgaatagcaaagatcattgggagtgattagaaaacataaattaactatacgaacttcatgaattactatattaaaattaaattatttattttctaaagttatgaagtattaaagtttggaaagaacatattttccattctggaaatggaaaaaaaagcatgttttctcattaaataattacaaacatttccatttaaaatttactactctattggagaattcttcttggcctcaacagattgcaaaaattgctaatgtttatttcattctccaggacctggagtccttaattgctgatgcatattcactggcgcatgcaaagtactgcagtgatgcactacttattgtaataattacatattaaagaacctatggcctacattcagtcagactcactttgtgagtttacttcttaagggggaaaaaaaaaaccctgaattaccagttacaaaatgagttagttgatagacaaaaattacccaaggaaaacataatcaataatatacactggaaaagagctcctctttgttgagcacagatctgcaatttgtaatttaaagtgttatttattttgttcagggcaggttgagctgtaacatgccgtgtaagagataaatacggctatggttcttaattacagactttaattcaatgggctatgtatagaaccaggaataaggtactactgtttcctgggagttggactatgtaaattagattgagtagtaggacacaaagctatgaataagaaggaattatctccggggaaatataggtgacaaacctacaatggcttttagcatctggcaggttctatttgaagagctaatgtcattctatgtaatggattaggaagaactggatgcactccataatgcaggccaagcataatttccatgatgactgagtcttctaacatatcagacactatagctgccttcaattttctagtctcattttcaaccctgtggtgagggatggggagggagaagtctgtatttctccatagtcagctgaggctacagcagctgtgaaagcaggatttgagggataattaacatgtagaattcatagaatcatgaccagttgaatgtgagagataagaattatgaaggaatcaaggacagtctcaaatttatggcttgatgatttaattaatgattatttcagtgatgaaaataaagaacacaaaatatatggtttgggtgagcaaaattattagttgagttatagacatgatgaaattaaaatattgcagcaaatctatgttgagatacacagatatcagaaacaaaatctggggaagaaaaatagatttttagagtcattgacatagagagctatagattgttgttgaaacagggtgatggattcagtaccaggaggtgaaacgacatgagagagagagagagagagagagagacagagacagagagagacagagagagagaaattaaaaaaggtaatccttgtggctcacacctgtaaacccagcactttgggaggtcaaggtgggcagatcacctcaggtcaagagttcgagaccagcctggccaacatggcgaaactccatctatactaaaaatgcaaaaagtagctaggcatggtggtgtgcacctgtaatcccagctactcaggaagcagaggcaggggagtcgcttgaaccccggaggcagagattgcaatgagccgagatcacgccactgcactccagcctggtcaacagagcaagactctgtctcaaaaaaaaaaaaaaaaagtaattccagtattcatgaatgtagacaaataaagaaatgcatccaaaaggaaatgctcagagtagtaataatctcaacaagaagatcatggtcaataggatcaaatactgaagactagtcaaataagacaaagaaataggggttcctaaattttggtacttatgcagatactaatgcctttaacagagaagttaaaggtagaaaacctacaacagtagcctgaaagtaacatgatgagaaaaaaatggatgatagagtagattatttgtaattgaacctaagtttatttcataggtacttattcttcattgagcgttgcactaaattatacactgtagttctttgtacctctctctttctctctgtcaaactctctctcttctattatacaactgggtatataggaaggaattttatgtatcctaaaatgtttaaagtgacatttatgcggtgaaaataagcttcactcttctgggtcaactgtgaaatagcataaaaagtccgaggttaaattagaagcaaagcattttctgtcaaacacagtttttactgaaaaaaaaaaagacttacataaaatatataactatgggtggctcatttagttgtatatggcagaattttttctgtcctctttccaaataactcgagtggtttcttcagtttgacaaatagttataaaaacaagtttgcagcataaaagaaaaggtggcaatcagctcctgcacaaaaactgattattaacttaaacaagtcatagaaactaatggtcaggattgcaattacagtcacaaagaccagaccacatctttatgtcagagggcatagagttcactcacattcaaggttcaatatgtttgaatacaaacacaagatgggtgattacacagaacccagtccatgaggtgacttcattcattaaccttggaaaatcctccattgaaattagacttttcttagtttatcgatgtttatgtgagataaactcaaggcaaacttgtatgacctcaaccatttcccttgtcactcaaggaaagggaattatttatttattaaattataaatgtatttataataattataaataaattgttataattttatttttaatttatattttatattgttataaataaattataacaatgaaaacattcacaatgctttaagaatggagtcttagccaggtgcagtgctcacccctacagccttaatactttgggaagccaaggctggaggatcacttgagaccaggatttgagaccagcctgggcaatatagtgagacccccatccatatgaatttttttaaaaaacttctctgtgaagttactaaaatcagcaaaaatgggttaatattctcctcaaagcagaaaaaaaaagatctccatagttcccaggtttttctttaagaacttttactatattgaaaggataaaagatctgtcattcctcagagcatatcacaaagttatcttccaaaaacaccctccacaccatcactacatggcataacttccctatcatgaagtagtaaagaatcaatcatagatattttcttaacattggataacacactgtttctcagggactgtctgcttaagggttttctaagacactatggcctcattgcctgaaaacaaccagttcctcactggctactctttaataacacaattttttattttcctttttccctccctcttcatttaattgatgtgcacaggagagcagataagggtgatgttcggctagtgatcaaaaaaatatttttgtcataaaaatcaacagaagcctctattctagcattttcaggtggtggtttcagagtctttcgggtaattggttttcttggactcagcaaaggcagacttgctttttctggggaagatatatttccagaggttagtgcttgtaaatctgctgttaggtgctggtatatttagtgactttggatctatggaatttgaacttgagaagtccttcctgtggcaaatttaaaaatagagcagcgttgcaacaaacataaccaaaaagaaagtgcttgcctttctgacagttcagcttgagtgcttccagagcagatagatacgtgactctcctgaatcaggcatttgagactttactgacgaaccttttaaataattatcaaaaggtcacttacatatgctgttagatagactaaccattgaaagcatgagaaaaactgctgattttaagtagtctgttgataggaactgctgtggatttaaagaaaagataaatgtcttctgtcacaatactgtcttattgtaaacaaattctatcctagctagagattcactgaacagaaaaggagcatttttagagacagttaatgtatcaggtttaactgattttcataatggtgtttttaaaaaattttccctagctttattattttatgattttctaacttatcagtatcatttgttcacacattaccatctatcttacctaacctgtagaacttccgttcaagtaatatggtgtatgttaaatgactattgttgtcatcattgctgttattgtcataattatattactcatagagttgtttaaaaccttgttgttcaaagtgtcatctgctgactaatacgacattggaaatgagtctcaatcatcaaggtttattagccagctatagtgtacatccggaaaaataggagccacagacacttttgtttttccaaagaggctttatgtgggtatttataaatttccttgaagtgggagagggcaggtagaaagaggggcaggtgagcaggaaggcaaatggctacattcccatgagacttgggttagtgcccagtaaatctacatttacataagattaatgaatgtttgaagagaaaaagagagtaaaggaagaagaaattatgcagatgtctctgggtaggtggaggaatgagtcttgacattgttctgcacctgggaagataagctcatactggtctttatcagtgtgaaatccaacagactttagttttaagagctagacttacattgtagccctgaagttacaattggcattcccttgtttatatgagaggccagcaaaaattttacttttgaatgatctatagggacagtccttttagatgcttgaggccttttaccttcccatggggatctggctaaagaataatgttagtgacagctattcatttggaagagggtgtggcaggacaggcttcattctcctttttgcataagaagtttagggttcctgagattttaaattttttcctttacaaaaaacatcagcatcacctgggagcttgttagacatgcagaatctcaggttctaccccagacctactgaatcagagcctgcattatagaagaaccccaggttattcataggcacattaaatatttaaaagtactaccttaaagggataaaattacttaggtaaaatacctataatagtcctggtcaatgtttgttaaatgttgtcttccctccctaactcagaaaatggattaactcattttctgtctatcttagaaagctgaccttcttttgtttgttatcaccaaacattatcatcataaataacaataataagaagaggtattacatccttactgttataaacattgggaatataagtacaagctatgatccctgaaatagaatatataatctatttaggatggcaggacattttatagaaagtacttaaatatgaggtatctatgtagaaaaactaattctctgtctatgaaaaatagcatcccaacaaaatgactagatagctggaacagtctcacttgaaatacaggcaatttgttgtacatgaaattcactttggaagtttctagtttagacgagttaacttctcagaaagttagatggttatctgtgagatgagcagaaactgagggacagtacaggaggaccacttggccactgattgagagagacttgccacatgtatctgctatcttggacagaaaagaaacaaaacagtttctgtaatgagtcaaaaactgaaagctcttagcctggatgtcctgaagtgcagaaataaagttgagccgttttttcatgtaaactgccataaacgtgagcataaaaagcagtatctttaggtcccctcccctcccctcccttcccttcccttcctctttctcttcctttctccctttcttcctttcttcctttcttcctttctagtacagagccaggcacctagtttaaggttatcagaaatttgggagagccagggttgggtctaggtgagggctgacaaaagaaccgctgcattccaagttctagtccatgaattgataagcctgtatctaccttttacagagctttcaagactgtatgaaattagatgttattccctctcaggctttatcttttaaaagggatggtcttcatgtgtgaattcttccaactcattatattccttaactttacgtaagtcttttccatatccactataaaaaaagtcaaagtatagcaatcagatctacatggaatatttgcggaatctgataacctgctttgagtttttttctctcaaaaagaaaaaaacctgttaataataatcaactattttagcccatttgtctgcatcaatttggtgatttcaatggagaatctacagggatgctcaggtgcctccttattgttatcccctgttcaaatctcatcattgtataggtgtggcttcaattattttctcttaagccaacattgtatttataccaaaggaatctgacttgtttcatttctgctcagtcttccagagctctaaatacttcctcaaatttaattacatcaatttggcatctccctggtgttttcattctgcactttctcttctggatcatttgcaagaatattcgtgtattagaaactcaacaattttttttctgtcaagtaaagtcctgattagccttccattgcttcccttcatctgagctacttccatatatgattaaaatctttctcagtataagaagtaaagttcctatattgaatgcatttctcaccaattcctttactaatctattaaaggattttaatgtattgttaggtaaaatgttctacagaaatcatccaagcttttctctataatgcatgtttctttagatattgtatgatactaaaacttgaaagtggtctggtcttgacattctacaaagtcaaaatttattttttctaatagataaactcttagattgtgaaacatgcacttaccccaagagagaagtctcctcattcttccccttactactcagtggattctaactttacaacacgtaagagatttatactattaaatagctgttaaagactaatttaagaaacttccatatgtctgtaaagtgtttttgcaatgcgtatttaaaacttgaaatttgcataaactaaagagcttttgcacagcaaaagaaactaccatcagagtgaacaggcaacctacaaaatgggagaaaatttttgcaatctgcttatctgacaaagagctaatatccagaatccacaaagagctcaaacaaatttacaagaaaaaaacaaacaaccccatcaaaaaatgggcaaaggacatgaacagacacttctcaaaagaagacatttatgcagccaaaagacacatgaaaaaatgctcatcatcactggccatgagagaaatgcaaatcaaaaccacaatgagataccatctcacaccagttagaatggcaatcattaaaaaatcaggaaacaacaggtgctggagaggatgtggagaaataggaacacttttacactgttggtgggactgtaaactagttcaaccattgtggaagacagtgtggtgattcctcaggggtctagaactagaaataccatttgacccagccatcccattactgggtatatacccaaaggaatataaatcatgctgctgtaaagacgcatccacacatatgtttattgtggcactactcacaatagcaaagacttggaaccaacccaaatgtccaacaatgatagactggattaagaaaatgtggcacatatacaccatggaatacaatgcagccataaaaatgatgagttcatgtcctttgtatggacatggatgaagctggaaaccatcattctcagcaaactatcacaaggacaaaaaaccaaacaccgcatgttctcactcataggtgggaattgaacaatgagaacacttggacacaggaaggggaacatcacacatcagggcctgttgtggggttgggggaggggggagggatagcattaggagatatacctaatgtaaatgatgagttaatgggtgcagcacaccaacatggcacatgtatacatatgtaacaagcctgcacgttgtgcacatgtaccctagaacttaaagtataataaaaatatatacattaaaaaaataaaataaaacttgaaatttgcagactttaaaatagaaattctacttttagaaatgtattctaatgaaataactaaggtaaacattgaaatttagcttaaaaaggctacagtattttttaataaataaacaccatatagtaaattaccaaaatgtatatccactaagtaagttagagtgcagaattttgtttgtttgtttgttttttcttgctgtgctgcccaggctagagttcaatggcgcaatctcggctcactgcaatcaatccctgcctcccaggttcaagcaattctcctgtctcagcctcccgagtagctgggattacaggtctctgccactgagcccggctaatttttgtatttttagaagagacaggtttcaccatcttggccaggctggtctcaaactcctgacctcgtgatccacccacctcagcctcccaaagtgctgggattacaggcgtgagctactgcacccgcccagaatgcaggtttttaataaaatgctatgcagccatgaaaaattacattaaacaatatttaataacatggaaaggggtttaagttattttaagtgaagaaaaaaataaattaaaaatatatgtgatacattttatagagacaactacctacacagaagaagctgaaaggttatacaccaaatattattcatcatgatttctggtagagaaattacaagaaatttctactttaaaatttttgtattttttaatgaattacatttctaaagatagtagaaaaaatgaagctctcttagagctgattcaaaatctttcctattagaacctctgttcatctctgaatcttatttcaattataaggaaagctgtgaatagcttgtaacaacatccaattcaccattgtgagttaattttttaaagtttcttctcccactgtatatggtgaaataggtgaatgtattaaaattgctaaattttgctttttctgaatttagctaatccttcttgagatgtgtgtgtgtgtatatatatatatatatatatatatatatatatatatatatatttgttcttcagcatttttctttattttattctatctccttttgagctaaatggatgacctatctgccagctccattagtaattttatttactgcttcagcctttgaaacaagttaatgcagaagattgaatagtattttagaatttacttcacacagtaatgtgactcaaggcttcattggctattatgtcccctttggcattaaatattttaatctgctaactatgacagatacaggatggccaatttcccagtaaatgtattagcctcctagtaaattaccctttcccaccttataccatgcagcctattaacctataaaatcccttctcttccaatataggcaagatgtcttaactgaagacttaatgttgaacacatcctaaagcttgagaagaccttatttcagagggttgggaaaggaaaactaatcattgcaagcaaactttaagttgctgagactacagatgtcactttggttcatttcctattaccatcgtttgatgaggatatagcccaaaaaccaagctagatgagtattttaataaatgtggactgagattgctttaacagaaaatataagaaatttctgtgtttttagtaatatatcctaggttcaaattaataaatctcttgattattctgtgccttaaacttgtatgaccatctagtcgtaccatttgagcaaataagttaccacctcaggaaaaatgaagtcagcactcaatttatatctataggataattgtgttttgttttgcttttatcttaagcccacactctagtaaacaaaagctatcagaagaaagctttgtaaaatattacagattgtgttgttaaataatactaagaactttcttgcatttcatggaaaagataatgcatattgtgtacttttcattattttaaatgtgtctaggaccaaataaaccaacggtgttctctgtccttctactggtttgggaaaagatttatgtaacaaaccattatcttctagttagaaatcatgaaagatgaggactgttgttcctgtaattaatcaccctatagtagaactctctcacagtgacttaacaaaatacacttatgtatgaatcttaaatatgcagaaggaatactaaagttgaacgggtaggatattttatcttcttttaagctttcatatggttaaataaaacaaaaattaaaagtctataaaacagaatgtatagctttacaaataattataaccaatacccaagttgtggaaaagaatattatcataaattacacacccttatatgctaatttttctttttaatgttaccgcataaacgtccctttctaaacagtataattttatttctttctgaaatttacaaaaacagcagctttatttcttgcttattttagtcaatactacacttgtgagattcatccagattgctatatgtacctataaatcatttattttgttgttccttttttcattatataaatataacacaaatccattctactgtcaaacatttggattgcttctaggaaattacaattaatgctgctattaatattttctcattcctatatgcatcagtgtcttcagattatgtgtctgggagtggaatggttgggtcacagagtgtattaacttttcatttcagaagacaatgctaaacatgtttctaaggtgtccatactgatgtagtctcccagcaacatatgagtatttttgatatttcacatcttcaccacttgatattgtcaatcttttaaattatagccattctggagagaatacagttgtgttttttattcggagttaccaataactaaagagattattctgttttctatatgttcattagatatttgggttttgtcatttgttattagtatatttaagtcacttgcccattcccaagtggttagcttctgtctttgtatattttgtatatctatatctacaaacatatacgtatgttttatctacataaaattatgtatgtacattatatattatatatttaaatataatatatttatcttctggatataaactcattgtcagttaagtattttgcaaatatatttttccatgtgaaggcttatactttcactctcttatggatgtattttgataaacacaggtccttagttttcatgcagtataattatctcctgtttatttttatgtttactactcttatttcctattaaaactttttcatatcccaagcttatgaagatattctacactatcttctaaaaacatatgtttttgctttcacttttaagttactaatccacatggaattggtttacatgaaagatatgagggagaactcaaatttcatttactttcacatgcatgtaattgtcacagcatcatttactgaaaagaatatattttccccacttttgtagcatcaaatcatcatcataataatcataataataaatgtatatttctgtatttttattccatttgtttatccttgattcagtacaacatggttggatcagtctgttttcatactggtataaataactgcccaagactgggtaatttataaaggaaagaggtttaattgactcactgtttagcatggttggggaagcctcgagaaacttacaaatatggtggaaggtgaaggggaagcaaggcaccttcttcacaaggcatcaggcggtagatgtgagtaagtgaaagcaggggaaatgccagatgcttataaaaccatcagatcttgtgaaatcactcactatcatgaggacagcatgggggaagccaccctcatgatacaattacctctacctggtcccactcttgacacgtggaaattatggggatcatggggattacaattcaacatgagattttgggtggggacacagccaaaccatagtcatggtcttaattactttatttttatcagatttgatatgtcccatggagtaattccttccatgttacactttgtttctgtcagagtagattatactgcaataacaaagaattttaaattgcagtgacttataacaacagagctttttgttttgtttttcttgctctctctagttgtccattttgggttgtctggagaatatacttgatttcttctaattctggagcccacactgattgaacagctactctcttgcacatattgctaattaccttagcagaaggaagtagatagagtgtggtgaattattaattggctcttaaatcttctagccaggagtcacaaatgtcactttcacatttcattaacaaaacacgtcacacgaccactcatcacctcaaccaagaggagaaaataaaatattggatagacagcactaatgattaacctaatcttttaaatgagtatataacttattcttgttcctttgatttttctttctttcttttttttttttttgagatagagtctgctctgttgcccaggctggagtccagtggcccattcttggctcactgcaagctccacctcccgggttgatgccattctcctgcctcagcctcccaagtagctgggactacaggcgcccgccaccacgcccagttaattttttgtatttttagtagagacggggtttcaccatgttagccaggatggtctcgatctcctgacctcgtaatccaccctcctcggcctcccaaagtgctgggattacaggcatgagccactgcacccagcctgatttttctatatgaaacttcttattaatttgtgaagttcataaataaatattttaaagattttggttggtattgcattaaatttataggtcagcctaaggttatttgcaagctttaaaatatttggtcttacaatccataaacatgaccatagttagattgagaaatacagatatagatttcggtcttcacacatgtttctttcaattatgatttttggttttctgcatacaggtcttgcataactttttgttacatcatttcttagtatctgatttttttttttttttaagatggagtttcactcttgttgctcaggctggagtgcaatggtgcaatcttggctcaccacaacctccacctcctaggttcaagtgattctcctgcctcagcctccccagtagttgggattacaggcatgtgccaccatgtccggctcccattttgtatttttagtagagatggggtttctccatgttggtcaggctggtctcaaactccgaacctcaggtgatccgtccacctcggcctcccaaagtgctgggattacaggtgtgagacaccgtgcctggctgtatttgatatttttgatattattgaatatattatattttataaaacttcattgcttatatcttttttctagtacatagaattgcaattgattttttaaaatactgacactgtatccagaaactggctaactcacttattaagtattataatttgtctttgcattgtattttctctacattaaattatttccaattcttcctctttctgttctttttctcatatttcatcctcaattagaatctctaggacaatagaaaagtgtgattgtaaacatctttattttatttccaattccaaaggaaagctttcaagtatcattattccattagatgttatagatttttttgtcagatgtcatttatcagctgtgaacattttccattgattcctaattggctaaaattctgattttgtcagatatttttctgcatgtattcaagtgatcatccaatattttagtattttgtaaattcatatgtttaattaaatcaattaaaaatcaattacaacaattgatttttgagtcttacagcaactttgcacttcctgaaaaatatgtatctttcttataatacatttttaaatgtttctagttggtcataacatattatccttttatatactattggatttttttgctaatatttattaaggatttttttgcattcatattcacgaagaatatttctctgtaatttttataatggaaaggttttgctattaaaattattctggcttaaaatatgacttgcctttctccatttttttttttttttttttttttgtttgagacggagtcttgctctgttgcccagcctggagcacagtggcgcaatctccgctcactgcaagctccggttcccgggttgacgccattctcctacctcagcctcccaagtaggtgggactacagtacaggcgcccgccaccacgcccagctaattttttgtattttttagtagagatagggtttcaccttgttagccaggatgctctccatctcctgacctcgtgatctgcccgcctctgtctccaccaaagtgctgggattacaggcgtgagccaccacgcccggccgcctttcttctttgaatgtctaattgaattaaccagtgaaatcatcaccactatgagattttttgtaataaccccttttctatttctgatattgattatcgtttttattattgatctgaatagttagaattttgtcagttttgttggtctcttcaaagtgagctgttccctttctcatctgttttctatttcattgatttctacttttgtcttcactgttttcttttacctgcttacttgctcacttactttcaccttgttaaggtgaaatcttaggactttagttttagattgttctccttttcttatataagcatttaaagctatgaatttgctgctaagcattaccttagcttttcctacaaattgtaatattttatattttccatgtcattcagtttgaaacattttctaattatcttgtaattttgttttaattcatgaattatttagaagtgtgctgtttaatttatagatattgggtgttttcttagatatctactttgatttctactttaattatgttgtggtcagagtgcacacctcgtatgattcttttttaatttattgagacttatttatggcctggcataggatctaatttggtttatgcactatgcacatgtgcaagaatgtatattttccagttgcatatactactctattatactaataagataaagacgtatctttaatgtcttcattgatttttgtctaaatgttctatttattgctgacgtagaggtgttaaatttactacaattatgaaattgtctatctcttaaattctatcaatttatgctccataaattgaggcctattatcaggcacatatacctttataaatgttatgtcttcctgatgaatgcctattttatcatgataaaatttttacaatctctcattatacacattgtcttgaagtctactttaactgataaactatcccctcaattctttttatgtttacagattccatgatatatcattttctttttacttaccttcagtctgtctttatagatctgtatctttatacttgaagtagcttagagtaaaatcttattttattttatccactttggcattctctatcctttaattggaatgcttaggcaagggatatgcaaaataggctcacaggccagccacctaatttagcaaaaatcgttttaaattggacacaaccgtgaccattcatttacatattttctatgactgctttcatgcaaaggtgattagctgagacagacaccatatggcctgcaagatgaaaatatttactctttggccctctaagagaaagtttgccaactgctagtttacatcattagcactcactgtaattactgatgtggataattttagatctaccgttttattattattttgttgttcctctattcccacttctttgttttctttttgattatttgaatatttttattatctcattgtaatttctgtctactggctgacttttttttaatctgttgattttctgcttataaatctctgatttttttttcagtttgttctagagattacaatatgcatatctaagctgtcatggtttactaagagttaatattgtattagttaatataaaacgtagaaatgctgctactttataaatccttttgccccattgaattttaggttatactttattgcttttatatacattgaaaaccccaccagataattattttttctttattaagtgaatttaaagagaaaaataactgttttctgcaattactctaatatttaccctttccaattgttctcaagacatgacggaaggtccagatatcactttggcatcattccctttcctttagccttttgttagccaatgttcggggcagatctggaaggtaataatttttctcaatttttattttacctcccttcctgaatgatatttttagtggatataaaattacggcttgacagttctattctttaaaatgttgtttccctgtcttctgaccttcattttttctgatgagacattctcatcagaaaaatcttattcaaatcactgcattcctgtaagtaatatacgtatcagtttcctctagctgttttgaaggtttttcttcatcttagagttttaggggtttatgatgtgtctatggttttctttggttatactgtttggggtttgctgagcttcttgatgctataaacttaagacttccatcaattcaaaaaaatttaagaccactgtttcctcaacttctgctccagtcactctcttgtttcttgtattgttacattagtaattccttttgatattgtcttataaattatcaaatttggaattacgtcttgtgtgtgtttgataaaatactttgtaacatgtggatcttgtaatactctgaagaatgttgatatttttattttagtaggcatttaactcaagttccgtttgtaagttctgttttaccttctgagaatgatagggattaaatttcagtttagctctcagtaggtttgatgtactgttttggagctgtccgtacatgcatagctcatggtgatcctgaaaattgtacaggttcattcacgggattagggaatcttttcttttccttttttttttttttttttttttctgagacagagtctcgctctgtcgcccaggctggagtgcagtggcgctgatcttggctcactgcaacctctgcctcctgggttcaagctgttctcctgcctcagccttccaagcagctgggattacaggcgtgtgccaccacgcccggctaattttttgtatttttaggagagacggggtttcatcgtgttagccacgacggtctccatctcctgacctcttgatccacccgccttggcctcccaaggtgctgggattataggcatgagccaccactcttggccgggattagggaatcttcttatcagactttctctatgctgggatttcccctcactctccagccttctggagcttttctttttggttctctagacagaaacatgagagttgtattggagttttagccaaagagaccattaccaccatctatatgatgctttacaactgggcccactttggggagcaatccacaggagagcatttcaaacacacacatgcacacaacaggaaaatcaaccctgtaaaattgcttctccaagtctgtactctcctccaaagttgacatgctttttctgcttttccaattaaagtcaggtagtcatttttgcattttgtcagcatattcagttctgatccatgagacatatggtctctagtgagcttacatcaccatgccaaaactaaaactgctattttctaatggttctagactccgatattttgtatttttttctagggattttgtatatgtgtttatttcagaggttggagtataatttttctttttgaaaggactctttaggtgcactaaaattttttatatatctctgaaaaattaaacctttatctttatgaagtgactatttctagcctcattatttttttccttgaagtctatcttctctgatattaatatagcttctctgggcacattttcctttttttccgtttagcctattttctttgatatttgttaaaaaaaattctgttcaaaaatctattttctctgatagttgataagtattttaaaaatatgctgagtgatttttttgcactaaaatcaattttctttgacattaatatgtttttatgcatgaagtctattttctctgatattggttatttattcatttattttgctgccttaaattctattttctctatactagcagtatactggtatttaatatgcttaatatttgcatggtatatattttgtaatccttttatcttgaaaattctttatcctcatgttttaaatatagtttttaagtagtatggtttttatcttttaaaaaatgagtctgacaaactttgctatatgactcattttttaatacatttatatttggtggaattactggcatggctgaattcaaatttaacatgttggcatacactttatactctatatttgtcctaccaaatatatgtttattttattttttgcttccttttggttgatcattgttattgttgtacattgttttccacagtaagtttggaaatgaagcatatctttttttttttcagtgattaccctagaagtgacaacatgaattattcaccaagatctaatgatgaacaatacttttctttttttttttttttttttttttttttgaggcggagtcttgctctgtcacccaggctggagtgcagtggcgcccatcttggctcactgcaacctctgcctcctgggttcacaccattctcctgcttcagcctcccgagtacctgggactacaggtgaccgccaccacacccggctaattttttgtatttttagtagagacagggtttcaccttgtgagccaggatggtgtcaatctcctgacctcgtgatccacctgcctcagcctcccaaagtgctgggattacaggcgtgagccactgcgcccggccatgatgaataatacttttactctccttttgaacaataaaaggtccttcaatcaattaatcctatgttttgccaagctgaattataggctatttttgtcatatattttattcaagttataatttaaatttggcaaaacattattattattttattgtgtcactgctcatttacctactttttgttactcctcatttttttcccacacagagtcatttttcttctgtctgaaaacacttcacaattttcctttgtgcttgtctcctggtggtgagttttcttattttctttctgaaactgttagtcctccatctggaagaatattttcttgagatatgtaaatataaattggaaattattttctttcaacagattgaatatattataaaacatagttcagcttcccattgtttttgttaataagtagttgccttttttcccctgaatacagatattttatctttgatttagctttatacagtatatcagtgatatgtcaaaatagggatacatttttatttatccaccttgaaatttttttagactctttaaatctattatctactatcagtgtggggtaaatcttagtcataatttttaaaaaaaataattctttttgcctaattctctctgttctccttctagagattccaatggcaaatatgccagaacttctcctatttttaatagctgttactctttcttttgcattccagtcctttgtatctttgcattttttttctggagaataccatgcagcctatttcccagtcctctgtttacctgtatataatattctatttagcccattcactgagttatcattttcagctatttttacccttctaggatttctatttggtccttttaaaaaatgtagtaaatgtagtatatcactttctataaattacagtttccatattttgtctttttatctcattaacagaataagtataggcttcttccttctttcttcattgtttccttcctgtcttcctcctttcttcatttttttcagtctctcactgacactgttaatatctggtgtccctgttcttctactttttggttattttttctctgctattttttgttcctatgaatttagttttactgcatacttggctctctgattatatgttggatattagttaaataacaattgtagaaataatttcagatctgggatgataattccatttaagggattttcatggtgttctgggcattattaacacatgactgtcttagtccaagttcagggtgtggaaattttcatgatttctcaaatgacttgaaaaggggttctagtcagcgtagtctggtttcattttgcttcacttttattcttacatgtagttcttcaaggtcccagccaaaaaacaaaacaaaacaaagttgtggtgatcttccctttggcagttccttgtttagacttttgcttcaaattcttgagatgttgccaaaagttctgttcatcctctcaactgcttcttccagaactgcaaatgccattagattaaggttgctaaatgttaaaaaaacagaatgcccagttacgtttacacttaagataaaccttaaataagtgtaagtatgagaatgtcccatgcaatatttgggacatacttaatacttaaaaataatcactgttacatgaaattcaagtgtaactgtgcattccgtattttatctggtacctcaggccaaaagtgaccaaaatgactggactacctcctgatttccattttaacctagatcttagcccaggcccgcttcactgttcggttagcattttgatgcttttaaggtgatattttaagcaatattttttccagctattttagttctcttcatgagaagtttagtccaaattacctagtccaccatcaacataatcaaaaggctaatattccattttcttggtggctttaacatcaaatataccaaaaattacatcaagaagcttaaagatagctccctgacactgaccctggaaataacttttggacagtacagcaaacaagagcacaaataaacaagtggaactatatcaaactaaatagcttctgcacagaaataaaaaagagcaataaaatgaaaatgcaacctatgaaagaaaaatatttgcaaactaggcatctgataaggggctaatatccaaaatatacaaggaattcacgtaactcacagcaaaaataaaaaacaaacaaaagcaaaagcataagcaaccaaatagacattttcccaaaaaggcataaaagtggccaccaggtgtatggaaaggtgctcaacgacactgataatcagggagatgcaaatcagaaccacaatgagatgatatctcacacctgtaaggatgaatattatacaaaaaatgaaagattataagtgttggcaagggtgagcagaaaagtgagcccttccacactgttaatgggaatggaaatcagtatagccattatggaaaagaatatggaagttcatcaaaaaattaaaaatagaactaccatatgatccggtaatccctcttttggtatatatccaaagaaattgaaatcagtatcgcgaagagatttctgtacccctatgtttattgcaactttattcacaacagccaagatatggaaacaacctatgtatctgtgaatgcatataaggaaattatgatatatgtgtacatatatcatatatatatacacacagtgaaatatttagccttaataaaggagcttctgctattttcaacaacatgaatgaacttggaggacattaagctgagtgaatgaagacatatacagaaagcaaaatactgcatgatccacttatatgtgaaatacaaaaatgtcaaatacatagaagccaaagagtagaaagctggttatcaggggcagaaaggtgggggaaatagaggaacattggtcaaagggtacaaagttgcagttatataagatgaataggtctagcgatctaactttcagcatgatgactataattaataatactcttttataccaaaaatttctgagagaatagatttcaggtgctcccagcaggaaaaccaatggtaactatctgaagagaaagatctgttaattcacttgactgtagtaatcaattcattatgtatatcaaaatatcatgctgtacaccttaaatatatacaattttattaaaaagtaaaaaagtgttagcatttaaaataatacaactgcaattttttttcattttcatagtcatatctttgtggctactaggtgcttattaagcattgctttcatgacttgctcaattcagaactaagcatctgaaagaacatacattctctattttttgttgaattgaacaacgtgctttatatgtgtgcatattgggaaaaggcacatatgctacaaaatggggaaaaacaatatccatcattatttctagcatatcaattttctataagttctctgaaatacaggtgacaccataaacaaggcccaataaagttgttgactaaatgactactataaataaatgaccattatcaatttcccatgtatcattcacacaggtgatgataatggtgtcatcattaactattccatacatgctctgatatgataacacaaaaattggtatataccatgttcagtctctggtcaaaaacattgtgaatatattaagcatgcttcagtgagggtttgttaaaatgatgacaaagacagaataatgagtgaattttaccatttccaagggaattttctgcaacggtaggatttttgtttctctcaatatcccatctgattgatcacaatgtctaagtgaagtaacagacaggacttcgtcatttctggctgctcacacataagtatactcccacaactggagttcctatatttatctccttacttggttttcagaattgttgagctcctccttttcctgattatgcatgaaatgttcttagtctttctttttcataagacactaagccttacaatattctgattatctgattctgattaaaaatattttttacatcacttttttcctgttaccaattttgagttggttttatatgtttcatttatttctggtgattaaattcttgtagaaatagtcattagatataacagttcactagtaattgagtctgtggaggtatttccagtatatatatttaaaataattatgaccttcaaggacaatcatactccttacccttgaaaatgacatggtcagtgatactggaatgccagagaactgtgaatagaaggtgtaaaatgagagaataagcactggggaaaactgggatatggataagcacatgccatcatttggaaaaggctgcaggtacatttggacaaagcagctaggtttctgggcttgacctcccagatcctgctgtcagacatgaagccttcagttatgcttgtaagagccatctctccggttgccaactccaatcttttacaaaaagctgaagcacttctactttctatatgaataatggttttaatttaaatgtctttctttcctactcttgccaagattttgttcatattatcattttcttttggggaaatggcaaaaaataacttatactctttaaagaggtatattgggtattggaaatctttgacacttttctgggattcactgatggcctgcaggactctagatgaaaaatttaagtagtacttttgtcttataataactaggtatcacatattgcataaattcctacatggaaataaaggccaaaatgccctgatattgatggtttctacttcattatttttcacaccttgtgggtgtgcacaagtatgtttgtgtgtactgatttgtgtctatttcattattggaataagatagataaatattttaaatatatgacaaattcatcaatgtttatggtacacctgtcagcaagagtctgaaaaggagttgaaactgctgtgggggaaatgactggttatgactaaaacctctttcagggtagagaaaacatccaatttcacattcacagttttaattagtatctattcaaatctcactaaataattctatcagtctctcttggagctgctgatccaaatccaaatgtctttttatatttcaccctaattttagaaaagtcactaaaaaacaacatggtcttcactcttcacatctgttccataaatcagtaaatggcatcatcatctacctatgtgagcaaaactaaggattcatctgtgacaactccttttccttcaggttcttatatccaacccaaatatctctcatatctatgttcatttttcctttgcaccagaacctccctacaaatattagttattacctatacaaatcatctccttctagctattcttcttctccttgcagccaatcagacccttctccactctgtttctattctgcagtgactctgatacttttaacacaaatctggtcttgctccctttcttaaaaataaggacaaaaggacttgacatggctacaaggccaggcatgatctggtttttacccacccctcccaccctaacctacaccatttttttcctcacttgttctcaatgaggcacaatattgcctccttccagaggacattttgcaatgttgcagcttttttaaattgtatcaactctgggttgggtatttgcctttagcatctagtgagcagaggtcagggatgctgctaaacatcctacaatacacaggaacaccccccacacccacctccaattagcagctgagattctgcttcatggagaatttggtgtacaacattgagtttctttcagtttcttatgccaccatgcaccccccgctcgggtatcacgacagacttttatacatgctcatctctgggtctgaaatgttctttcctcatttactgggttagcatgtactcatcttttagaacacagtttaaaccaccaattcctcagtgatcctcttctaccctcttgaccaaatgaacatctctccatcccacgccacccccttttaagctcttataatactacatagtaattcatttttagtgtttctcttatgcaattttactttcactgaaataatatttgggaagtgtctgtctccacttctacatcataatctatttctgttcatcattgtatcctagtgcttaatctgacgctcaacacacaataggcacgaaataaagacaagtgggaagaatggagagaggacgggattgcatgactcacagggatttctcagaaatggtggttagagaaaaaagccataatatgcttttcatctttgttaaaagtgtaaactcaacaatgagaattactccttaatatttctactttttattaagctggtcataataaaaactccttgtgttccatcttctaagcaaaacacagcaggaagattttgggttttgtagtcagattattcaggttttgaatttggagatagaaacgtgagcgaattttataactttttgagtcttggttttcttatctgtaaaacagtaacctacctcatggcactgttgtcataattgaattgcctacaaagcacttgattcataatagttgtacaataaatactttagtagctattattccactgataccaaagctaaacgagtaagaaaatttgtctctgtatcttgcaatgtatggttattgcagaaggtgttgcaacacaggtatcaagagttcacagctacaccattgctattgttttatcatgacttttttgtacttttatcatttgggaatctacagctttatgtcctagcctatttgcaaagctaaatggatattagtttatgaattcattattccaaaaacttcattatattctcggtcttgatctataatggagtgtggtatgaactgaatgtgtcctccaaaattcatacgttgaagtctaatccctaatgtgatagtatttggaggtggggcctttgaaagggcatgaggttggagccctcataaataggattcatgcgtctataaaaaaagaaatgagagagcttgcctgctctctctctctctccctctctctctgactctcttttctcggccatgtgagaaactagcaagagcacagccatttgtaaaccagtaagtggaccctcttgagacattggatctaccaacaccttgatcttaaacttcccagcctgtagaactgtgggaaataaatttttgttgtttaagccagccagcctaaggtaatttgttacaacagcccaaactaagacaaggtgactctttaaaaaaataaaaataaaaactttaaactcaagaaaaagaaaataccagtaacatcactacaagttaaacattaacaagttataaaacagagttttacaggaattttatctttttatctaaaatcaagaggagtagaatcctgaaatttatcaatgtacttcatctttaaaattctttttgttcctttgacatacaatgcacaaatgtactgagagggcaagacaatgggcaaacatactggaaaaactgtatttgtgaatttgttacatctaacaattattattaaatgtttaccgtgtgccagacactatacttagtaccttacatatattgtcttaattaatgctcacaggaaagacatatcacaggactatttctcacatttttatcggatacattaataaacttgcccaacatcacttggctagtacacaataaaaccaagttctatgtaaagtgattgggtaagaaggatctaaccaggggaataaaggagaattacagtttgcaaagatgagaccagggttggatgatactcagtatcacaagagaggaagttaaaggactctgatgagaggagacattcaaaacaggaagcaaggagattgtggacctggatgaacagactaaataagcaaaggaaaatgctgcagggctttaaaaactttacctaatggaaacttttgagaaatctttagcatgagagtgaccataggatttatgagaatagggatttttacacccatttttttgttgtttgcatgatctcaaatttcacattatcctacatgatttgaattgctctatattgtcaataacctttagtcaggttggcaatatacatcgtgacgatggtttgtgagggggagatcaaagataagggatcgagtaccacatatgagatggctcagagaagagagaagataacaggtgagaggtaacagctaagtatgattagaagttcaatgaatagaactaggagtcagaaattactatgaaaacctaaggcctggagttttgtaaaaatttatacacacgtgcatacatattagcaaagacataggacattgtgcatctcacagaatgttggtgctagaacaggtcaattttactgaaatctcattgttcaaggaaaacttcagctaacagcttgactttgttttcatatataaggtaactgacaaatttctcttatttacattctctttaatccttattttaatcatataaatgtaaacattattaccctcatttcaaaaagaagaaactgagctcagataggttaagccaactggctgatgttcacacacctaagcagatagcccagctgagatttctaactcccaagtccagctttacttttccagcagcacgtttatctcctttaagtaatgctaagtcctcctctatcctttactctttgagagcctataatacaatcatgtgaggaaaattttaaaagaaagccaccaaaagcacaagcaattttactatcctcgattactcaatatttaagactacattaagtgatgtcaggtagataagagccttgcccagtggtctgagcatagaatatactcagttttatttttgtggttgtcattggattatgctaatatgtacagatcaaaggtaattttaggatctcttttagtttattgattgtaaaatagtctaataactatatttattattttataaaataatacttttaagtatataaatattttgttctaagaagtttgaagcatttcactggaaatatctttatactatttgttcaataaaaccaattacagttcatcctaactccaacatagcataactcctattaatgatcacttttattgcatttcaggaacattaaaataatttttcgtgaaaatatgtaatataagcctgacccacacattttaagggaggatggcttcatgaatacatcatcaattcctattgctttttatgtgtcagtgtagaactgtcactgccaaagaacagcaggtgaccacatagcactcaacttcccttagtgttctatagactgtagtatctttgtaattgcaaagttaataattatattaaataatgcagtatagaataaccactgcttttttctttcaaatctctatcattagtaaatatcagtcatacatacattagtcaccacagctgtttcagattggagcactgttttacaaaaagagaaacaaatcaaatgaaatagccatttctcctttattttgcaaattacagaagaattaaaagtaattctttttatcaaagacttctttttctctatgaatacaggcataccaaatcctgatttggttttctttgctgaaaatatgctgtcattttgcaattcacttaaaaagattaaaagaaaaagttgttccattacagaaaaaaagattttttaaagatataattacataatctctttgctagttgtttcatatgagaaagaaaaataaatcttggggcccccaaaatcactaaaccaaagagaaaagtcaagctgggaaccatgttgggcaaaccctcctccgattctattcctacataagatagttacaaagataaaaggtctacatacccccctcacaatttgcccacaaggaaattccttgtggacaaaggacagacagaactaagtcatccctctgctcaaatgagacaaatgcacatctgattgcttcctttgccctattgtttcacgaagccagactaagacataagtgactattccaataaattgtgtattcagtgaaaggataatcagaaactcaaaagaatgtctcttatctacctatgacatggaagccacctccccactttgagttatcccgcttttccagaccaaaccaatgtacatcttatatatattgattgatgtctcatgtctcccgaaaatgtataaaaccaagctgtacctccaccaccttgggcacatgttgtcaggacctcctgaggctgtgtcaagggcacctccttaaccttggcaaaacaaactttctccattgactgagacctgtcgcagatattttgggttcacaatactctcctttataggaataatcgatacagttttatgcgcttataataaggaaaagacttcgccaaaagttgtctacttggtgctatgttcatatttccagaactgaaaagcagagttaaataatgagcaaagtccttattgctgtgcctgtgacatactacagatcttgcctctagccaggacccataatgagcagatgtacaatggccagactaccaggaaaggcttcagtgtcatacaggtttcagcagggctatggtctagatggctactcttccctgtttacctcatgggcccgcttcatccagattacaattctcttcccctagcttctccaagcctctctgcaaatagaaagtgatgatgccattgggatttgattgccccattgcttaactactggttggcaaataaggagtgctagatcatttgttaagtgagtcgacaagtgagtcacatgtgaatgctgaggtcttctctttctgattttgaggggacttgaaaagcacggactctttcattctcagtaacctacttatgctatcatatcctgacaaagttaccaaaagtgccttttccttgaaggacataaaaggtgaggaagggacaaggaagagaactaacatataatactgagcttgaattatttgagctaggcaatttatggatgctaattattcgacgtttacaataaattagtgggggaagggttatttgtattttattttttcaagtgaaagaaatgagttgctcttcagttaaggcacttgctcaagtcataaagctagtaaaagtcagaaatagcattagaacctatgtatctttggctatttccactgggcagctctgcctttcgtatgcatatacaggaacgaaaaataccattctaccttccttccctttgggaaaatgcattccaagtttcaaattactgagtcataaaacaataattgaaatatttcacttccttataccaggagcttcttggagtaatgacattgtaaaaaagaaagacacaatctgtaaatatttattatctaaagccaataaaattgacagcacctataaaacaatcacttcaccaatttgttgttaggtactacttgatccaatggagatactgagtttttactgttctagcaccattttacgttctgggaatacaaaggatacataagagatggagagagaaataagtaaaatgtgtaggtaacaatgagacagatgtcaagtaatagctaatttatataaaatgatgtgggaactgagagatgagggccatggggctcaagaagagaggccattagcaatgtcagggaagctgcacttagaagtaatacgtgagacggatcttaattaatattccataaagggaaggataggggaaatataattaaacagacttttaccgaacatcaaatgaagtagggaaaacctgaggcagagggtgaggaaaactcacagcaggttgaaggatggcaggttgcctgctgcagctagcatggagtcgcgcctgaggttgctgcaattcattctccagatctctgttttagcgacataaactcaggaaagtttttcagagccccaagaatatgtcaggtctctcaggtataggctttccgagctctgagctccttcctctcattgcactgatctctccttgtgaataaacattttcattatttgattgtttgctccctctcccacatgggcagaaaacattaggagaaaaggagatctatctggtgttgcttttcattatatcccagcacctagtattgtatctgacatattagcagccactgaaaagaaaaaaaggaaatgaggtaaataaatgttgaaagaaatcctgaggtcaggacgagtaggttgaaaccagaacgctaacggattcatagacattgttctgtggagagtgggaaacactaaattttatttattgactttcagtgggaggaaaacataatcggggctgtttttaaaagttagctttggctgcaatgtggaggactggtaactaagagtagagcctgcaggcattaaatgaatgtttcagtattctctccaagagataatgaagtcccaaaatggaacagtgataggacttggagaaatgaagaaagacacgagttgcacatattcaaatgcccaggatttggtgactgatgggggagtggcaaagagaggaatcagggatgattatcactagtgtcctagatcatgacaataaatataaaactgcttgaaatttaaagaagagaaactggttcttctcaacaggaacattttgatggtaagtctgtgcccagattgaaatgcagcttagcttacataattgaaataatcacgtctgaagtattcaaacaattcaaaatcaaacgcaaaagcaattttcatgaattgagtgggcgtatttatttttgagttgaatgaaaatgtttttgactagttgacacatggtaagaaaaataataacagaaccaagtatatgcagtacaatgtgaatctccttcccatcgctgtctccttgtcctcttcatgctccaagaggcaacccctgctactaggttcctgtgactcctgagtaggagtctggctaatcatccaaaaatgtcaaaagagaaaccaaggtgaatttctttcccaagctgagatttgaaataaactgctagaagttgtcactgaatgtggatattagcaaataactttaagctacagaaacatcacagatttctgctttactacttttctgaatttgtaaaacacaaagagagggagagaaaaagagaggtggagaggtgggagggagtgggctagggtgagggcaagagcagggagcggggagaagaggatggtagggggagggggagagagaggaagtgggagaaaagggacaaagggaaggggagggggtagggagaaagaggggaagggggagggagggagggaggagtggggaggggtttaggtggcttttgaagtctaaagttcatttttcaatatcactatcactcaatattatgaacagggaactcacaggcagttgacagacacaggcaaggaatcatatgattagactaatcagtggaaggtgcaatgacagaggatggcatgggagcctatgaagaaagagatgatgtttctgtatattatacattctccagaaactaagagctccaatagtctatcgagacttcatttccctggcctggcgaggtggatcacagatgtaattccagcaatttgggggccaaggcaggagaattgcttgagcccaggagtttaagaccagcctgggcaacatagtgagaccctgtctctgtgaaaaataagataattagctgggcatggtggtacatgcctgtagtcctagctattcaggaggctgaggcaggaggatcatttaagcccaggaagtagagactgcggtgaatcattattgcatctctgcactctagcctgcgtgacagagcaagtctctgtctcggggaaaaaataaaataaaaataaacgagagagagaggaaaatttcatttcccttaacagcgaagggcttcactaaaaacaaatttatcatcctgccattttactaagatattgttttcacacatccccctttcaggtcattgccactcaaccatgttcaatctttaccctcctcatctctgagctggcatccatccatcttggttgatgattttttccagctcagagactcagtgccccagcacagcagttctccaagttacaataataaacttcatttgctcttctgactactctgggtcctgaaaatgttataactgacacagttgcagagccatccattggaacaactacactaaaatatagagattgtgttcaaacatgtatacttcacatttacagtaattactatggctttactttcatttgcttctctcagttttccttcatcttgcaacaagacaatcaagaaaaagcaggtagtaggtagcttctaacagaagaacagacaaaagagagcataaagaagatattagccaagaagtgatgcttgacatttttttcaaatagaaatctattaaggaccttaaaaaatcatctattatagccaaactggtgcctaactgaagtagtagctgagagtgcttcattgaaaatcaattagagtccaacctgattgtagacagtgtcccttcaacaaaactgacaagcattctatctctactttgataacatttgtatccaaaatgagaaaacactagagaaatatgaaaataaggcaatttcaatgtatgagttatatcccttaagttcatggatgacattaactaagttctgacaccaatacccctagggtgtctttatttcactcccccttctggaaatgattgaataatttataaaggatatatcttgggggtggccacttctacttcctgagctgcatacagaacataacatttttagagctcagaattgggttcaccaccttccattgcacagttaaagagactgcagtccaagaagggtaaggggtttgcctgctgtcacaaagctagggagcaatagaaccaaagttcaaatccagcaatgctggctgcaactctggtatcttctttgcattcttctgcttgtaccaaatcagatgttagcagaaacgcatggaatcctaggaatagtaaacaaagagaaactgataacaggacaatttacatacatggggcagaatgacaaaggaaaccaacctgggaagcgaagtctgccagggctggcagcagagaaagcctttgcttcctatctctacatcctaaaggaatgaggaggaggaagagagaagtaactgaaatccagaaagtactctgactatagcaaaggatctgcaggagctgtggccttggaaaggaacatgccctctgataaactgtggctttgtcaggaagaagctagagaataaaagctagacatcattttgctcctggcctctaatcacctcctagtgcctctcattagccttgcccaaccagaagccagagaacaaaggaggctgccccatcgatgttctcctaggaccataggaggagagaaaggggatgtggagggacaaatggaaaatattcagccaatatttcttagctgcgccagccttttgctttgcaatttagtcttccttaccctcctctattttctttcattgggacaaacattatcaaggttaataagagataatggcccatgtaaaaagagtattgtattcttttatggactttatctaaaatttactcaaatataacagaatcctgtagatgaagcataatatgcaacagatatactttgcaatatttaaaaatgattaatctcaaaagtaatcatctcagtactatgactcattagctggaagaaaacagtaataacatgttttgtgcacagaacaattttaattaataagcaggacatatttattcaaaaattataataagacattattattctcagaacatgaactttgatggtaggtgttagcatcctgttgggtcccagagaatgcacttctggatattaaacatgatggctttgagacctcaaatatatcagcttgtacagtcagctattatctacactgacaattgtttatggctacaaatcacccacgcttgatgtgatatctgaaagtacctcagtaagatattatgagcaatatcaggagtgggtggtgtaaaagtcatttcagtaataaaacagtattcaaagagttgattcaaaaggcagagccattactaataaaaataatataggtagatatttgttaaatgttttctttcttttgaagggcaatactatgaaaggagagtgagcatagggaagttgtctgcaacctctgagccacacacctttctttggtctaccacatatctgtgcagccattaagaatgactctcatctcttgcctttccaaaatgaggtgtaagagaagtcattctggtatagacaggagatatgttaccaaaacagtccaatggacccttttagggatacttcagttagaagttttagctctgtgtgggttcagtgtctctccacattacccctgagacctaaatcccacagaaaatcttaaaggcaatagatgctagttttccttatacctttcaaaaatatgatttgttttgttttgttttgttttgttttgttttgacagagtctcgctctgtcgcccaggctggagtgcagtggtgcaatctcagctcactgcaacctctgcctcccgggttcaagcgattctcctacttcagccttcccagtagatgggattacaggcacatgccaccacgcacagctaatttttttatttttagtagagtcggggtttcatcatgttggccaagatggtcttgatctcttgacctcgtgatccacccacctcggcctcccaaggtgctgggattacaggcgtgagccaccgcacccagccgacaaaatatgaatttttaaagaccaaacacatcagaacaaaccagctaacttgacttttaaaaaccacttgatttcacacaggtctcagatggagcaaaagtaaaaaaaaaaaaattaaaaaataaagacatcccacttgaattctagacaaaattttatattatctaatggaaatgttttttaaaccacataaactgatgagacatatcctttatcctctgaaagaaagaagaaaaaaacaatatttactagctgaacaaaatgccttgagtgaaatatctgtgagcatacatttttaatttcctaagatgaaaacagttttgagcaaggagctctcaaaaaaatgtcctgatgttctcctaatacaccaagaaataaaatctgtcaaagtgctgagattcttataggttttggtacatgttcccagttgatttgatctggctccagatgaaacatattatttaagcaagatagtaatcaaggtaactaacaattttaaaaattacttcaaagcatatactaaggcttgactagtgtgtatttattctctttccattatttctagacggagaaacaatttcattatattttaagttgtatcgaagcatttgttctggaactttctgatgcattagcagattctacctttaatatagtcatatgtgtaggtgtattatcatgcctgctagaccagaagaagtgaaagcctgaattggttatcgcattcccttttggagattaaaaaatagcattacaactatctgtgttgcatttcaagctaaacccatactttcatataaattgtttcacttggtctacataataatcctgtgaggaaaacagggcagcaattactgccccatttcatggatgaggaaattggcttagaagagttaagtggcttactcaaaggcacatggctgagcagttatggacctctgactcataactaagcccagttcaagaaaacacgtatttattcagtgttttaaaattatcaccctaagtcttttgggttcaaggtagtatacatatggcagactaatgaacaaaaagaaaagtaacatttatacagtatttattatacaagagtccctctcataagaactttatagataatagggtcattatagatttatctcatttaaccccatagcgaccttgttaacagtgagataaatctgtaatgacccataacaaccttgttatgcagttaaataagataaatctataatgaccctatgtcattgtcacgtcacagatgaagccgccgaggcacaatgcagatgattaatttgtatagaatcactgacgcattttttaaagaaattaaacaattaattagtgtgtattcatactagttgtacatatttatgaggcaattttgattttagagtccatgttcttaaccactatacatatttgcctccagagattccaaaacttacggacatcttttcattatgctacacagtctcccatgagcagagtatgaaaaaaatccagatatgaggccgggagtggtggcttatgcctgtaatctcagcactatgaggggttggggcaggtggatcacttgaggtcaggagttcaagaccagcctagccaacaaggtgaaaccccgtctctactaaaaatacaaaaaatagctgggtgtgggggcacgtgcctgtaatcccatctactagggaggctgaagcaggagaatcgcttaaacccgggaggcggaggttacagtgagccaagatcgcaccactgcactccagcctggttgacagaggagactctgtcttaaaaaaaaaaaaaaatctgaatatgaatctaagcaaacatatacacacaaacaggcatacatacctagacaaactatatgtctatctctacatctacctatctatacatacaccttatgctgagggtcttgaatatgattgataatcacattctgtgtggctaattgcatttaggccaggactcaaaaaaaaaaacaaaacatgaaataaaccaaaataacctagatgagtgagaaattctaagtttgaattttaactggggaggaaaaaagataaagaaaacttcacagattggaggccacttatctccacatttaactttcaaaacctttctcaaaatatctttgtatttaaaagaatccatcagtctttgcaaagagaggagagaaaatagacttgaggaagatgtttccttctgtgtgctgtgtgactcaggacacatgcttcttctgtgcaatgctttaccatcatctgccaaagacgtgtgtgcaaatatcagtcttgcaaacagacaatatttgcactacattgaggctaacctgccatctgcttatcagatgttcggagtccaaattgtacagttttccttgtgtttcccctaatgaaaaatggaatgctggggctctgattacaagtgtctgtgcacaggactaatactacatccctaggtagagtaatggaaacagtgcatctaggggaaatggcttatatattgacattgtttaaagaaaacagaattattttctgtggctcaggttcacatgaaatataaacctcctagttcactaaagtgtgatatatttttctcaaaatttggagaaccactgatgttctggacaactgtatttcagtgttaggcctagccgaatatatcaactaaaaatgcaatcacagtgaaaaattctaatgatatgcattatttctgaataagcaaatgccagaagcacaatcccaacatattatgaatgatgtgattgactaccagggttgctcgcagcccatagcttcaggtaacacagctgtctcctcccattaatgagaaaagagatagcattttctgtttaaaattaataactgtaacactccaggattataggaaaaattctaagtgtttcacacaaagtgcttcacaaaattttactgaagttcaacaaaatcattatataacaaatacatatgagaaattcttctttatggcttattctattgaattgcctattcatttttgccttcccagaatccacaattttcagcaagatgaatatgagcagaaataaaaatgccctttctatttaataccccctgctttcaattaaaagaaaactggttagtcatttagtatcttagaatatttcttacttataatgaattaggcattaattatattcttctatataaccaaaacaattttttagcaatggacaacactattattttctaattcatgttactttttttaagcatgcctttgggcattggatcactatcagcaatgtgcagagaatatcatcatcctttgaaaagctgtactactgatgtactttacagataaatagtaaaaatgtttaatgtacacctaaaacacaattgaaataaatgccatttcaggaatttgaaagtgtgttgaggttaccaagattatctgtgatccttttcaaacagcaataatttactcaaaaggctgtcatgtctgcttacaagactgtgcagatagttgacatagatgaaattagtattaatatattcattttaatttctacccatttactgtcttactaagggtaatttaactcagaaatgccgtcataatagggtgataatctgataatccggggtgcagtggaggcagggaagaaaggaagaaaaaaggaaaaacaatgacaataaatggcacaggcaagaagaaagcaataatgtaataattactaccatgttttgttcaattatcaccgaaaaatccagaaagatatgaaaggtgagcaaaggttctaccatgtttttgtaaagaaataaaagctcactgaaatattagggagaaatggaatcaaaagtaccaatgaaaaaagcaaaaataagataatttaaaaagaaattagaataagaaaaaactaggaaataacgttctttacatgtgaataatttctttttggttgagttgtaaatcacatatctgttattcaaaaatatttcctgattcatttgaaaagaaaacatattgaaaagggatctaaacaaaggttgtttttttttcccctctttaaatgttgctacctcaaacaagctgtaatctgagtattaaagtacaaaacacttaggaaatataattttccatgattactttgagcttcctgtaagtgtaacagtttttttactacagttttcctctctaaagacagaaatgcaccgtatgggcgcaaggatgctcatgccatagcctatgctcaaaagaggattcttagtctacattccagattcagctggagtctatattaactgcatccattcttttaatgttggccatcttgtatgggttggatgtcccaagaagccacttaactatgggtgtgattgtctattcaagaacctagaaaaaatggtaaactggttacataacaaataacacatcttgatctaagttgagaggactggagtcttctagctatattatttgaaaaaatgcaatcatgatttagtgacaaattgaatagcaacttcattaaccagaatttgactgtaaacccatgcaccgtcctagccagtatctcttttctccggaagagaggcatgggaggaggggagagaaaaaggtgagctatactactttagagtcttatgctagttctgtgaggtaaatgtaactactatttcctttatttaacaaacaaaaaatgaggctcaaaaatttaaacaacttgtgccaaagtcacagaggtaagaaatactagggcaggaattgctcccatgtctgtgtacctttaaaattcactttgcagctgcacagctgataagtctgctcagaagatttaaattataagaggaaaaaatgccttgcatccctggcactgtgcctagttctttccccaaactgaaaatgatacttgcaattttttgagccctcaccatgtatctggatcatttcaattaatcttgacaatgctggtcaagggactattattagtctcattttgaagatgaagcttagagaggtaaaataacttgccccatatcctacagctggtgggagacagagatggcattctcaccagctctctctaaactccaaagcctgtgctcttcccatttattccattctgctttctctccaggagtcttcataataactctgagttcagcagctgttttcaatgaggatataggctcaaagcaaatacaacataaccggtacatggttagatttctaagcctcttgccattccgccttgtggacaaggacatcaaatacaatgaaaaatgggtgccccgcaaatcaatacatctgttctttaatacctgtgatcacagctgtgaaataggcttaatacacagcctgaaaatattgttgtgaaaataactgtgtgtttggctgttaagtaaagttcagctggacacatgatctagtaagaggtgctaggctgctgcatgcaaaggaattccattagaaaagacagagaggtatgggaggaaaccgagcacaaagcagtgtgtccattgatgagagaagtcactcccacttcgcccacagatggtggcattaataaagatatcttgtacaatccaatgatgtgaatctcaatcttcagcatggataagaatcactggggagcttgttaagaatacagttttagtgtcatctcacctaagattctgattcaattaagtctggggtggtgcccaggaacctgaattttataaacatcccagctggttttttaattattattactattggtttctactttattctaggtttagtggttacacatacaggcttgttacatgggcaaattgcgtgtcactaaggcttgatgtatgaatgagcccatcaccaaggtagtgagcatagtacataacaggtagccttccaatccatgcccccccaccaccctccccaatgaagcagtctccagagtctttgttcctatctttgtgtccatttatattcaatgttgagcttccaattataagcgaaaacatgtggaatgtggttgtctgttcctgcactagtttgcttaggataatgacctccagctacatttcatgttgctgcaaagaacatgatttcattcttttttatggctgtgcagtattccgtggtctatatgtaccacaatttctttatctggtccactgtcaatgggcatcttggttgatgccatgtctttgctattgtgaatagcattgtgatgaacatatgagtgcatgcatctttttggtagaatgatttattttcctttgggtgtatacccaatagtggaattgttgggccaaatgatagttctgtttcaagttctttgagaaatctccacactgctttccacagtggctgaactaacttatattcctaccagcagtgtataagcgttcccttttctctgcagcttaaacagcatctgttgtttcttaactttttaataatagctattctgactgatgtgagatagtatctcatagtttgaaatttaatttctctagtgattagtcataatgaacattttttcacgtatttgttggccacatgtatgtctttttttgagaagtgtctcttcttgtcctttgcccacttttaaatgcaattaatatatttttgcttactgatttaagttccttacagattctggataataggcctttgtcagatgcacagtttgctaatattttctcccattcagaaggttgtctgtttattctattgatagtttcttttattgtgcaaaagctctttaagttaattaggtccttcttgtcaatttttgtttttgttgcaattacttttgggaacttagtcataaattctttgcaaaggcccatgtccagaatggtatttcctaagttttcttctagggtttttattgttttagttctacttttaagtttttaacccatcttgagttaatttgggtatatggtgaaaggaaggggttcagtttcaatcttttgcatatggctagccagtgatcccagcaccatttattgactagagggtcccttccccattgcttgttatcgtcaactctgctaaaggacaggtggttgtaggtttgtggctttatctcagggttctctaacctgttctatcagtctgcctgtttttgtacctgaatcatgctgttttggttactgcagccttgtagtatagttttaagtcaggtagtgtaacgcctctggctttgttctttttgcttaggcttgctttggtgattcagtcttttctttgattccatatgaattttagaataactttttctaattctgtgaaaaatgtattggtactttgataggaatagcatctaatatgtaagttgcttttggcagtatggtcactttaacaattctgattcttcctatccatggaataggaagaatatttttccatgtgtttgcattgtctctgatttctctcagcattgttttgtaattctctttgcaaggttctttaaggtccttagtaagctgtattcctaggtattttattctttttgtagcttttgtaagtgacactgtgttcataatttcgttctgagcttggacattattggtgtatagaaatgctactgatttttactcatagattttatactctgaaactttactaaggtcatttatcagttctagaagccttctggcagaatctatggggttttctaagcagagtcatgttgtcttccaagagtgagttagacttcctctctatttggatgccttttatttctttgtcttacctgattactttggctaggatctcctttactatattgaataggaatggtgagtgtgggcatccttgtcttatttcacttctcaaggggaatgcttccagctttcacctaattgctatgatgttggctatgggtttgtcataaatagctcttaaaatttagagatatgttctattgatgcctaatttcttgagggttttcagcacgaaggaatgttcaactgtatcaaaggctatttctttgcctattgagataatgatgtggtttttgttggtaattctatttatatggtgaatcacatgtattgatttgcctatgttaaaccaacattgcatcccaggaataaaccctacttgatcaccgtaaattaactttttgatgtgctgttagattcagtttactagtacttcattgagaaaattttgcatctctgttcattggggatattggcctgatatttttctttctttttttttttttgtttgttgttgttgttgtgtctctgtcacattttggtatcagaatgatgctggcttcaaagaataagctagagaatcccttctcaaattttggaataatttcagtaggattagtactagctgttttttgtatgtctggtagaattcagctgtgaatccatctgctctaggcctttttttttttttggttggtaggctttttattactgattcaatttcagaactgattattggtctgttcaggattttaatttcttcccagttcttgggagggtgaatttccaggaatttatcaatttctttcagtttttctagtttgtgtgcatacagctgttcataatagtctctgaggattttttgtatttctttgagatcacctgtaaagtcacgtttttcatttctgattgtatttatttggttcttctccttttattaatctagttattaatttattatttccctaaatagtcacaaacctaatttgtcaagttatagctcagttgcattacaaaagaagttcttacatcaagtattacagaagaatcagtagtatttgcttgggcagtacatgccatcagattatgaatggattataaatgcaaactgacgtgtgacttttaaaataccatgatctatccaatttgaaagagaccattaaagtggagatttcaactcctaccactataactctaaagtatgatctttactttggcagaatattacagacttagaggtattgtttttatcacttggttttgtttttatccatagcaaagccttcaataatatttcaggccacagagaaaataatacaagtttttgcattgttgatacttcaaccaagatagtcattcttttaatgtaggtctgctggtgtcaaattattttattgttccttcatctccgagaatttcttgatttctcctttatttctgaagagtatttattactggatataggatcctgagttgacaaaattttttctttcagcacttcaaaactattgtaatttttgctggcttccctggtttccgatgagagatccagtgtcatctgaacgttcttttttccacagagaatgtgatatttatttctgactgctttaaacatttgtctttaattttcagaagtttgtctatggtgtgatttcatgtggatttctttgggcttatcatgtttggggtttgcattatagtcccatacatttctgaggttgtgttttgtttttgttttctttaaagtctattttgtccctgttgtttacattgtgtaatttctatttgtattatttttcaatggactggttcttttctctgtctcctctgttcagctattgagcccatatgttgactttttaaattattattttattggttaatatttttagttctaacatttctatttcattcttctttgatttctttgctgtaacattctatttttttattctcctttggtgacattcttcccctttgcttatttttatttttaatttttatggctacataattgtacatattaatggggtacatgtgctatcttgatatgagcatacaatgtataataaaatctaggtaatttgaatatcgattatctcaaacatttatcatttctttgtgttgggaacattccaaatcttctcttcaaccaattttgaaataggtgatattttttcatttgttcaaggatgtttatgattgttcattcatttttatgatggctactttgaaatctttgtaagataattctaacatcgctgtcatctattaaatgtatttttttattcagcttgagatcttcctggttcttgatatgacaagtgatgtttgaatgagatggagacattttggttattatgttaaaagactatggatcatatttaaaattctggatcacatttctgctttagttggcttcttctgaaactgctttggcagaggaagaagagggttgcctcattactgcctggtgagggtaatctttaggggtaaaagtggttctcagttacatggatgaattgtataatggtgaagtctaggatattagtgcatgcattatctgaatagtgcatattgtactcaataggtagtttttcatttttaccccctcaccccttttaagtcttcgatgtctattataccacttggtatgcctttgcatacccatagcttagctcccacttataagagagaaccttcagtatctcgttttcaattcctgagttacttcacttagaataatggcctctagttccaaccaagttgccacaaaatacattattccattctttttatggctgagtagtattccatgataacatacatcacattttctttatccactcatcagttaatggacatttaggttgactgcatatctttgcaattgtgaattgtgctgcaataaacatatgcacacaggcatctctttgatatattcattccttttcttttgggtagatacccagtagtgagattcctggatcaaatggtagatctacttttagctttgagaaatctccatactcttttccatagaggttgtactaatgtgtatttccaccagcagcatataagtgttcctctttcaccacgtccacccgagcatcttttggggatttttttttttgactttttaataatggttattctggctcgggtaaggtggtatacattgtggttttaatttgcatttccttgacaattagtgatgttgagcatttattcatatgtttttgaccatttgtatattttttgagaaatatctattcatgtcttttgtccacatttcagtttttaagttgtctgtttactgtaatgattatttattttgctgtgaagaagctttttagtttgagtcctattcattatttttgttttgttggatttgcttttaggggtcttagttataaattatttgcctatgctggtgtccagaagagtttttcctaggtactcttctagatcttttatggtttcaggtcttagcttcaggtctttaggtctttagtcaaggtaaagttaatttttgtatctagtgagagacagagatccactgtctttcttctacatgtgactatgcaatttttctagcaccctttattgaacagaatgtcctttccccgatttatgtttttgtatgttttatcaaagatcagttggttttaagtatttggctttatttctgagatctctattatattccattgatctacttttataccagtaccatgctgatttggttacgttagccttgtagtaaaatttcaagttaggtaatgtgatgcctccagatttgttcttttcgtttaggttgctttgactatttgggctattttttggttccatgtgaattttaggattgatttttctaattctgtaaaaaatagtgttggtaatttgatagaaattgcattgaatctgtagattgctttggagtgtatggtcattttcatgatattgattgttctaacccatgagcaaagaatgtatttccatttgcttttgtcatctacaatttctttcagccgtgttttatttttcttgtagagatactacacctccttggttaagtatgttctagcatattttatctttttgtagctactgtaaaagggattgagttttttatttgattttcagcttggttgttgttgatgtatagcagtgatactgatttatgcacactggttttgtaatgagattttgctgaattcatttatcagatctaggagtcttttggaagaatccttagggctttctagatataagattatatcattggcaaacaaagataatttgactccatgttttacaaatcgaatgccctttatttatttctcttgtctgattgctctggctaggattccctgtactatgttgaatagaagggataaaagtcagcatccttgtcttatttcagttaataggggaaatactttgaactttttctcattcagtatgatgttggctatgggtttggaatatacagctttaattatttagaggtatgtttcttctatgtctagtttgttgagggtttttatcataaagtcatgctggattttattgaatgctttttctgcatctatagaaatgatcatatatttatttaaaaaaattctgtttatctgatgaatcacatttattcccttgaatttgttaaaccatctctgcatccctaaagtgaaatccatgtgaatatagtggattatttttttgatgcgctgttggatttggtttgctactattttgttgagcatttttgcatctatattcatcagagatttggtctgtagttttctcttttttgttaagtctttcctttgctttggtaccagggtgatactgggcttgtagaatgtattagggaggattctcttcttctcaatcttttggaatagattcaatcgaattagtaccaattctttggatgtctggtagaatttggctgtgaattcatttggccttggactgtttttgtttgtttgcagtgttttggtttttgttgttgttgttgttgttgttgttgttgtttttctaaattactgattaaatctcactgcttcttattggcctcttcaggatttctagttcttcctgattcaagctagcgggggttgtatgtttccaggaattaattcatttcctctaaattttctagtttgtgtgcatagagctcttcacagtagtcccaaataatcttttgtatatctgtagtatcagttgtaatatctccattttcatttataattagtcttatttggatcttctctcttcttgtcttggttttaatctacctagtgttctaacaattttatctttttgaaggagctattttttgtttcattggtcctttggattttttttgtttcaattttatttagctctgctctgatctttattattccttttcttctgctagctttaggtatgtttttttcttatttctctggttccttcagatgtattgttaggctgtcaatttgtgatctttcagaattattgatgttggcattttgcactataaactttcctcttagctttgcttttgctgtatcccagaggttttgataacttgtgtcactgttgttattcatttcaaaaattttttaaatttccaccttaatgtcattgttaacccaaaaatcattcaggagtagattgtttaatttctatgtatttgcatagttttgagggttccttttggaatcgattcctagttttattttaccgtggtctgacaagaaacttaatatgattttgatttttaaaaatttattgaacttatttagtgacctatcatataatctatcttggagaatcttccatgtgctgatgagaagaatgtatattctgtagttcttgggtagaatgttctgtaaatatctgttaggctcattttttctagactgaaatttaagtctagtgtttctttgttgactttctgctttgatgatctctctagtgctgttagaggagtgttgatgactcccactattattgtgttactatgtattttcttttttagacctggtaggaattgccttatgaatctgtgagctctagagttcggtgcatataaatttagacatgttatatcttcttgttgaatttatcctattttaattacataatgaccttctttgtccttttttaatattgttgctctaaagtctattttatttgttttaagaatagctactcctgcttgcttttggtttccatttgcaagaaatgtcttttttcaccccattagcttgaatctataagaatctttacatgtgaggtatgtcttctgaagatagcaggtatctatttggcttgcaaatttttaaaatccattctgtcagtgtgcatctttttaaagtggagcatttagaccagttacattaaacattgagatgtgaggtgctgttctagtcatcatattgattgttacttagtgactttgttttcttcatattgttattgttttataagccctgtgaattttatgctttcaggagtatttattctggtgagtaacaacaacttgtttcaagatttagtattctatttagcacttctcatagagctggtttagtattgacaaattccttcaccatttacttgtctgagaaaaactatttctcctttatctatgaaagagttttgctggacacaaaattcttgaccaacagtcattctgttcaggagactaaagataggaccccaattccatctggcttataaggtttctgctgagaagtctgcagttagtttgattggttttctgttataggttacctgatgcttttattttactgctcttagaattttttccttcatgttgactttagatagcctgatgagtatatgccttagtgatgttttgtttttgcaatgagtctctcaggagttctttgaccttcttatatttggatatctatgtcactagcaagtccagggaagttttcctccctggaaattttcctcaaatagacttttgaaatttttgctacgtttttctccctcaggaatatctacaattcttatgtttggccattttatataatccacatatttcttgagactttccttcttcttttaattcttttttgtttacttttgctgtgctgattgggttaatttgaaagccttgtttttgagttctgaaattctttcttctgcttggtctaatctattttaaaagcttttcactgcattttgtagttgccgaaatgtgtagtctttcatagaagttctgattggctttcctttaaaatatccatctctttagaaaagttttcattcatgtcctgaattaaaaaaaattatgttggttttcaactttatgttaacttaataatcaacttttttgaattatttatctggtattttatgttggttttcaactttctcttatgtctccttgattaacataataatcaactttttgaactctttatctggtatttcaaagatttcatcttgatttggatccactgctggagagtcagtgtgattgatttttttgagttgtcatagaacaactcaaatgttttttatgtttccagaattgtttttatggttccttctcatttgtgtaggctatttcttctaattattttaaaattagtttttgattcaattgggtttaaaaaaattttcctccttgaagatgtgactttaacatttatagtttatttacacttagtttcagctctgggtggtttcaagtggcaaagactgtatgagtttcttggttatagagaatcattgtgaagtgtctttctcagatgccggttgtagtggcagtgggctgggtgtgtgagtaggttcactgtctcctaaggggctggaatggcagaggtctcatgaagcttattttgttccccagtggtgtgcacctttaaaagtttttcttccagcattttattcaacgggttgagtagttcaggcttcaggccagtaggaggtgcccacagataaacacaggttgtggctaaagcgggtgggtaaatgtaatatccaacgattggatgaagtcccagctttgacagaggcagctggcaaagctctccgtgaaatacactgaggtcttttcatggggaagtgaaggagccaccccagctctccttccaggcaaagcaggaaagcaatccacctcccagtcacactgctgacctggtgttctagcttttcagatcaaacaggtatctctttctatctgcaagaatgctgatgttccctctaaagaagggttgtagctctacctcttgtgtaagtctgaacctgtatggcacacttcctgtggatagttaccttggagtgttccagaaagtctgtctacagatgcatccatgctgagctcccatgagagaagccccagctctctgcagtgttgggtgaggggaaaaagaaatcaccttctcaaacctttcatgagcgctgtttgactgttggggtagagctgcagactttccccactgagcccagcactgcacttgtgtctctcccgaaagaaacttctcacaagtgggaagttaagggactcaaggcccatggtctgctttcttttataccatgggatgctcccttaatgtggttcactactctttccccaaaaaatagtagtccctgaaagccaggctattctgaattctactgctcctctaggtctagctgtccagtggggctgccacagttcaggctgtactggagaatatctgcaagggatccagtgatgtgaactgtcctctagtttcccagcaccaggtgccagcattacctctgatgggggtgggtggggagtgacacagactctgagattttcttggttataaatagctttagtgttttggttttctcaaatgccagctgtagtagtagtgtattgggcacatagacagactcaagacgtcctatttagctaaggtaatactggcaatggcaatagctgaggttgcataaaagtttttggcttcctgagtgctgggttattgtttatgcagatgttttaatgggctgtgccggttggcctccagccagtaggtcatggcttgtagaaaagcaccagctgtggaggtagtggtagaatttgtgcttgctttatgtcactcaggggaggtattcctgtgtctcaggtaggtaatgggtagggccatggagctcccaaacatccctgtatattgcactgtgctaccagggcaggtggaggggcaaagctgggtatgggctaggtcaggcaactccttgctctggctcctcacatgcaggcacaagcagcggccccagtgaggatcataagtcaattccttggctactggggtaatatttcagggagtagcacagctgcctctgttgcacagaagaatccgcatgggatgcaggggttagcaagcagcagtaagccccactcagctcccatgcacttggcaaggcatgtatcccactcataatgttcgctaaaagcagcaggctgggttccaggtagtctgtacgtagaactaaaaactgccccaggccataagccgtcccagtggagaccagtgaaaccacagctttcaggccgcaccccttctggtctacctgtgaagcaggagtgcccagctcctgcgcccatggctatagcaaacttactacttgcccctcatttctggccaacagggtttatcctcactcaaggttataatctcatatctcagatgggagcttctctcaacctgtgactgcagcttgagttagctggtagacttctgtgaggtcccctgtgaggtaggatcaggaatggcttccctctgtccttgctggagtgtgaaagtgcaggcaatgtgcatcctgataccgcttcttctcaccccatcactcgctaaatcagctccagcactgggtagtgttaagatctgcctccatggcctgaattgcccggctctccggtgggagtgtgtgtcacggtggcagtctctccccctctcacacactctggagactcacagttttccatctggttcacagtgtaggctgctgtttcttctttcaaagggtctgtagtttctttcagtttttctgttaagttcctgtgttgcttcttagaaagaagtgcacattgtgaatctctgcacactattttgtctttccaagtgggagaggcaggctaacaatgcctccaaaccactgggccattttaaataacacataggccagattttcagttaacacaattcttaaaacacctgcaacttagcatgcttctatttgacatcatttgggggtctgttacattatttgagaagtctgctgttagtctgataggttttcctttataggctagggtatgcatttgaagactagttagcatatccactctatttcatttatctaattatcccatcactctcataatccaaaagtcagacacgaagaaaaggaagaataccagcatatttggatgggaataaaagacaagaaatttcttgagcatcaatattaggtgcatgaaatcttgggtaatctaaggtacaaagtaggagttggacttttgaggatggacaaggcaaaaattcattacaattgaacctaattataaggatattgccaagatattgctagtgggagtacagtggagataaaagaaggtctctgtgtctgaagccaacatcagttaaagtgcctttggttataaaaacccaaaatttaactcaaacagactagtaattaaatacatttgttaactcaggtaacagaaaaattctagttttgtttcttaagtaaggatagatctgacagctcaacaatgtcatttaaaatgtatcttgtttttcttttcccttgatttacattgtgctttctgagtttcactttgtcctgaagttggtttcctttatagttataagagggcttccagtgattcttaggtttataagggtcattggtcacatcacatccagagagagggggatcaaggagaagatggggataaatagaggagaggggaagcagaaaaaagaaagagggatgaaaggggtgggaagttccctagctagataatgaaattcttctatttcactttgattgtggcaatatatatccatgcccaataagggagttggtttgggttaatcagtacctgcccctaccccatgaaactgagaaagtgaaatagacatgagaaaaaccaatagtgttttctacattaacattttctctttactataaacacccatggttgttcctctacatatcattgtgcatcaacatcaaggagcttcccctcccttgggttagaaaaccagtgcacatatttgactgggtttaactcatcagtgataaaagcacctattcctttttacaattttcaagagtggaatatacagtcttaagaaatggcatacaagttgagatgttgtcatattaacagaaataatggcagctgtttaatctgttctaaaacatatgatttaacatgctttgactcatcatttgtttccattgctttttcccttagataagatcacttaaaaacagtgttaatcagataaaaggaaggaccatcccacacatttcaatgggaaaaaagccagtgggctcagtgtactgtgatatatgaattgtttttgtgattcccatcataaacgctgccttaactgtgttatttttttaactataaagtagaaaaaaataaattactttgctcttaaggagtataaagaaatattgaaaggagtaagattttttgaaaaaaagtttggtagcctaaaatatgtttagataatattgaagtttgtgaactgctaattcaatggtattgtttcaatcaaattataatgtaaaatatctgttatgtgtttaaagtatgttttacaggtataaactaagttgaaggcttcccaaaatagaatattaaatctagaaggaatattagacatctagtccaaatctacccacttacaaaggagggactgaagaatctgagagtttaaggttcaagtgacttgcttaaagccacatcattaattagtgaaagaagactagagcacccatttccagactggaagcccactgctctttcttggtttgacatacatgaaatatgaaatcacccgtaccagacaactggatactggcaaaatacatgttacatatttcattttgagacaaaagtgaaattcagattatcctaccatttatcaaagtgtataattaaagcaacatacatccatctagatacaaatctgattatgattcggttaaaacagtctaaaaagtgaattaggaaaatatacaacaatgagaaaaatgaggaccatgaatcagaaagccagctttacatttgattcagtgagggtaatttcatttattaaaattgctatggcatttatattttaacatagtcatgtaacatgtgaggataatgttaaaaatagttatagtttgccttatttctagagggagaaaaaatacttttcagtagttctaaagagggagaaaaaacagtattagaaaaattataattataaaggccataaaatatcttcctaactgataatgcatttgattaatagagggagaaaaatggcttatatatgtgcagatataaaaagagatggcattgctaatatatctaaggcatcaaagttgtttgtggaatctataaacacagggacttagtttttcacacagagtacaatttaatacggtttactgagtgggagtggttttaaatgataattattttcctgtcttctcttattaagaaaatcaaaacaacagttttgtcccattttgctgacactggtttctgtagtgtgatttctattgaagcgggaaagaacagaacatcatctgtatcattttaagaacttgagttgtctcctagaattgtttataattgcccttgcaaaagagagcagcctcagcaggttggaaaattaccaatcagtcaacaagtgtttattgaactccagctatgtgttcagaatagtactgagtggtatataaaacatatttttccccccttggggactttcagtggaaggaagattgttgggaatattatcaacgcacatggaataaagagcaattaagtaccttcataattaaatatggtctatcagtgcaattacatatcagaaggaaaagatatcattttgaataagagcagcctgaaggcaacatgagagagataataaaatctcaaaatcattaatgatggaaactgctttacttgatcactgttcttaaagcaacccattcatctgttggctgctctgactctagaagagatgctcttgacattgacctgaaacttacccctcttttacctccagctatccacccatctttagctaactctcagctgttccagccctttcctgtggtggaattttaatgcagcaataatattcccacatagtattctctctttatcctgtcagcaatgataatgatgccatcctgatattcatcatttttttgctctatactttgttaaaatccccttaaatataatattcagaaataatacaacactccaaataagcattggcgagttaataatacacaggaaaaaaatctttttcttgatctgaacactatatttctttaactacagaataagagtatgttagttttattgcccgtatataaccctatcagctcatattgagttttagcaagttttatttgacctctcccatgaattgcagtcaagcaaatttgtaaggacttataaatacaagcgatgaatttaattggaatgtagactttatagttattgctgttaaatgttccttgttgatttctgaatcattattctagcttggcaaaaaaaaaaaaatggtgactcatgactcaaccatccataacattagcttttcctcctgaatttacattaaccacaaatttaataaattagatatctggtttttcaacagacctatacaataatacttttcataggattgttgtgagaatacaaataaaataagatcatgaaaaaagtatttatcacagtttttaggaaacagaagttccataaatgtcagattattttcctttcttcaaaaaatatttgaaaaggacataagcaagttcagaatctccttcaggataaaatttacctacttaccaaaaccctttgtgtcaacctcctacaatgttccccaattgtactaacatccaacctccacttttccatcctggtcacaaatatataattgaagaccacattgataaaatgtatcattgtatcagaatgtatatgacagatagaatgcatatggggagtcaaaacatatagaattaaataaacataggccagtcctctacagagttataagcaaaagctgagacacagaaatataattggtaaatttaaaagatgaagggatggatatatgttagtgtgggttgaagaatggtaatttgtgctgggttttaaaacaataaaaggagatgggaattgatacagaaagcaatagcagccactggatgactttatgtcaaggtttggcagaaagaggtgggagacaccaaagtgtctgcacagggtaaatatattaggcatataagttagagaagactttcatggaggtaggaggtaagctactgtaataatagaggccagaagcaatgaaaatctagtttgaaataatggtaatgataaccgagtaaaagttgtgacttctgaattcacccattatggacaatgaagaagaaggcaaattcaataattttcagaatcatgccactaagaaatttataagacggaaaggaaagaacatttgagccatattatggaataaaacaaatttaatttttataattttcaatgtgtggggctttgaccattgcatcagcattatgtaagaatttattagaaaagccaattcataggatcttgcttagacatactgaattcaccaatactggtgtgttggtgatggtggcagggcagggtgagaacagaactaatctgtaacgttgaagatttctgacttttctgatttttgtactcccaccatggccagtttcaagtcactggtgacatagagttgtgaataaaagtgcacattctgctccccagactctctactaggccactcatgcacaccactggctccaggtgaatctgtagtttgcatcagaatcagctggatgatgatcaaaacacagttggaccacatcaccaaagtttctgtttctttagatctagggtagggcctcaatatttgcatttctaagtttccaggtgattttgatactcctggtctggggaccacactttgaatatcactactttaagtgtcccttaagccaccttatttagaaatttaattagcatacagagccgtaattgccaaagtcacattgaatcaaagtgtttttattacttctgtttgtgaccaaaatccaaaaaagcagtctcaagttctcatcatacttaaggtctcaagcaggaattgccataggttaaacatatccttcttgaaactatttccttagtgttccactatccacaatctcgtgattctctttttccttctttggctattcattctcagttgttttctgtagattactccttccctgatagctgaattttgaactaggcctcattgctttccttttctgatggctgaatcctccctctatgttatattatccctatcccatccaatggttttaaatatcaaaatgttaacaactccaagttttcctgcctaaagttcttctctgaacttcaaagtagaaatatctcttccacctgacacttccatttgggtatctgaaacaatactgaccaaacggaatttgtttctcccctgcacctcatgacatctcctcaaatctttcccagctcagtaaatggcaacactatccactgtgatgctctgacctggaaccccagagagtctacacctcatcttgcccttttagcacattctacatccactaattcctattaccactctttccaaaacattttctcaatgtgacaagtttcattgtttccacaaccaccacctttggttagtccactatgattctttcccagacaatttcaatagcttcctacttccatcttgtacccttataatccatttgtcatacagccatcatggatctgattaaattcttcctgttttactgcagtacccttagaatgaaatctccttccaaagcatagccctacatgacctggtccttgccctatcttccctattccctactcaagtctgcatctcttcattcaaacaggttgcagtcatcccatctggatgcttttgcatttgtttcttctgcctgaaaagctcttctcctagaattgtacacggttttttcctttatgctataaaactgtcaattcaaatgtcaccatctgtagcaaggcatttttgttttttgcacacagtccttttctatttcataatttatctgattttcctgatatggtagcatgtagtatggtaggcaacagtatggattataaagccagatcatctaagtatgaatcttaactcttgagcttctttctctaaattaggcaagttacaagaatcttttgtacttcactttccttatctttaaaaatgtatacataataatatctgccatataagtttattgtaaggattaaatgagttaatatataaaaattatttataactgcatctggcacatataagaactacatgcatgttagcaattattatccacaattatctcgtttgagtgatatcagcgagattgtggaactggagatcccagccctcaacccccagaagaaacaacaattttaacaaacacccatggtcaaaaatacctttatgtgagctcaagaatccagctaagattccactgttccagcatcacagtggaacgacaacaacaaccaaaatccaagaatagacgcattaaaaagcacaagaaaaacaatttcactttacctatctcaccaagtgccaagagagacccataaaagatgcatttagtttgaatgtagactttatagttattgctgttaaatattccttgttgattgattgatcttatttattattattattattattattattatttgagacagagtcctgctctgtcacccaggctggagtgcagtggcgcgttcttggctcactgcagcctctacctcccgggttccagcaattctcctgcctcagcctcctgggtattacaggcgcatgccaccacatccagctaatttttgtatttttagtagaaacggggtttcaccatgttggccaggctggtctcaaactcctgacctcaggtgatctgcctgcctcagcctcccaaagtgctgggattataggcgtcagccaccgcacccagcctgttgatttattttttaaaagagacagtcttaatctgttgcccaggccagagggaagtagtaggatcatgtgtcactgcagcctcaaactcctgggctcaaatgatcctccccccttagcctcttgacaagatgggactacaggagtgcaccactgtacttagctaatttatttatttatttatttatttatttgtagagacgggtttcactgtgttgcacagactggtcttaaactcctggcctcaagtcatcctcctcaagtcatcctcgacttcccaaagtgctgaaattacagatgagagctaccatgcccagcctccttgttgacttttgactcatttttcaagtgcagcaagatatggtgactcaataactcaactgaccctcgtcctacaatttctctcatgaagaaaagtgggagcagcttccttccttccaaggagacccacttctgtctcatcccacccagaatactaaggggattagcaaaatgaaataatcttggggacactaggaacagggtaagggggtaggggccgtggcagcctgtatgaatatctcaacaactggccataaatcccactggctggttcatgatggtctccactaggatctctacccatgacccctgtggactcccccagctaactgatatgtattcccaggattccatgcccctcaactaaaatggttagagccctgctgtctactacatatggtaccctatgctcacccacagacaaaacattgagcctttgcaagacagcatgtgcaagctcccaaagatggcaagcaaataccagcagctggcttgactctgctggattgggaggagtcatactatattaaacaattcaggacactgtcttaaggaaaataagtgagagtctcttagcaacaagcctggctttgcatgatcaagagaatatacaaaatctaaatacttacctctttgaagagaaaagagaaatagagtgggtgcctctacatacaaaaaggtctgaaagacccccaaaatctccaacggggctgactggtcaaggtttttctttcctaatatcagacagtaaacactgaaggagatgactccttcttcaaatgtgaagacaccatcaaacagcttcaagaaacacaaagagtcaaagaaacgcaacaccaccaaaggaacaaaataaagttccagtgactaatcccaaggaaatagacatctaacaattgtctaacaaagaattcaaaataattgttttaaaaaagcacagtgaaccaccagagaacacagatagatacctaaataaaatcaagaaaacaatacatgaacaaaatgagaagttcaacaaaaagatggaaacatattaataaaaaagaacaagacaaattcagcagaagaataaaattaatgaaatgaaaaaatataatagtaagcttcaatagcagactcaagcagaaaaaagaaccagtgaattcaaagacagaccatttaaaattctccagtcacagaaataaaggaaaaagaatgaagaaagcctatgggaattatgggattccatcaagcaaactaatagctgcattatgggagccctataagcagcagagaaaaaggcagaaagcatatttaaagaaatcataacagaagtctttccaatctggggagtaaaatgaacaccagatctatgaagcccaaaggattcataaaaaagccttcactgggacacattataatcatattattcagtgggacacattataatcatattattaaaattgaatgacacccatgtctgtaatctcagcactttggtaggctgaggcaggaggatcacttgagcccaggagttaaaggtcagcctggtcaacatggcattttatttcatacatatatatatatatatatatatatatatatatatatatatatatttattaaaaattttaaaaataacaaataaataataaaaatcagttacaagaaactctgaacacagaaagagaaaaacaacttgtcacatacaaaggaaccctcatgagattatcagttggtttttgtgcagaaaacttgcaggcacaggagagtgcggatgatatactccaggtactgaaagacaaaaaaatctgtcaatcaatgatactttacttggaaaagctgtccttccaagaaataaaagataaagacttttccagaaaagcaaaatctgagaaacttcaccaccattagacctaccttacaagaaatgggagttatttaatattttatttgaaacaaaagaaggttaattagcaacattaaatatatgaaagtattaaacactattacaccgctattagacaccgttagaaaagaaaatcagaggccaatatccctgataaatgtagatgcaaaaatcctcaaaaattactagcaaaccaaatttaatagcacattaaaaggaacattcaacatgaagaagtgggatttatcccaggaattcaagaatacataaatctgtaaatgtaatatatcacatttacaaaatgaaggacaaaaaaaataacatctcaatagatgaagaaaaaagcatttgataatatttgacattcttttttgataaaaactctcgacaaactaggtatagaaggaatatacctcaacacagtaaagtccatttatgacaaatccacagctaacatcacactcaatgatgaaaatttgaaagcttttactctaagatcaggaataagacaaggatgcccattctcatcagttctatccaacattgtactggaagtcttacccagagcaattagacaaaggaaagaaataattggcatccaaattggaaatgaggaagtcaaattgttcttgtttgtagacaacatggtcttatatatagaaaaccagaaaaactccaccaaaaactgttagaactaataggcaaattcagtaaagttgcaggattcagaacatatgaagaatcagttgagtatctatacactaatgatgaactacaaatcaagagaataattatatttacaatagctacataaagaacaaaatacttaggaataaatctaactggaaagatgaaagacctggatactaaaaactagaaaaaattgatgaaagaaatttaagaagatataaagaaatggaaagatatctgtgttcaatgattggaagaattaatattgttgaaatatttgtactatcctaagtgatctataaattcactgcaatctttatcagaatcccagtggcattttttacagaaagagaaaaaaactgtaagtcatatggaaccacaaaatacaccaaataaccaaagcaattttcagcaagaagaacaaatctagaggcatcacactccctgattttgaaattatatcacaaaggtatagtaatcaaaacaatatggtactggcataaaaacagacacatagaccaatggaatagattagagaccccagaaataaacccttgcatatacacatttgttataaaagcttgagaaagctacaaagaactgcaacaaatgactgaaatcatacttttgttcaggctttcaaatatttgcctttgaattccatgatttctaggcagcatctggcagaaactgaaataatgattattatttattgacagttgacagtatattccactcagagaggcaaagacttcaatggaaagatagctgtcaactctttattaacatccacaaagcttggttcataggcacaggccataaacttaagtattcgcttaagagaaaaaccatgaattatttctggaatgctgacagacagttttgcagtcatggctgtactattcccttcaatttttggcccatttctcctaggctgcccccatgctagagtttgcttttctatcccagaactcctatactttggattacccatgaaatatttcttgttacacaacaatacattctgaaaaaatacagtaacaccatataagcctctgaaaactcattacaggtgtttttcttttcttcttctactttttttttaattgggtgggaatgagtgacctcaaagtgtcttaggaaatgagttccagtgtttgctttaagtccttcaaaagaaactgcaccataagcaaagaaactgttcaccacagttccttccagacttacaccatgccagtccacatattaagtaactctctggcctccacttaccaccaacataattcaaatatcttcaacatcaccaccaaaaatattcaatagcacctatatgtgagacagagtaagtgtacattctcttaggtcactatgttacctagagctaaagtctttgggaaatgttcacttcttattcaattattcatttttagctaataacttgccagattagaaaaatgacttaagatagtacaaagtcattgttgatatggaaataaataataaaaaacaaagtagacaaaagaagcatatttaacaaccaggctaacacagttgctgagatagaacctcaaatttatgttgaactcacctataataacaacctaaagaggaacacattaagttatataatttatttaatgattaaagatccgatattcagaaaaatggtttttcatgatagtaaattatttaaaaattaggtatattgccctggatcctaagcagaaagttttaatacaaaatattattttaaagaaaataagaacatataccttgaaataatgtaatttttaaaattcagtcaaattgttttttccagtatcactcatgtgcgtgttcaagggaccatatattgctctaataccttgaaatatacacttttatacccaaacaccacccataaaaatcagccttttaatttttagtcaaaagctttgactactagatttttgaaaatattatgccaaaattgcataacacactgatccatcattttttacctgagggagttcctgttaagtaaataaggatgttaaatgatttggcaagaactgtattttaacttcctccccctctttgctgtgtaatcttacagaacccccaaaatctctcttggtatcaaatcttaccaagtatgatacagaaattgtaaagcctgttttaataataaagtgatacataaatgtcaagtaatattggcatcctttctaatggagctaaggccttcaattatgaaatagcaagccctaaatatatgacagtcaaaagcattgcagacttaaatgttgaaaagtaagattcctgggatattttctttatcacgtcttttacagcaaggggtagtagaaaagtctatgttctttggagaattacacaattatgagtaaattaaactctgatgaaataattctaaaaccaagaaaattattagtgttcaaatcctaaagcatttttttttgttctttaactttggagtagtcacctaaaatctctgaatttcttcttctttataatagaatgagcccagtaatgtgtatgtcacaataccattgcaagaattaaatatggtagctctaggaaagtacctgccagatctcagatgcatgagaagaggtcatcttttcctttataaactttcttaccaaacgcacaaccatagcatgcccagaaggtatctacatgttcaaaagcagattcatgactttaatttagcattcaacgagcagaaattgagaaattgaaaaaaaagtagtttattttgtgagatatctaactcatgttgccctccattaggcaaaaagtagaattttattgtgctataagtacagttattttatttctgcataagcatgacagagattaaagttatttttaaaataataaactatgcaatatcatattgatagcttgctaattactagaaacaacatttgactctcaagttctccaaaaccagttcattctttctatggagcaattaccttatagcttctggatctcaatgtagttctgtttcagctccctagaccaagtttctgcacactgtctgttatactaaccatctgtaatgggaggactgcttagactgttttaaattacccttgtcacattctccttgggtaatccaaaatgacaaatcttattttacagaatattgctaacaaacgcagccttagaacagaaaaaaatagaaagtataggatgaaaaaataatgactattggtgtacatataatagacttagtgacattcatgcttaagtctgtttcattgctttttaacactacctttcccagatcgtcgccccaaccagcttatatactccaagaaatctggagtgaactgccagtcctaaacttttaggttcagtgtagatatgaaattagaatactctcttcttgaaaagaaatacagaaaacctctctaaatctaaattaggatgtaggggacactagcattgtcagttatgacacataaaatgagagtgcagagactttcagttatagaactacaatttgtaatcttgattgtagtacaaggaagaggatgaatgattgcttagatttgtataaggtcttttggttggaaaacttgtcatgactgggtatagaagttcttaggatctatgggcatgggtaattttcatattaaccctcaagacaaggttctgggaagaaatagtcagacattctccatttggttaaacatcctactacaaatgacatttcatttcagcctcacatttaaaatgacatttaaaaataatgttatgaacaaaatatttttcagcactaacattaccttctgaattacataaaagtatcttaagttttaaagctttttttaaaaaaactgtttatgtatttaaggttaatctaagtgtgaaccacctacaagtccaggatatcttatttacttactgattaataatcagtgaaagctcatactaatatttagctccacaagcttgagttcactatataaaaacatactttagaaaatgctgctagaattgcttaaaagcctactgcactatgtagattctgaagacaaaaggcaatattgaaaaattaccctgataccaacaccagagagactcaacaaaaaaaggaaaccgcagaccaatatatctgacacacatagatgcaaaaattttcaacaaaatattagcaaacaaaaatcaataatacattaaaaagatcattcaccatgaccaagtaggattcatcccagggatgcaagaatcttttaacatgtgcaaatcaaaaaatgtgatacagcatatcaacagaatcaaggacaaaaaccctatgatcctttcaatagatactgaaaaagcttttgataaaattccatatccctttatgataaaaatcttcaacaaattttgcatagaagaaatatacctcaacacaataaaggccatatgtgacaaacctatagcaatcatagtgaatggggaaaactctaagccttttcactaagacctggaacaagtctacgatgcccacttttgccaattttatccaacatagtactggaagttctagtcacggcaactaggcaaaagaaacaaagaaagggcatccaaattaaaaaggaagaaagtctaattatcctcgtttgtatatagcgtgattttatatttagaaaggcctattataccaaaaaattcttggaatagatcaataaatttagcaaagcttcaggatacaaaaccaagacacaaaaattaatagtgtgtctgcaaactaacagtgatcaatctgaaaataaaaaacaagaaagcagtaacatttacaatagctaaaaatatatatcacacataagaataaatttaatgaagaagtaaaaggtctttgcaaagaaaactgtaaaacactgatgaaataaattgaagaggacacaaaaaaatggaaacatattctatgctcatggatttgaagaattaatattgtcaaaatgtgtctactacctaaagtgatctacagattcagtagaatccttatcaaatattaatgatattcttcaggtaattacaaaaaaatcctaaaatgtgtatggacacaaaagactgaatagttaaagcaatcctcagtaaaaaatgcaaagctcgacatcatactacatggttttcaattgtactacaaagctatagtaactaaaacagtatggtactagcatgaaaaaaggcatatagaacaatggaacagaatagagaatacagaaataaacccacactattacagccaactgatttttgacaagagtgccaaaagcatacatcagggaaagacagtctctttaataaatggtgctgagaatattgtatattcatatgcagaagaataagagtagattcccatctttcaccatatacaaaaatcaaataaaattatattaaaaacataaacataagatctgaaactatgaagcttctagaagacaatatttggaaaacagtataggacactggtctgggcaaagatttttttaggtaagacctcaaaagcaaaggtgaaaaaagcaaaaatagaccaatgggatcatatcaagttaaaaaagctactgcatagcaaagaaaacaattaacaaagtaaagcgacaacctacagaatggcagaaaattatttaaaaactatccatccaacaagggattaataaccagaacatataaggaactcaagcagctcagtagcaaaaacaaagaacaaaaacaaaaacaaaaaatccaattaaaaaatgagcaataatccccatgctaacaccaccaccagtgtgactgcatgcacattcgccagcaggggccccccgttcccctgactcatgctgcctccaccgctgtggtgaatgtccgcatggaggcaggtacactgacacccattagcaccctgctgcagccgatgagcgtgcaccctgccatgctgtggctgccactgctgctgacatacgcggatgaagacagatcctgctgtcaccatactacgaaatgctttggctgacaccacccatcagagagtactgaccagcattctgggagtacctcggccccctagtgtagcagatttctaacctcaaagaaccaaagaacactctcaggtcaccatactactcccccagagttacagcacccagtacaggagctgagagctaagtgttcactccctaaagtcttccagaaacaaagccagttggcagaattcacttcatagcataatcaaaccctcagggtcatcaaataggataaaagcaaaaaaaaaaaaaaatccaaaggtcaacaacttcaatgactgaagaaacattagtccacaaagatgagaaacaaccaacacaagaactccaacaactcaaaaagccaaagtgccttttgtcctaaaaatgaccacatcacctctccagcaggggttctgaactgggctgagatggcggaaatgacagaagtagaattcagaatatggataggaacaaagatcattaagatgcaggagtacattgaagcctaatccaaggaagctaagaatcagaataaaacaacagaaacggacagacaaaatagccagtatagaaaagaatgtaagcaacatgatagagctaaaaaacacactacaagaatttcataatgccatcacaagcattaatcgtagaatagaccaagttgaggaaagaatctcagaggctgaagactagctttctaaaataagacagtcagaaaagaatagagaaaaaagaatgaaaaggaattaataaaacctaagataaatatgagattatgtaaagaaacaaaatctatgactcattggtgtccctgaaagagacagaaagagtataagcaacttggaaaacatatttcaggatatcatccatgagaacttctccaacctagctagagaggccaacattcaaattcaggaaatgcgaagaaccccagtaagatacttcacaagaagatcgctccaagacatacaatcatcagattcctcaaggtcaaaatgaaagaaaaaatgttaaagctgctagagagaaaggccaggtaacctacaaagggaagcccatcagactaacagtggacctttcagcagaaaccctacaagccagaagagactgggggccaatattcgacattcttatagaaaggaaatctcaacccagagtttcatatccagccaaactaagcttcataattgaggtagaaataagatccttttcacacaagcaaatactgatggaatgtgttgccaccagacctgccttacaagagcttctgaaggaagcactaaatgtggaaagactgttaccagccactacaaaaacacacttttaaatatacagaccagtgacactataaagcaaccacacaaacaagtttgcacgctaaccacctaacatcatgatgacaggatcgaatccacacataccaatactaaccttaaatgtaaatgggctaaatgccccaattaaacacagaggggcaagctgaataaagaaccaagactgatttcacatgcaatgacacccataggctcaaaataaaggaatggagaaaaatttaccaaataaatgcaaaacagaaaaaagggaggttgcaatcctaatttcagataaaacagactttaaaccaaagatcaaaaaagacaaagaaggacattatataacagtaaagggttaaatacaacaagaagacctcactatcctgaatatatatgcacccaacacagaggcgtccagattcacaaaagaaagttctctgagaccttcagaatcttaggctcccacacaataatactgggagacttcaatacctcactgacagtattagatcattgaggcagaaaattaacaaagattttcaggacctgaactcagcactggatcaaacggacctgagagacatctacagaactctccactaaaagcaagagagaatacattcttctcatcaccacatggcacataccctgaaataaatcatacaatcagacataacacactcctcagcaaatgcaaagtaactgaaatcataacaatcactctctcaaactacatcgcaatcaaattagaaatcaagcctaagaaattcactcaaaaccatataatccatggaaattcattacatgaataacctactcccaaatggcttttgggtaaataatgaaattaaggcagaaatcaacaagttctttgaaactaatgagaacaaagatacctcacgccagcatctctgggacacagctaagacagtattaagaggacaatttatagcactaaatgtccacatcaaaaagttagaaagatctcaagttaacaacctaacatcacaactaaaagaagtagggaaccaacagaaaaccaaacacaaagctagcagaagaaaagaaacaaatcaatccaaattagagctgaattgaaggagactgagacaccaaaaagcattcgaaagatcaacgaatccaggagttggttttttgaaaaaattaataagttagatagacatctagctagactatcaaagaagaaaggagagaacatccaaataaacacaattaaaaatgacaaaggggatattactgctgaccccacagaaatacaaataatcatcagaaaacactatgaccacctctacgcacataaactagcaaatataaaagatgtggataaattcctggacacagacaccctgccaagacagagccacgaaggaactgaatccatgaacagactaataatgagctctgaaattgaatcagtaataaatagcccaccaatcgaagaaaatgcaggatcagatggattaacgacctcattttaccagatgtccaaagaagagctggtatcattcctcctgaaactattccaaaatattgaggagaatggactccttctaactcattctatgaggctaccatcatcctgaaaccaaaaccaggcagagacaaccaaaaaaaaaaaaaaaaaaaaaaaagcaagaaagaaaagaaacttcaggccaatgtctttgatgaattttgaggtagaaatcctcaacaaaatacctgcaaactgaatccagcagcacatcaaaaagcaaatgcatgatgatcaaggaggcttcatgcctgggatgcaaggttgattcaaatcaatacatgtgatttatcatataagcaaattaaagacaaaaaccacatgattatctcaatagatgcagaaaaggctttcaataaaattcagtatcacttttatgtcaaacatgctcaataaactaggtattgagaaaacatacttcaaaataataacagtcatctatgacaaacacacagtcaacattaaactgaatgggcaaaagctggaagcacttccttgaaaaccagcacaagataaggatgctctgtctcaccattccttacctaacatagtattggaagtcctggccagagcaatcagggaagagaaataaataaagggcatgtaaacaggaagagggaaagttaagttattcctgtttgcagatgacatgatcctatatctagaaaatcccacagtctcagctcaaaaacttaagctaataaaaaaacttcagcaaagtctcaggatacaaaattaatgtacacaaatcactaccattcccatacatcaacaacagtcaagtcaagagccaaatcagaaatgcaatcccatccacaattgccacagaaagaataaaatatctgggaatacaggtaatcggggaggtgaaaggtctctacaataagaattacaaaacactgctcaaagaaatcagagatgacacaaacaaatggcgaaacgtcccatgctcatgaataggaagaatcaaaattcttaaaatgaccatactgcccaaagcaatttatagattcaatgctattcctattaaactaccaatgacactcttcacacaactataaaaaaaactattttaaaattcatatggaacaaaaagagcccgaatagccaagacaatcctatgtaaaaagagtaaagctggaggcaacatgctactagcttcaaactatgctacagcactacagtaaaaaaacagcacaccaaaataaaaacagagaccaatggaatagaatagagtatccagaaataaggctgcacacctgcaaccatctgatcttcaaaaaaaaactgacaaaaaacaagcaatgggaaaggattccctgttcaataaatggtgctgagataactggctagccatacgcagaaggttgaaactggaccccttccttacaccatacacaaaaattaattcaaaatggattaaacatttaaatgtaaaaccctaaccaataaaaaccctggaagacaacctaggcaataccatgttggacacaggaatgggcaaagatttcatgacaaagacactaaaagcaattacaacaaaagaaaaaattgacaattgggatataattaaactaaagagcttccgcacaacagaagaaacattcaacagagtgtaacagaaaacttacagaatgggagatacattctgcaaactatgcatctgacaaaggtctattatctttttttttctttttttgagacagagtctcactgtgtcgcccaggctggactgcagtggtgtgatctcagctcactgtaacctccacctctcaggttcaagtgatcctcccacctcagcctcccaagaagctgggaccacaggtatgtgccaccatgccaggctaaattttttttgtatttttagtagagatgaagtttcaccatttggccaggctgatcttgaactcctgacctcaagcaatctgccctcctcagcctcccaaagtgctgggattacagttgtcagccatcgcacccagccaaaggtctattatctagtatgtataagaaacttatacaagcttacaagaaaagaaaaagcaaccccattaaaaagtgggcaaggtacatgaacacttttctaaagaagacatacatgtggccaaaaaaatatgcaaaacgctcaacatcacctatcattagagaaatacaaatcaaaaccacaatcaaatgctatctcacaccagtcagaatggctattactaaaaagtcaaaaaataacagatgctagcaaggttgcagagaaaaaggaacttagacactgttggtgggagtgtaaattatttcaaccatgtggaaaacagcatggtgaatcctcaaagacctaaattcagaaataccatttgacccagcaatcctagtgctgggtatatatccaaaggaatataagtcattctatcataaagacacatgtatgtgtatgttcattgcagcactattcaccatagcaaagacaaggaatcaactcacatgtccatcaattggcagactgcataaagaaaatgtggtacatatacaccatggaatactctgcagccataaaaaagattgagatcatgtcctttgcagtaacatggatggagctggaggccattattcttagcaaactaacatggaacagaaagccaaatacttcatgttcttacttataagtggaagctaaatgaggaacacagatggacacatagagggaaacaatagacactggtgcctgctgaagagtagaggatgggaggaggaagaggattagggaaaataactaatgggtactaggcttaatacctgggtgacaaaataatctccaggaatagacttcatgtgtatcttttgaatagcctccagtttttgtgtaaaaatacccatgggggggctatgttcctggagcaatgcttcaggccccgtgacatgagcttaccctatgtaacaaacccgcacatgtacccctgaacttaaaagtttttttaaaaaggtcagatagtaactattttaggttaggtggatggtctctttccttgttgtatgaaagcaaccctagacaataaataaaggaactcacatggctgtgtttcaataacagtttatttagacatgttggggaaaaaaaagtcccaaagacctgaataaacatttctcaaaagaagacataagaatgttcaacataactagtcatcaaggaaattcaaatcaaaccccaatgagatacaatctcaggccagttagaatagctattattaaaaggacaaaaaataacactagcaaggatgtggagaaaggggaatgctcatacattgttggtgggaatataaagtcatacggtaaatatggaaaactgtatggaggtttctcaaaaaactaaaagtagaagtaccatatgatccagcaatcccaatgctggatatatagccccaaagaaaggaaatcaatatgttaaagaggtatctgtactcccatgtttattgcagcactgttcacaatagccaaaatccatattttgttaatgaacctaagtgttcattaacagatgaataaataaaaaaatgtggcatatgtgtgtgtatatacatgcacacatacaatggaatattattcagccacaaaaaaatgaaatcctgtcttttgcagcaatacagattgaactggaggtcactatgttaagtaaaataagctaggcacagaaagacaaatattgcatgttcttattcactaaaactgtggatctcatggaggtagaatggcggttaccagaggccggaaagagaataaggggcagtgaagagaagttggttaatgggtacaaaaatagttagatagaaaaagtaagttcaggtattagatagtacagtaggaaaattataattgacaataacttattatatgcttcaaatagctagaagtgaagaattgtagagtctccaacacaaaaaaggataaatatttgaggtgttggatattccaattaccctgatttgattattacatattgtttatgtatccaaatatcatatgtacccccaaaatatatataactatgatataccaattaataaacacacaaataaagaaaaaaataactgatagtaaaaagaatggtaggactttatggtaaaaagtctgcaaggtggagcttcccagtgattctcttttccacaattaggtttacttttcaatttaagggggaaaaaatctaggaatatagcttctggcccctgccctctcctcatttctcacaatgctgctgaaactattctttggttaagatgactgctcacttcctaatttccaaattgtcagtactcatccctctggacttcactggagtatctgtctttgctgatcactgtgctgaaatgctcccatttgctaggcttccagccacacttccctgactttcctcttactttgctcattgttctttttcaggttcctcttccttttctctcccagatgtgttttcttaaggttacgcctttgattcttttatttttattttgctctttagcaatctcatcccacatttatggttctaatcatcacatctatatgaatggtcaccataatctagtggtgacatctcaagttcttgtagttttattttctatcatctcaacctggatcttctggtagtaacttaaatatattcatttctgtcctaaagtgtccctttcttaattttgtttccaatttcttctaatataaccactattttcccaggtactaggctataaacctcaaattcattccctttcacctccatcatcacaatcatctaatttgttttcagtttctgatcaatttatattgtctatttgcaatttgtcccatcttaaaaattcttattcctacatctcttattcagatcctgacttctgcatgtaatattcaattatcttttagcaggtcatgcctctcccttttcccattcagttgacacagaattttcaaatcaatcttccgaaagcacagctgtgatgatgtcactctcctactcaaaacctgtagtacctgtagtaactaaaccaaatctatgaaactgatctaaaccccttcacttggcactaagggctacaacttacctttccacagactatgccctcccactggttcttaagtggggcaacatcactttactgggaggtttatggaaatgtgtgaaggcacttttggttattagaaagactggactgggggaggtggaagttgtgtcttagtgctgattctgagctttctggcctccccagaaaaggttgatccccaccactgtgactgtatcacacaacaaataattgttccacccaaaatccaagggtgcctcctgtaaagaaacaacgtggcttagacagactcaattgtttacttttttcaatttctattacatgtttttccatctccgttgcctagaatgcccttttcgtattttcccaaatgtgcaaatcttgcttctcctttaaggcccatggaaaatgacatttttctgtgggctctccctgtgtcccctgacatgaatccaattctcatgccatttccaccgattcctcccaaacaccacttcctttctatctggataataaattttcaattttgattataaacttaatgtcagcaaggctctacctttattttcctccgtgactagaagaacattgtacaggccagcacagatcctttatgttaatgtgcttaatatcacagcacacaccatgattataaatgaggctgtaaacactttggtttgtaattcattctgagattcttgccttggcctgcatgtgaaactatgctaattctaggctatgtactttaaagtcattatctaattttttaccccactttcccacttgagtttgatggccatgacttctcctccacaaattctgtttcttctgccaggacacaccacctccgattttccttctaataaaacttaggccttaaaattcttatttctcagaactgctccactgagtaccccctaaatccccactccctgcccctgcctcaccctagcttcatggatgctcccagtaggtggtccgtaagtatttgttgaatgaagagttccttggagtaggtggaagaaagtggctgtgtaattggaacaagatacagggcagtgataggacaaaggcacagacatttatttccagtcttagtagctgtgctcatagctgcacccacgcactctctccccacatagataccacaccatcactagaaagaaactggtactaaacttacatttgaaatcaccctagtcagtcttgaggatacaccactcaattattataagctttttaaaaataaaatcacctcatttaagtcttttttacattatgacgcgactgtttgtttccaaagtcttaagagcattttgtgccattccctgaagtgaaaagaaataaattaggcataaattataaaaggcctgatatggcttttacatgattcttaaagaatatggtcattttacattgaatatttgggtcctatattgtttagttgcaaacaaaacatccatcatcatcatcaacagtagatgaaagagaatatgtttgcttcccaaagcttgatacttagaaaattaagtgctttcagttcgcagatatgacaacttctctaccagaaaaacaaataaaaaacccatacaaataagcacatagctttccattttaaagagatagtctaatgctcttactgaagtgtgtgctaaatacatcataacttaatcagaacaagttgctgtttttacaaaatagtcctgtctatgcagagagagataatgccagtcacttcacatgacttgtacttcaacagacaaagtgtcatactgggactttttatcattttgattagaaattgggagtttctacactcccagaaaacaaagaaggaaggggaatagtaatggcttccagcatttacctgccaatgaatataatctgaaaaaggtcattgaggtataatcattcactcagcaaaaatgtactgagtacctactatgtgtcaagcattattcttaggatatatcagcggaacaaaaattcctatcctcatggagtttatggctttccatgctaaaatatgaatacaagtgatctccagtgcatgccctagcccaaatactttgttctttttatatttcacatgcttctctagggcaatcttgactttcttccctacttatcaacacactcaatatatatctcttttagaaattacagattttcagtaacaacttataaaaatattatctctttatacccaaccacatcactgaaaataaattaggtatctctggaagctgttttagccctgtcaggttattggatactacttggtgagagcaacagatagatataacaaagcaatactacatagtgactcaaactagaccgtgattggaaaacttgacttattttagaaccacatattttagaaccacatttctctcttgtgattttggaaaatctaagtacttaggagggtttgcctaattgaatgtgtattcaccacagggaaaataccctaggttttcatcatgatttttgttaattagtgaatcttatttatggaaagaacacttaagaggatctaattcttctacttctcaataatgaaattctctctccaatatttttgtcaaggtacaccctattttgcttttgtttaaacacttccagtaatgaggtgatagctcactatggcttaaaacaacttattctttttctgcctatcctttaaactatgggcccaggactcagcatgaaattcttgatgtggacattcctgtgccaagtatattgaaaatttccttctatttcacaagctaagtatcataaccattttattttatttttcatgtcatatgaataatgtgctagtgtcataacaaggtttgaaggaggcacgtatcacacgtgagcatgaaaatccaatgatcaaacttacactacaaaaagatcaattatttcaatgctataagtcagtccccatatcacgctactgacttatactgttaagtcacctaaattagtacttttaactttctggacttttcaggccacaaatatttttcaaagaagaaggagacacaggaaggagaaggaactgacatagggtgggtatatttttatttttttattagtaaagtaaaaaaatattttttattgattgataaataatttatttgttgccaaaaataaaaatgtaaaaaactattatctactttattatttcataaatcaaatatttctgataaatataaagtagtaaatataaaacctgagaatgaaaagttgaataaatttcactatatgaaaaaaagctaactacactgagctacttttgctatagaccatgaaaatgctttcatagatccaggtttgaaattcattgaacaagagagcaaatgtccctctcaactcctgatgacccatgtgcttttgatgtgcaatcgtttcactatatgctcgtgcaataggttgtatttaagctaaggccctgactttatatttgcccttatttaatttcagcttatgagttttcaaacattagaccattctacctttctcagttttgtgccttacacaaatataaaatgtttactttttcagtattcttccaagtcacttgttaaagtggagcaaggattaagccctatagatcgctttatccttccaccaggttgagtataactgttcacacacctgtagtactccagcaatcatccagatcacatttctctctttcataaaacagacagatccattagaggatctaaggattgggtttcaaaaggcttctagacccacttttcacccaagatttgtttgtgccccccacaaaataccttggtcaactagtcactctccttgtgttaaatgtctgcagtgttgagaaactccaaatcctgtgttctcaataaagtccaattcctgtcaggatagctctgttaaaaaactcttctctatattgagataaaatttgcattcttctaacatctgctcataggttgtattttgcccctcggggcccttcagaacaagtcattcacatcatagtcctttaaagatataatgagagtgattgtgttcctccaggtcttttcctggctaaaaattccctattgcttttctgaggtgttcatatgatatagtttcaactcatgtcactatttcaaatatctctgctaaatatgctccaagtgacaaatcttttttgaagggtgatacctataactgggcaaagctttacagtgtggtcctttgtacacagtaagaaccagaacaactcaattcactgaaacctacgtgaattcaattgtacttaacaaatagaaactcagggccaccctattagctcctcctgacccaggacttaactgactcactctaaaatcaatctagcctatgaattcagatctcatctttggtcagtatctatacataaaatagtcactgtaaaggatttttttctatcagttacagctcaaagtaattatactgtctttttttcatcttattaaaaataagacacaccatattaagaaaaatatcaagaagctgttgccaaaatcatccctgccctctatgaatatagaatgatttatcattctagcaaccttctcactgatttatacactgaacaaatatttattgaacatccaatatatattttatttctgctaggtacaggggatattaatggtgaataagggagatcaaatcactgacttcatgaactttctgtgtgagtgtgttatatataataaaggtaacaaattaatataaaatataacttcaggttgtgatatagactctaaaataaataaatatggtaacataataagtcacagctggaggagtgatttagggagaagggagattgatctctgagaagatgatatttaagctgagtcctcataaagtgaacataaaagaagttgtccaaactgaatccagcagcacatcaaaaagcttatccaccatgatcaagtgggcttcatcctgggatgcaaggctggttcaatatacgcaaatcaataaatgtaatccagcatataaacagaaccaaagacaaaaaccacatgattgtctcaatagatgcagaaaaggcctttgacaaaattcaacaactcttcatgctaaaaactctcaataaatcaggtattgatgggacgtatctcaaaataataagagctatctatgacaaacccacagccaatatcatactgaatgggcaaaatctggaagcattccctttgaaaactggcacaagacagggatgccctctctcaccactcctattcaacatagtgttggaagttctggccaaggcaattaggcaggagaaagaaataaagggtattcagttaggaaaagaggaagtcaaactgtccctgtttgcagatgacatgattgtatatctagaaaaccccactgtctcagcccaaaatctccttaagctgataagcaacttcagcaaagtctcaggatataaaaccaatgtacaaaaatcacaagcattcttatacaccaataacagacaaacagagagccaaatcatgagtgaactcccattcacaattgcttcaaagagaataaaataactaggaatccaacttacaagggacgtgaaggacctcttcaaggagaactacaaaccactgctcaaggaaataaaaaaggatacaaacaaatggaagaacattccatgctcatggataggaagaatcaatattgtgaaaatggcatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcaaggtactggtaccaaaacagagatatagatcaatggaacagaacagagccctcagaaataacgctgcatatctataactatctgatctttgacaaacctgagaaaaacaagaaatggggaaaggattcccttttaataaatggtgctgggaaaacaggctagccataggtagaaagctgaaactggatcccttccttacaccttctacaaaaattaattcaagaaggattaaagacttaaacgttagacctaaaaccataaaaaccctagaagaaaacctaggcaatactattcaggacataggcatgggcaaggacttcatgtctaaaacacctaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacacatttacaagaaaaaaacaaacaaccccatcaaaaagtgggcgaaggatatgaacagacacttcccaaaagaagacatttatgcagccaacagacacatgaaaaaatgctcatcatcactggccatcagagaaatgcaaataaaaaccacaatgagataccatctcacaccagttagaatggcaatcattaaaatgtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcagcactattcacaatagcaaagacttggaacaaacccaaatgtccaacaacgatagactggattaagaaaatgtggcacatatacaccatggaatactatgcagccataaaaaatgatgagttcatgtcctttgtagggacgtggatgaagctggaaaccatcattctcagcaaactgtcgcaaggacaaaaaaaacaaacaccgcattttctcactcacaggtgggaattgaacaatgacaacacatggacacaggaaggggaacatcacactctggggactgttgtagggtggggggaggggggagggatagcattaggagatatacctaatgctaaatgacgagttaatgggtgcagcacaccagcatggcacatttatacatatgtaactaacctgcacattgtgcacatgtaccctaaaacttaaagtataataataataaaaacataaaaagtaaaaaataaaaaaaaagaagctgtccatatggccatatgtgaaaaaaacactggtgaattaccaagtgcaaacataatataatgtttatataaacttgtacatgtgtacgtgtatttatgtttataagtatatatgaacatgtgtatacaaatatatattagacaatggaaatatttataagtccttatgggatgtgtgtgaaacaatggtagaatttcacaataattgagaaaggatcaactatttaatatatgatggtggcccaaatgtcaacactactaaatgaaatgatctctacctcatgttagacataaaaatatatttcagagggaataaatatctgtatgttgaataataatactttactcttttaacaacataatgtgggaaatatgtgacaaatttgttgatagaatgtcttaacgaggtacaaaaccacaaaccaggacacccagtaggtgctccataactatatattaaaataattaaaagataaatcatatgtttaccttaaagttcttcaaatcttctgtgactgaaaaattatttaaaaaatatttcaaaagacatgggcaacagagatatttttaacaaacctaagcaaattaattacaaaatacaacctaacaaaaatcggaaaattggaaaacgatataagcaagtcaccgaattagaaagccaaatagtcaataaatatttgcaaaaagaatgttctcactaggaatcagaaaattacacattaaaaccaatgagagatacttaatcctcttcagattgaaaaggcattttaaaaagtgataaccttgagcattattcacaatgtgcagagatgaaaacacttaaagagtgttgatgggagtatatttcattcaactactttagagacctcattgcagtattctgttccctctggagtttcatagaaaattgacatcagttgggagatctcagctgcaggtcctctagatcccacttttccagcttgttcttacttgttaatcaacattaagtccaaagaagcagtttccttcacagtttccttaatattcttagagatgaaattgtcagcaaggcaaatcaataatttaacacatgccctactttttgtagactgagaatctcaggagacgtccagagacttaaagtccctaatctttgttatttttctcatccttataacatttgtggtctttattaggaagtatccgtattatatcctgcttcttctcagataagagtgtttaaaatttctctatgtgtatcttgattcatggcttcaaaaccatttgtcatgtagaaataattccctaaaagtgtgtcactcttcagattttaagaaacatctgaattaccgacaagaaaatatttcttaacttttttcaaaccgataccttctttgataaaagaaaaaaagagtcaattctttcagctgatttgaaatttcaaaataaataattactaaaaataaatcaaatcatttggacaaagcacctttgcctcaggagattccaatatggccacttaaagaatgtcagtctttttctctactctctttttaagaatcgccttaggacaattctgtcttccatgcttcaaataaacattttggctgggcacggtggctcacgcctgtaatcccaacagtttgggaggccgaggtgggcagatcacttgaggtcaggagttcgagaccagcctggccaacatggtgaaaccccatctctattaaaaatacagaaattagccaggcatggtggcgcatgcctgtaatcccagctactcaggaagcagaagttgcagtcagtcgagattgcgccactgcattccagcctgggcaacagagcgagacctggtctcaaaaaaaaaaaaagaaaaaaaaatagtgtattttcatatgcataaaagcattaggaattatatataattttacacacaaaaagtaacttagttgtcatacctgtggacacaaggtttccaaatgattggctgcaattttgacaattttaattccatcttcatttgttgacatggaacaagcaagatttgccaccttaaatacaatccaaaataatggaaattattttagattagcaaggaaatgcagcaacacttatactgaacaagaacatgtacacattcatcaagaatctcaatgacaaataacattctcaaaatcatcactggtatctattttatgaaagaattcagagaatctattaaagcaaataacaataaaaggacctagataattgtttaaaatgaggagagactagtgagagaatcagtaaaccctatacagtctcttggtatcaacatctaacccataataagaagctattgtgagactggaaaaacaaaagtttatctgtggattgaatgctaataggtttttggaatctcatatgattgtgatttattttaaatttgtaattggtttattatttcccagaggtctattactcatatttaagttgcattaagtatgactgtatctttatacattttgtttgcatcaaatatactacaaagctgaacaaatacaagataattaacttcttcctgctcttgattttccactacaacttcatgggcactgtttgacattcctgcagtgcatttgattcaagcattagtgacacccaaatttctcttatattattgcttttgaaatttacattttcttccaacaaaatgagtgctgttttaattaccattatgtccatgacctaaatccaaggtttacaaatactttcttcagaccatgaaagagccatgatgaagagtgagaggttattttcccttcctctgcaccccactcttgttcaagattcttcttactaacacagtaaggcttatggacagaggcaatgttttctctgatctacaaaatatctcattgtctttatcattgcaaggatttactttatctaacagtaatttttctaacttttaaaatatctctgtcagttgttttatactttaacgcattgcagtttttcctgctaagatctaaaatacatccagttgcggagaaactacgcattagccacatgcagtggaaataaacaacatatgactttggatcactattttaaaagtaccacaaaatgttatttaaatggatttacagtctttgcttttttataacatttcttttaatatgccaatagtgaaataactcctcggttttcattcacatataatgaaataacagccatacattatttaactgtggaagggcattgctcactttattaatgtacatggggatggcttacttgaaaaggtcttttgttggcttgaaggtcacaatgcctcaactttcataatttctgacacataattagcacatttgtgagttgtttgaaaagggcaacagtttctgtgcccctttccactccccaaaccccaatcactaaaagtgaaacttgacagtctaattgctttaatttgtattatattaattcacactgcatttgcaaaaaatactgacctgtaaaattgagcactgtttgtttaaagtaaaaaaataaaaataaaaataaaaatcattggctcaatgtggtcaaattagaagaatgctggttaacccaaagcttagaaattataaaaaactggccctatgtagatacttttttattttacttacttatatttactgtatcctcattttcttctttttccttttgaaagtatacattcttcttctggatatttgctggccaccgaggcttattaaaagccaattaagtgactgacatagtatagaaattatgttaaacacagtgtgtgtttatattagcagaattaattttatacaaccctctaatgaaaatacaacacaactgaaagttgtgttttctactcaaagttttctgctcagtcatcatactaacactctttttgtcttcatgtattctatgcctgcacatacttgaacttctccttaccagaactgttctgtcaaagttactaggtaatagagtatatttcaagtcatgtgcagttttagtgctattgtgtacaaacaaggtcgaattttaagataagtaatatctgtgacaaaacagaaaagtgttagaaataaaatatctttacatttcaaatttgaatgattttatgacatattttctaatgttacatcagtgtgtgaataaagccaaatttcttctaatgatgattcttcctaaattctgcatggctctttagtcaagtatgttcccaagaacagtagaaatgtaattccctgctggtcaaagaatacagcctgcaaataagatgttctgtaaaaatagttttagatatttggacatttgatatcctttgtgtatctgcgcaaaatgtgggcaaagctttgttggtattcataagatctctgtagaatgtttctgctcactgagggaaacaaggatatcgggagtttttggagacaaacagatttgggtttgaacccagttcctacagttaataagcttctgattatgagcaagatattaaattatttgatcttgttttgtcacctataaaatgagtatgataatgatgacctcactgggatgctttgagaattaaacgagataatgtatggggagagtctgaagcctggtggccctcaccatgtatgaattgccttccatttaatctatctctcaactaatggaaagaaaaagaaaagaaaaaaagaaatttcatactctcagaggttttgtagaattaaagccttaggagcctaaagaaatttaacaatatgtctgacccaagagccacaaactcaaatgctttcaagagccatgcaggggatgggatacaaacattgagtctagattgaactcagtagtaggctggggttgtgggtccccagacaaaatgattatgtatgccctactgaaaggcattcattaaaacgagagaaatgaaaggaaaaactcaatgtcttagccaaactaacagtctgttggcttactttagttcacaggtcaccattttgtgacatttaaccccactctctaatcttatattgtataaataagaaaacaaaattaagcagggggatgaaacatactcaaaccaaccaatggcagggcgactattaactagcaatatgtgtatgtcctttttgctaccctgaagaaagtcttgaaaagcattctggcattgaaatgattgaccagactttttattggtattttgctacatccttaaccaagtctacaaaaagcagaatctaaattatcttaaataaatgggacaaaaggtagttatttaaatttacacatttattgaaaagaaaaacctgggacaaaatgttctttcatttttatgaaagattaaattacatccttaaaataattaccaatattgtaataatttaaaaacaaacaagaagtcttcaaacagggatatgtgtcttgttatgagaggagagtgaagttttttattagcatccctctcttgcagctctttccttcccaccattccttctgccctctaaaatgtatggtatattctaggccctttaaacatggctgaccttattgccctatttgggctctaaaaaacattgtagatgagaatgcctagccagacaattcctcagctgaacaatcatgttaatgtttgttcccttccttctggttcctagttcaagttcattttatttacttatttatttagagaccaagtctcactaggtcgcccaggctggagtgcagtggctcgatctaggctcactgcaacctccacctcctgggctcaaatgatcctcccaccacagcccctcaagtagctgggactacaggtgcgcaccaccacacctggctaatttttgtattttttgtagagacggggtttcgccatgttggctaagctggttttgacctcctgacctcaagcaatccatctgcctcagtctcccaaagtgctaggattacagccatgtgccatggcactgacccctagttccagttctgtatactagttagtatgtttctgtcatgatttccatttgctggactttgagtcttttctttcactcagcagagaacatagtatccttcactccctaacccatggtttcaggtgagaaattccctgttgtggagcctggccttgtagaatcctgacacctaggctagttctgtccctcactctctatcaaggtcaggaggatgatcaggcttgaaacaaaaggatgagtcaccagtggtagagccagggacggcaatgaaacagatattttgagatggaaaattttttcaatgaccctttaaaaaagatctaccatactataggttaagtctgcttttcatcattactttgttctaatctggtaaagatattctattttaaataaattgaatatcagagcatggtatgttttaacgttctagtattaagttttatctgaaatctcaggggcactggtagtgttctcagtcatcttagaaaactgaaatgaaatcattgttaggaatgagtacactatttggacagctgcttatcacatatcattcagtctgtcaccaagaagttcccacacaggtatttacctgtaatatgatctctccagaacacgaagcaaaccttgatgtttgctgagattttcattgtcacacattcattgtttatatattgttcatatagttaattgtaatatcatgtcaccacgtctcctagctctcaatgggggagaaaggtcactgtctcattttcatgcattttcccatctggcaattggtcatgcaactcttgtgtaaatacttccagaggcagataatttattgtcttccagggcagtctagtcccattgcaggacagcccaaagttacaaagttacacaagttatgaagttcttctttataaggagatgaaatatttctctcaacaaatttctcctacttgttctagaatacagaatggcaaatatattcaataatggaaataaaatggggcctacaaaaaatccaaatcaatagtcctcaacttgtgggataagagagatggtaagagtaatagaatcaccagtaaatagctattaaaaagaaaagtccaattcccttctgtcaagatattctgatacattaagtgtgtatacgcatggaagacagaggtgtaaggactgtataattagattttttaaaagttctcccaggtgattctgatataccacctcccccatctccaacacatacacacacacaacaacaacaacaacaacaacaacaatacacacatgacaacacacagatacatactaggattttggttaattttcatgtgtttgaatagacagtctttcccgaagataaatgtactgaggtgaaagtctaaaaaagaatgacctgaacatgtgtgggttagcgtaggaagtttaatagaaagcttcacacattagaggcaagaaataatgacttaaacttctacttgagaaatagagaaaaggctaaaaattaaaataagaaaatcaagtataggggatattctggccttccatccaaaatccattcctccctttggtaataacactgatttccctcggagaacagttctttttctaacctagtggtgtaaagtcttggtacgactgtcaatcaaggatcctggtcctcccctaggtctagcctgggcatatcccttacttactagtgccacctacagccctgaatcactctttgttctgtcgaatcttagccttctttcattctgatttatgtgcattaccttatgtcttccataaagtctttatttctttttaagtaagccaaatttattttcctttgcatacaaccagagaaccacgattcttagtaagtactgagccagaaacttataccctaagaatgtactaatctcagatggatactttcaacaaagttgaaagctggtaatgtataaccataattatttctgtgaaaggcaacttctcattaaatgcctgcctctgggtttagtcagcctgcatgtcctagtgttaggaacaaatgtaaggaaggagacagtcatatcagttcctgcacatacagataagtgtcttcctttgacgatctaattcttcaatgtctattagaacatgttacatatcaggtacaagagaacatctaattcttgaagaaaataatttatcatttttgagtttatctttcagcaagctgctcattctgtttgaaaaccacccctcacatactctttgaaaatcatacctatacttcaaggcctggatcaaatattgtctcttccacaaactcttttcagatgcccaggatccatatctttatcttcccacactctcgcattatagcgaattctccttctctctaaactcatttatgtatctatcagatggtgagctgcttgagggtaaagacgatgatatattcttttaaaaatattttcccatcaagttaaataccccgaaaatagcatttcatctatgtaaataaataaaaataataatttatctctatctggaactgaatcattgttaatataaattattgtctattgtgtctgaaattaacacatttggtgaattctattttttaaagtcctgtgtacaacttaatttgttcgttggaagctgtgtcctttcttccactccttcctaataaaaatgatcctaattctgtaccgtatgaatataaaggtaagaattattgctttaggttatggggggaaacacctgagaaaagaaagtccttaggttattaaacttaactgccccgagtggatttcagtctgactgtgtatattcattggaaacatcaagattagacaaatctgtagcaaagatacaaataaacagagaaaaactttgaatatgggtgtggaaataatctagctgaaatgtgttatttatttttaacttgtattggcaaaggagacttgggcttctttctgaatttagaaataaatggcagttcataaaagcttgtgaagaagcatgaagaaggaaaaatggtgtctatgccccttggacacagtagtaagtagcaaaactacaaagtcactagccaaatcactgatagatggaacactagaagttcttcaggttggtaggagatagcaagagttgaatcagatactttgagtttgagttgccactgagatacataagaagacataaactacatatagttagatgtgtagttaagagggggtctacagtagagatattaattaagaagttactagtttattgatggtaattagatatgattatgtgaggagaaaaagttcttggaggtatataagatattaatatttattaggcagaaacatgaggttactccttcaatgagacttagaaaaagtggccagagataagaaaggttgcccacaatactgtgatgtcatggagaccaggagaagaaaaggtttcaagaggatgatatcatatatcaactgctgagaggtcaagtaagttatccctgaaaatatccagttcagccacagagacaaccatgctaatcattcctagagtgttcaagtcaaatgatgatggttaaactagtctgacatgaacagaggactgtgtatgaggtaaagtaaccccatgagtcttatgactcaaggcagagagctacaggtcgcctggataatactcactctctcattctcccatctatccattttaaaacattttacctctcagtaatatctcaaatcatgtattaggttggtgcaaaagtgattgtggtttttgcaatggcagaaactgcaattacttttgcaccaacctatatttttgctgtcctctaccctagttaagattttgatcagttttatttattttattcttgtttccagttttagcttttgttgtcagcaaatgttctttctctacaatatgttcacattgcagccaacaaattttttcagatgcaaatttggttcccccatcatcacctttccatccccacatcatacccccatccctactacgtcttgcagtctggcctgagagtcatcatgtgtagttcttgttctctctttgcttcagctatatcaatgtacttttatgtatcaatgcttgcttctgccagaaaacatctgtacatactgttctctgttggctggaatgctctcttcctcccttttcacagccaccttcacaccacttatacttgcttaactgctatccatcagatctctgctcaaaagtaattccttggaaagtttttcaccaacactgtcctccacctccacacagaatacctgaaacttctgcccacctaagtcagatttttccttcagagcatgattctcagtttataattatatgttcactgggaagattatttgattagcatacatttccccagatttataaaagcagggaccacccctgtatttgctcatcattcagcctacagtgccagtacctgacacacagtagacagtctataaatagttctttggggagtgaatgaatgcatgaatgcctgaatcagtatgcttgagaatgtatcatcttcttgatgaacatgagatgacaaatagaagaaaaatgggttttaagggaggagtcagcagcagaaattcaggacaagaaataaagaggaatgaaatttttcctttgaaattcattttcaatattctacaaaggcttagacaactggactttcaagaaaagtacttgtttttcttctagtctggccatcatccttaacaaggcttggggggcagcttctttcaagttttaccttcacttaagatatcaaatatggaactactgaataggtcccaatttagcttttaatttatttatttttaatcaagtaaagtaactcttaaagggcccaagctggatgccaaatgttggcaagtgtggcagatggaaagaggcacagtaacttccatagacaaatccaagagcttcattgtctatttcagaatgtaatatatgctctgcttctgataattgcagaaagagctctgatctccccatgttggcaccgaatgacctctggctaacaagtcagcccttctctttctcctagtgaagcagcgctgctctgcttcccttggtagtaataagaaatgattatgaattatgggttctgtagaatatttaactaatataactgtgctgtaaaagcacatagcaaattgcagggaaacaatttcatcaactaacaaatattgattatgcacctattatgtgggctgggaactgtcagggaaatgatagaagtcaaaatcaatgaaagtgaatcccaacaagcacaatctatttaaagggacacgtgaaaggatcaaaaactaaaactctgtctccaaatactacaagaagatagaggtaggtgaacttcatagagatgactgtagtaagagtgttacatggagacaaattattacttaggaaattcatattctcttgaactttgcatctcaagctgcttcccaaattttatgaatcctcaatcacacaatccggtctctgatattagttttgctttacctctctgtctttggtcatccatctataagatgaggaacagattgacttcatttctagacctctttccatttcaataattttgttttactgcttatgtaactgataacaaaattagacagaaattagacaaaggagaagagctatcaggcaacgttcctattaatttaaacatgaatttgtagatgaaatattagccaatttaattcaactgtgtaataaaaaataataataaagcaagacaatgttgtttattcccagaatgaacaaatgactcatgactgagagatctaatactgaaattcctttttgaactggatatcaatagatttttaaaaagcattgatgacaggtttatgcctattctgattaaagcaaagcaaaactacactaaaaaacaaactcaaaaccttagcaatctatgaataggaagaataattcttaatctcaaacaaaatccagaaatttccagcaagtgtcatgctcaaaattcaagattaagataagcattcccactataagtgaggttaatcaatattttactcaaggttctagtaaatctaaatgaataaaaaaaagcaatagatgcaaatattgttaacaaataactatatttattcccaggtctcaaaattgtctacctagggaaaacaagattatctgaaaactgttattactattgagtattcggtaacacttcttcatgcagaatgaatgtgagatgaataatatatttttctatatattttaaaagttttcatgacaaaatttgttattatagcaactaaatattataaatttcatagcagtatatatctattgaaataagcacaattatagatatgtgtgcatatctatagatgtattaaattttacttaatgatataaaaagagaatggaatgaatagtgagaaatatcagattcctggatggaaaaactcagtattgcaaaatataatgttatctctcataaaatttgtctattaaatttatagagctatactgaacttaggtaaattttaatgtgcatctggaagaatatatgaaaggctggcaaataagttttataaaaatggggaatgggctgggtacggtggctcacgtctgtaatcccggcactttgggaggctgaggtgggtgaatctcctgaggtcaagagtttgagaccagcctggccaacacggtgcaaccccatctctactaaaaaatacaaaaattagccgggcttggtggcgcatgcctgtaatcccagctacttgggaggccgaggcaggagaatcgcttgaacctgggaggcagaggttgaagtgagccgagatcacttcattgcattccagcctgggtgacaagaatgaaactccatctcaaaaaaaaaaaaaaaaaaaaagaatgaagaaaagtattatgtgccagtaattaaaaacacaaaaatttagtgtttttcagggtaatggtaaaaaatattggtgatggcccaatttcctgctctctactttcaggagaaaagtgcaattatgtaaaaaggctagaatatattactacataaaaaattttaaatgtcaaaatattgaaaataaagttaaaatacaaaagataggcaaaactttgtttttatatttgataataaaaattattatccacaggtataaatagctcctaagtatcaataaggaaaaaaggccattaaaaatggacaaaatatttaaatagagactttacatatgaaatatgactaataaatacatgaaaagattctcagtctagctcttactaagcaggatattcaactaagcaagaaaatcacggtttttgctcatcagatcagaaatatgtaaaaagtttttgatattatccaatactgctgagaatatggggatacaactggaaggtaaatggccaacttttcagagagcaatttagtttcacctacgaaaatttaaaatgttcagaactgtagcaattcaatttaatggaatctgtcattcagaaatacttgcatatgtgaacagactcacagccacgtgaaaactttatttgtaaaagcgaaaatgaatctaaatatttaacagtggagaataaattatgtaatattatgattctgtaaaaaaaataaaatgttatgctgctgtaaaatatctcaagtatataattttaagtgagatactgcagaatggaaaacatgattctatttaaaattatttacttacatgaccaggtgcagtggctcacgcctgtaatcccagcactttgggaggccaaggcgggcagatcacgaggtcaggagatcaagaccatcctggctaacatggtgaaaccccgtctctactaaaaatacaaaaaattagccgggtgtggtggcgggcacttgtagtcccagctacttgggaggctaaggcaggagaatggcgtgaacccagaaggcagagcttgcagtgagccgagatcctgccactgcactccagcctgggcaacagagcaagactccatctcaaaaaaaaaaattatttacttaaaattatgtataaatgcaaagtataatgtccacagtgataattcctactgttaatttgagttatatatgggagagaaggtaggattactattgctatgaagagaagtatccccttttgactatgtttctatatcgactgaagtttttccaagtatatttttcactatattaacagtgaaattagttttctaatttacaaaaaaacgcgattgatgaaatagtcctatatgtattggtgtatatggaacacaccaatgacaagtaaaacagcatgtgtaataatctcatttatgaaagatggtaaggttttgtgtatgcatatggaaatgtgatatccaaaatgatcctccccaaaatggcaattgtgatgatctctgaggagtgaaaatcaaggtaatttcaactttccttttctatattcttaataatttataatttggcttattataataaaaatgaatcattttgaagagaataaaacctatctatacctgtatgtgaatttttaataccaatcaagaaaattgtattaatcatgacacttattgcgaagcctgaagatacagaaccatttataaataaggtttccagaaaatacacatatataatgattacatagaaaaaaatgctgctaagcagaaaatagttttcatggtctcatatgctgttatatttaaaatgatgattcacaaaaatgattgagaattcacagtagggaaacaaggcactggttttaccttgtcttaatgtcaaataatggcacaaaaacaagtcaattaaagcttcttatcaatgacaaaatcataccagccaatattgatcttaataatgaatttaaattcaacatgtttggaaaggtactctgtgcatggtgtgtgtgtgtgtgtgtgtgtgtgtgtgtgtgtgtctgcagcagatataaggtaatgattcttatgattgaataattataacatggtcctacatttcttcctttttcctatcttactcacacctccaattctattcaaatttgtgtctgaaattcttgtccctctcaaataagtcattaaagatgaaaatattcatttgtctaagtggacatatgtcaacattgttctgaaaaagaggtatcagtatgctgcgtcagaatgtgccatcacaaaagaagcaattgagatgaaaacacacatacacacaaactcaaacatatttggctgttacagtattattgcttccaataaattatgagaaatatatgttacatagctcaaattgaagtctgcaatgtagactgctctaagagtcccattttgccaaatatatttcccttttagtttggaacaatatataactgtaaatggacacacacacctcatattgctgtgtgatgtaaattataatggtaaaaccagctagatagtttattcaaggtccctctctaaattaagctattattcacctcagaatcaccactcaaaggataaaagtatgtgtcacctgcctagtaaatttaatataataaacagtaccaaataaaatatattgaagtaccaaagagatgaaacaaatctaaactataaattaaagacaggattaagtgttgtttcctaaactagtgttattctttgttgtcactgaggtcaagaataaatatgaagcatgcaggtctaataagtgtttattaataggatcattgtggaaagggtagatgtcaaaacaatgctataattagctttcattatcattgaaattgctgtcaaatttcaaagcaattttatgaccagtgacctgatttctcacatggcagaaagagaagggattttcttaaagagagatacaatatattaaagccaatataaagttttcagtgagtctatttctgaatcaacatgttttgtacatattgcactgttcaaatgctatcatgggaacagaaggtgttgcataggacaaagttaattgaattgcaattgtgtaaacttcctggatgtggatgagaccatcaatatcacctgattccctaactaatcacgaaatacacacccagattcattccttactttcacaaaagaacgggtctcttagtagaatgacagtaggcaatcaatcatctggcaacttctatcttcgaagacatcataacaataatctgtgaaactatttttttcctgtaggcatctatttattatgactttgaaggaaataggcaaagaagctttgaaatttaccataattataatcccagagaaagccccttgtctctgagtataaattgccgataatgagtgaaacaaattggaagaacactgtgtgtgtgtgtgtgtgtgtgtgtgtgtgtgtgtgtgtgtgtgtggagtggaagagaggcaagcacatttgtgtatgtatatatgaagtccgagcaaaatttacaaatatgtgcatgtactattattaaatactatgatttcatatcccctcattcttgggtccctgaatctcaggagggctccttgaatgtgttctgcatttaattatatgataaaaatgaagtatagctaattatgtaatatagaattaaaagaaaataaaatatttaggccctttaacgttagcaggggcataagctattacaggtttaatcttaactacccctgtacctctacagcacactgaaatactggacacatactgtgagtagtggccattactagaggataggataagacacttgcagtgtaatcttagtaatttttttaaatatatattatttatggttcctagtagttctagaagggaggagggaggagtaagaagggatcttgtatactaaccttccataattagagcaaaccaacatatgaattctatttgcacaaggttaaattgtgaaatccttgaagacagaaaccatcttactcctctttttggttctaagatattgcaagcagtgggttcttaaagcttctgttgaatacatttaacccaacattgcaaataaaatatttttcacgttgtcttctctatacttatttatgattgatctctttacagaggcctaaagacaacaacaaaatccacaaatatttattatctatcaggcatgttccaggcactgaaagaaaaagaagagaagatggggaaaaagtagttgccatgcttcaataaatgagagatttagatgtaaatacacaaaacatttagagctattaataatgaaaacatttaaatgacagtgtatactatgctaaacgagtaaaacactaaatgctgatgggcttcataataaggagataacgcagtgaagctttaaaaaatgttagctggatagttttaaaaagtcttaaagaaagacaatttctatatatcaattgaattgtttaataaaactctaaaaataagactgtcatataaaaatgtgttgatagaaaacatagaagttttaatattaataaatcccagtaacagaagatttttggataaatcagaaatgtttcgtttaaatacaaattctctttaagaaatagtgaatggtctaatgaaaactgttattgcaaatactgaaagttacattgcatgttattttatttctatccttattacaatacttcctatgtatttagttgttttcaattcttatgtcaagtaacatgaaacttaaatcaaaattcaagaaagcaatgctgcattcaaggtagctccatgcacatcagccacatggcactacatggttgcaccagccaggcctggattctcaccagcattgctcaaaggctctgagtctgagtcacaggagttggagggcatttgccatcaactagtccagtttttgaccctgtttcagaaggctggcttgcttgcactgcacctggagcctttcaaaccgttgtcaggctcagcctctgaagaaagaaatcccacagcattctggctttgctcagtgtatgccgttttgttccagaagtcaggagacaggttgcttccttccccagctcttgagggcagaggctgagctttctcacctatgagatggtaaccttaatgagcacctcccccttgggacacagagtacaaagcgtcctggatgctcagtagccagaaacagagaatgccaataaaagcccagttcatttttcatcacagaagttagagtcctaccctcaccttcagcctctgactactatggatccctcctgcccctggctgccagtctttggaaagcacacccacaccttgttggttaattaacactaatgggcagctgccatccctgcataaaaccacaaccatggctggattacttgagggctgattatgctgtttgtccaggcacaatgtttctcttccctaacagcctaccctttggaccctgatggctcattatcaccttccaccactggaagaacaagacaagactgtcagctgcgtcacttctcacatttccaagaaaaagcttaaatctaagcaatgccattctaggcgttctctgcaagggtttttagcttagcaaaatccctcttgcaatctttgttcatgattttgtctcaaattctgaattatcttattaagaactggaaactgttcctgcaagtgacttgtttttaaatttgcttttcagacatctctaagggttgctggcaactcaagtgcaattcgtgatttcctctttcccagcacattctatttagcctattaatttcaaatgaatgtattttccctgcatcctctagaagcggactttaattgaatataatatcctcccgccgccgcccacccctccgccgccccaactctagaagtggacttctgggcgggggcaggcaattatattcaattgatattaataggcttaatctattcacttgaaattaataggctaaaatctgttgctctttcttttcccataaatagactaatgccagtccctgctgtcttcctccattcatcttccacatcctcttttttcaaggcccacaccatcatcttcccttctctgaaactgaattcagtctctacataatcaatgtactgctgtgatcacagctggtactttctggtatctccaggaatcacagttgacctacctttgttgatttctgggctctgaactatcattcttttctcttttctcccccgcccattcgttattcttgtcacatagtttctttcccttcccactagttatcccatcttgtagaatacaaaatccctcatacttttcctctcattctgcctttttcacatcactgtctctgtggtaaataaaacataacaaacaatatgttttttttaatctttgcactttaaacatatatttatgtgcagagaaataaaaatatatttctctgttggtgaataattcatttcctgttgctttggaaatagagtctgtgagccaggggctagttttatatctacgtttagtaaattgaatagaatattttgctataatgcagtaagtgtacctgaaatcactgttttgggagccacaaattcatgagggaaaagcctcaaaggctatggtacattagttgaaccatagaaaaagaaatcaattataattgcttctccagttaaatattatgagttacagtgagtatttaagatagttttgaaaaaaacattttattatttcaagatctgcatcctagttacagtggccatttttattagtgggtccaataaagtattcgtatttatccttgctctgttagcaggtgctgatgaagtagaggttgcgctatgaatataggaagcagtatgatttgaaaaaaggagaaatggcagtataggtattggaatccagacagaatgaactttatttactgttatcttatattttactcatcttccatgaagatgactaacccaaagggattcatatttgtggtcccctcaaatatgtccagttagtggaaacacatcacatattttagagtatgactcaataatataactttaaatccttctaactctccactctttcatattctccagtaaaaagataaaacttgaagtatttatttagaagtcactatgcaacactgtgctttgggagttcataactaccttaaaaagacataatctgtaacaagaatcattctaatactgtgtgtccttttatgtttaaataagtatgcatgtaaagctaaaataacatgaataaatttaccaagtcaaagattttacttcatatatgtcacttttaattcattactgtagtcattttaaatccctaggtaagtttaaaaaaaagacttgtttctcttctacaattatactacggatgaactgtgcacctctctctctctctctgtctgtatagctacatacatgcagatatattttactttaagtgttcagaaatcttattatttcaaaaggaatatgtgcttaattaaaagttttggaaaacactgttaaatacaaaagagtaaatacacaaaatacacattttcagtgtggcagataaactcacccaatgcctactctcaactcctctttcctgtgtcttttctcccctctattgcatatcacagagctctggccatatctcctcttcatattggatacatccatctttcagctgctggggataactgctattgaccactcatggcatagtcgttcactaggaactgtcctaggttgtaggaaactaccttccccaaggcaatgtctcttcccaggggaagctcacaattaatgatggagtgagttgggattacaaaggcataggtcccttgcctctacatgtgacaattctgaaaggtcacctgagctccagagtccctaagagttcaggtaaggtttcagttgcaaccacattcattgtaagtcagctgctgcttctacccaattctacctttctcccttcattacaggcttatctctgaagattactccccagtaaatcttcaggatagaactatccgtatcaaagtatacttacggggagccaacttaagaaaatcataatacccagcaaacagaatactcattttttcggtctcctttattgctaggctgaaccatgtgccaatgagattaggcacagttccccagggaagaatttttccccccaccattagtagtcaagattcactagaatatattcctttgactttttcccctttgttctcctcccaactgggatgcagacaaaataccaagagggcagacataatcttaaaactataaagataaaagcgaacaaacataccaagcatccaaaagatccttggaaacatcattgagcaaatgaacgcatgctagcaatcaccaacccctcaactttttgacatgggagaaaaaaacaaaaatcatttttaaattgattgttatttgcagccaaatgcaatcccaagtgatacaattaaggaaccactctatctagaagtatatgtatatatgtagtagagtgttgtttataacagcaaaaaaatgaaactgtcatataagtgttaagttatggcctatccttaggaaggaaaattatagtcattgcaataattcctttgaaaaatgaagttgttgagaaatgctttttatgccatattaaatttaaagatataaattccaacacacatagatataactacatatagccaatgaagccaccaatcttgtgacacttctttgtagaaaaagaaatttccatgttgtagcatattgcattttctaaaaatggccagactaatattatgtctcaacccacataatctccctaaaatgggtctacactctttccattgaatctgggtaagggcttgtgactgctcctaacccacagaaactataagagataataaatgattgttgtcttaagtcaccacattttgggatgatttattatgcaccattagatgacaggaacagctgtgtgttatctttgttatttgatcttttgaaatatagtttaacttggaaactgaagacaagtttattcctttatttaaaacatatttaatatgtgcttactgctctttttcattgtgataaaaaactttcattgagagagaaacatctcttaatattagtttgtcaggtgttagaatccaggacccctgccctggaattgttcatgagtccaagcagttgtaactgcatctagcaaataatggtctgctttgctgtctccttgttaaaagtacttcaaaatgtatgcaaaatatgtcttatagccagcaggcttctcattccttgctagggactctgtaaatgaaaaacaaaacaaaaaacccaaagctacagcagaacacatttgaaattatgaatacaaccataaaaatggcaattctaaggtaaggtttgagaatacagaacttatctgagcctgttgccttcttctgtgcaaaagaaccattatagataaacaggcagcagatagtcacaattcaatgccatgatatgtggataaaacgaaacaaaggtcgagaaattagcttacttccagatgttctttgggtcaggctcatctatccctaacttctcatatgaaagttaaactgccacagcctgaaataatagataattgaaattctcattttcttcagaaaattctgcaattaaaatgttgatatttctttaaaatacacacacacacacacacacacaaacacacacacacacacacacacacacaaaacctgatatcaaatcttacattccctccacccagaaaacatgactaggtcatttaaacagtacttgaatatattcacagaaaatcagcaggtcaggtagaaaattactcaccctacacaccagttgtgtgagtgttgcagagtatgaaccgctgccaagatatctgtcattggcatatctccacttttcaatttgatacaatgtgtttaacctatcactgttattcagtgtactataactgctatacaagcacctgtgtgtttaccagagctttactattcccttggctagaaatatttccaaacaaggtactaaatataaatgcccgccattttcaaaaatatatatatataataaacattctccaaatattttaaaagcctacagttaccaataagcttttgtgtacataaattagagaataaggggcaaagaaaactttattagcataccattaagtacttaatttattatttttgcagtgacatccttgcaggatttcttctttaacatgaaaaagtcaacatcttaactgttgaaggctctgctttagaatcctaggggcatttccagacaagttctagcgattattgtgaaagtacctgtttctagaccaactctttaagcagaccactaaaaagaccttttcaaatcttccatgtaaaggaaagccttgaaagggagagagctagatagatacatagatacacatatatagatagatgatggagatagatacagagaggtcagatgataacaaagatcagattataacaaacttaaatgtaggtgctccagctagctaacagagaataacaaatcatcacacagtttagtgacttaaaacaattatcacataatttacaatctaaacttgtaaatcttgtcaacagcaatcaggagtccacattatcctttaaaccaaattttatttccaagtagaaaatattttcttatttaattgtatactgatctgaattcaatgtatcttgtacatgaaaatagcaacttggctctgctgggtaactgaagaccatgtttgtgactggaagcatgttattaatctacttaaaatcttcattccttaataaaatctactccctgtcaacatttattttagaaactgaaatctttgtgagcatagctatattggcatcataagctctaaatggaagactacttaagggcatcttcttatttctagtagagttaatatcattactaaccccaactattctgatgaaataggtatctagcataaacatcaatcatcttcttttataactcattgataattccccatggtcccttgctctatttttcatctgttgtaacacataaaggggttcaacaactactttattctaagctttctctgctgcaaaccgaaggttactaattcacttcattaacaattacaagtatttgtatctgtcctcacaaattcaaaattgaccattttataaaagacatatcccttctcttcattctacctttgttaggtatatttttctatttccaaatatttattttatttccaaatcatgattcattcaaataagttttacacaaagaagaaagtacaagatgtgtaacagctctagtagagaacatttcagctgtgccacaaaaagaaaacagcaatataatggtgtgctgacaaaataggccaggcatggaggctcatgcctataatcccagcactttcagagaccaagacaggcagatcacttgagcctgggagttcgagaccagcctgggcaatatgacaagcccccgtctctgcaaaaaatacaaaaattagccaggcatggtggcacatgcctgtagtcctagctacttggcggggttaaggtgggaggattggttgagcttgggaggttgaggcttcagtaagccatgatcatgctactgcacactagcctgagtgacggaataagagacttggtctctctgtctgtctgtctgtctgtctgtctgtctgtctctctctctctctatatatatatatatataaaataatactttacatatattatatatattttacatatagtatattttacatgtgtattttatattttacatatatatattttgagaccaagtctcttacttgatccaaacccccagatcccccccaaatatgtatatatatatatatgtttatatatatatatacacacatacacaatatattagacactatgtaaatgtctgaaataaattttagttgggttctttattgagataattacaaattcacatgcagttgtaagaaataatatagagacatcccttgcaaactttatccccgtcttacaaaatgttaccacatcatccccctgtggtaacattttgtaagactatattttcagggtcttgacactgatataactcactgatcttatttttctccagttttacttgtattaatttttcttagtgtggtatgggtgggtgtgcaataagtctatacaattttgtcacctgtgtaggttcatggattcaccaccgcagtcaagatgttgaacagttcccacaccacaagagtattcatgttgcctttttataactatatccatctccctccttcaaaatcccacatcctcctgctagctcagtgcccccacacaaccactaactattccccatttctaaattttattatttcaaaatgttttataagtggaattatatagtatgtaatcttttgggatttttttcataacataattcttggagatttattcaacctaaggtgtttatcaacagtttattcctttttattgctgagtagtattccatggtatatatgtacaatacaaatatgttctcccattctttagcttgtaattttattctcacatggttttcacaaagttagcattttacattttgatgaagtctaattcatcaattttttaaattcacacttcatgattgtggtatcaaggactctgcctagccctagatcccgaatattttttcctattttgttctaaacattttgtatttatattataattttttaatattttacctttgtctctgatccattttgagtttatttttgtgtacagtgtgagacttcgttcggaactcattttgctgcctataggtgtcaaattgctccaacaccatttgtggaaaatgctgtctttcttctattaaattggttttgcatctttgtcaaaaatgtgttgaatatacagatttttgtgtggggatatttatgggtcccctattccagggctccccaacccctgggccacagacaactaccagtctgtggcctatcagcaaccaagccacacagcaggattggtgagtgaactttactgcctgatctttgccttctgtcagatcagcggtggcattagattctcatacgagctccaaccctattgtgaacagcacatgcaagaaatctaggttgcacgtcctttatgagaatctaatgcctgatgatctgaggtggcacagtttcatcttgaaaacacccctgcctccactcactatccgtggaaaaattgtcttccatgaaactggtccctggtcccaaaaaggttggggatcgctgccctattctgttccattgatctatgtgtctatgctctggcaatgtcacaccactttgattattgcagctatagtgtaaaacttaatatcaggtagagtacttttccccactttatttacctctttttattatttaactatttttgctattcattgtaaatttagaccacatgcatttatatttccaaaaacttgccaggattttgaagaaattgcatataaatccttttgggaactataatgaaattaaagaaagaaacagaaatgttctaggataacagagcaaaggcagataaagttctggcattggaggaagactaataaactaatacaatatgaaaaaaattgatgtgaaaaaatagaatatccacttgaaccatacatgcggacgtgtggataggcatcagcattccagcacaacggatgggacagaaacaaaaaatgagattatagcacaaagagttaactttaactatgtagtcatcacagaatgttatgggagcaaaacaataactcagtcacagcaatagaagtgtcaattttattataatagtgctgaccttttttggggcaagtggaaggggtagggagtagaagactgtcaataaagacatgtctgtatggaaatacagacatcttttgttggtaatctgctaaaaccacatacttttaaaggtgaaagagagatgaaaatacattatgttattaaggtatactctaaattgccaggcaagattgagaaaagtgatgaggcttccctgatagagactccacaattagaaccaaagcagtacagagcagcaacctgagcttccatcattcactcactgggattcccatcaacatacagcatccttggcaagtcttgttcagatggaaaagcagtcacaagaggagtgctcttctaatcctgtgctaaccaatctaaaagcatttgtgactgaagtagtggaaactctgaacaaaattaccttgtaaattttagtttatagtagcccagatatgtggccatgctagattccaaaaacttcagagaaaaatgggtataattaatgacctcttattctgacactttgagagggtttgaaggctatcaataataattctgtgatctcaagcaaaaaagaaaaaaaaaaagaaaaagaatgcggctgcacctcagactccatgagaagcttatatgtaaatggacaaaattcagaagaaataagtgcctcgcacaggccttaacacacaagttgtgctcaatcatgtttggtaaaagaatgaatggacattgtaaaaccaaaaattaacatctaaagggttcatacactacaagccaggagagtcaaagtatatatcatctgttcatctaatcattccatcattaatttattatgagcttcttgctttcagggtcccatagtccagagtgaaaaagtgatatgcaaaccaaaaaatcaaaatacaggaaagtaactatgactaggtaattgtttaaaatactttgggaacaggcaggctggagttattaattaactatatttggggaaaagaagactacaaaagtcttcacaatgtagttaacatttaagtaattttgaagaatagcagagatagagagttataaaaattactcttttttttttttttcttgagacagagtcttgctctgtcgcctaggctggagtgcagtggtgtgaccttggctcactgcaagctccgcctcctgggttcaggccattctcctgcctcagcctcccgagtagctgggactacaggcacctgccaccacgcccagctaaattttttttttttttgtatttttagtagagagggcatttcaccttgttagccaggatggtctcgatcttctgacctcgtgatccacccgccttggtctccccaagtactgggattacaggcgtgagccaccgtgcccagccaaaaagaactctttatatatgtttttgaaaagaagaagaaaagagaagcatatgctatcaaaaaagaaattcagtgctggaatgataatgagctcagagcaaaagtaaagagataaactgcctatagattgtttggagagcttaagttgaaccctccctagccattcccaaagatgcaagccccctataaaaatttggagcacctaacactacaaagtttgaaagaatattatctttgatatgattcctccctgtctgttaacttccatgtttccatcccattggccctgcttttatgtatcctccattggcctaacagctctcaaccagaggttttaaaccctgacagctcattagcatcaccagaagaacttttacaaaagccttccacttgtgtcccttccccagggattctgattccactggtttggggtaagggaccctgtgttgcccacagcggctgatgcccatcaaaagggcattaggaaaatcactctgcgggaaatcactctggcccgccatggtgaatgagtgtttttaagaggattaaacaaacatcaaaaagaaaaaaattaatgtcatggagttccataccatcttaagacttaatgattcatatgccattacacagaaggaatttgcccaagatagctatgaattgtagccatgatctctaaaaaagagtcgaatatgcgaatcctacctaaagaccggggacaagtgatccttaattcatacaaacagtaatggggagacactaaaatgttttctgaagaacattgacaaattaagatttgcacattataagaaatattctagctacatacaagaaaaaatgattgtaaaaaaatcaaagatgattcccagacttttgtttgggaaaccagatgaacataaatacaattcatcgagaggtaatggagaaaaaagtacaggcgtggcagcggaattagatgaggacagaagttctcctttagatatgctgatttttgggtatatatattacatagtggtttatacacaggttggaaattcaggagaaaaatcattacagatgggagatgtgtatttgagatccatctgcatatagctgggttgttaaggcaaagaaatagataagcttgttctgggagggtgtgtagaattctctttaggagaagaatacctagggcagaatttaaaggaacgctaacataggcagtagaaaaacacccacaaagtagattcataggaaatggccagagaggtagaaggaaaatcaggagagtgtggcataataggtgccagaagaaaagagtgtttaaaggaggaatgattgaacaatacttgcaaacattgcaatgatttcagtggagaatgcgactgaagtttgattagagtgaattaaggagtagatgggaggtaaaataaaaagtagaaataagaattagaaaaggtttataaagatggtggaagagaactttccagtgcttatccccacagagaaacattaatttgaacaaatatccatgcacaaacaaaagttcacaagagctaaagaaaccatgtgagagattacagaagctgagtggagcacagaaataagaaagacacactgataaaggtaagaaggacagttttaaatcacctgtgaagccgcttcacaaactgtatacagcacggacacagacagcagcaatacccaacccttacgggaaggaaagtgagcaccaaacttactgtggaacccaacactgggcctgctccagcaaaacccaacttcacgcaggcacctatggccccagactccaggctgatacctgcagactaagcttccaggcccacctggattctaggatagctcccacagccctgggatccatgcctgctcaatagactcaatctctgggcctgccccactgccaggctgaccccagcagccctaggctcgggaacagccccagtatcaggcaagccctaccagccctggcccttggtcagaaccagacatcacagatgtaggcataagcctgacccaggaccaggcctgacacaggccagcaccttgggacccagcctccaggttaagccccacagactcgggcttcaggcttaccccaggtttcagacaagccggaagctaaaacatcccatgcagtcccaggcctcaggccccaacaccagattagcactcctggtctcaatagcaggggactcaaatatcccactttcagcaatgaaaaaattatccagaaaaaatatcaataagtaaacatcagattaaaactacactttagaccaaatagacccaacagacatatacagaacattcccattaagcagcagcagaatatacttttttctcaaacacacacagaacattcttcagggtagatcatatgttaggtcattcacaagagcttaagaacccatgtgggagattacagaacccgggtgtagcacagaaatattggcaaaacaagtcttaacaaatttgaaaagatgtaatcatattaagtattttttctgatcataatggtaagaaattagaaatcagttaactggaaaaatttcaaaaacttcacaaatatatgaaacttaaacaatatgctctttaacaaccaacgaatcaaagaagaaagtaaaagagaaattaaaaactattttgagataagtgaaaagagagacacaaaacagcaaaactcatgatgtgtccggaattggtgggttcttggtctcgctgacttcaagaatgaagccgcggaccctcacgatgaatgttacagtttttaaagatggtgtgtccggagttcattccttcagatgttcagatgtgtccagagtttattccttctggtgggttcgtggtctcgctggcttcaggaatgaagctgcagaccttcctggtgagtgtcacagctcttaaaggcggcgcatctggagttgttccttcctcccgtccagagttgttcatccctcctggtgggtttgtggtctcgctggcttcaggagtgaagctgcagaccttcacagtgagtgttacagctcataaaggcggtgcagacccaaagcagacccaaagcttccacaaagaacaaggcttccacagcctggaaggaaaccccaacacgttgccaccgctggctcgggcagcctccttttattcccttatctgaccccacccacatcctgttgattggcccattttacagagagctgattggtctgttttcacagggtgctgattggtgcatttacaatcctttagctagacacaaaagttctggaagtccccactagattagctagacacagagcactgattggtacatttacaaaccgtgagctagacaaagagtgctgatcagtgtgtttacaatcctttagctagacacagagtgctgattggtgcatttaaaatcctctagctagacataaaagttctccaagtccccaccagattagctagatatggagtgctgattggtgcatccacaaaccctgagctagaagcagagtgctgattgggtgcatatacaatcctccagctagacaaaaaagttctccaagtccccacctgactcaggagcccagctggcttcctctagtggatcacgtgcaggatccctgggctgagctgcctgccagtcccacaccaagtgccgcactcctcagcccttggggggtcaatgggactgggcgccgcagagaagggggcagcgcccatcggggaggctcgggccttgcgtggggaggggggttggggggcagtgctcctgcatggcaggctaagggtcccaagccctgccctgctgggagacggctgaggccctgagagaattccagcgcagtgcccgccggccggcactgctgggggacccagcgcaccctctgcacctgctggcccgggtgctaagcccctcactgctcggggcctgctgtgctggcctgcggctccgagtgcggggccagccaagcccacgcccacccagaacccgcattggccggttcccacccgcgcctctccctctacacctccccacaaggaaagggagccggctcctgcctcggccagcccagagaggggctcccacagtgcaacggctaaaaggctcctcaaatggtggccagagtagatgccaaggccaaggaggcaccgagagcgagcaagggctgctagcacgttgtcacctctcaatgagatgcagcaaaagcagttctaagatagaagtttatagcaatagacacccataataaaaaggaagatcccaaataaacaaatgttacacctcaaggaactaaaaaaaaaaaaaaaaaaaaaactaagcccaaagttagcagaagaaaggaaataataaaaatcagagcagaaataaatgaaatagtgactgagaaaatgatagaaaaaaaatcaacaaaagtggctttttggaagttaatcaaaatggacaaatctttaagtagactaataaaaaagagaaagactcaaataacattatgaatgaaggaggggacattacaactgataccacagtaatgcaaaagagtataagacactattatgaataattatatttcaataattgaataacctagaagaaatgggtaaatttctagagatatcacccacccagattgaatcaaaagaaagagaaaatccaaacaaactcataatgagtaagaagattaaatcagtaataaaaagtctccaatcaaagaaaacccaggaccagatggcttcactgcttaattttatcaaacatttaaagaagaattaattccaatccttctcaaactcttctgaaaaacattgaagaagaaatacttccaaactaatttcatgaggttagcattaccaccataccaaatccataaaaggacactacaaaaaaataaaattacatgccaatattcctggtgaacatagatacaaatatcctcaacaaaatactagcaaaccaaattcatcagtatatttaaaggaacatttatcatgatcaagtaggatttattccagagatgcaggtatggttgaatataagctaatctagaaatgtgatacaccacattaacagaataaaggacagaaaaatatgatcatgtccatggatgaaaaaagcatttaacaaaattcaatatccttttgcaataaaaattatcaaaaaattagatatacaaggaacataccttaacacagtaaattccatatatgacaaatccatggctaatatcatactggatgcctctaagattaggaataagacaaggattcccgttcttttcggttctgtctaactaaagtgctgtaagtcccagccagagcaattaggcaaaagaaaaataaatggcatccagattggaaaagaggaagtcaaattgcccctctttgcagatcacatgatcttataaatagaaaaaattagtgacctcactaaactactcttaaaactgatacattcagaaagttgcaggatacaacatcaacatacaaaaatcagtagtatttctacagactaacaacaaactctccaaaaaagaaatcaagaaaactatcccatttataatagctacaaaagcaataaaatacgcagaaataaatttaaacgaggtaaaagacctgtggattgaaaactctgatacattgataaaagaaattgaagaagacacaagtagagttatcccatgttcaatgattaaaagagtttatattgtttaaaatgtctgtattattccaagcaatctacatattcaatgtaatctgtattaaaatgccaatgtcacttttcatagcaatagaaaaaaaatcctaaaattcatatgcaagcacaaaagatgctgaatagccaaagcaatcttgagccaaaataacacaatcagaggtatcacattctccaatttcaaaatatactacaaagctatagtaatcaaaacagtgtggtactggcataaaaacgtacacaaagaccaatggaatggaatagacagtccaaaaatgaacccatgtatatatgatcaactaatctctgatgagggtgccaagaatagaaaatgtggaaaagataagtctcttcaataaattttgttggggaaaatggatatctacatgcagaagatgaaattagacccttttcacacaccatatgtaaaaatcaactcaaaatggattaaagatgtaaatcaagcaatacctgaaactgtaaaactgctagaagaaaacatagaggaaaatctccatgacataagtctgggcaatgattttttggatatgatctcaaaagaaaaggcaacaaaagtgaaaatagacaaatgggattacattatgctaaaaagtttcttcacagccaaggaaataattaacagagtgaagagacaacctatggaatggaagaaaatattgtaaaccatatatctgataaggagttaataccaaaaatgtatgtgaaactcctcaatagaaaaaaacccaaataacccaattaaaaaaataggcaaaatatctgaataaacatttctccaaagaagtcatgcacactggccaacatgtatatgaaaaactgttcaacttcactaaccattaaggaaatgtaaattaaaactgcaatgagctatatcaccttatacctgttacaatggctattatcaaaaggaccaaagataagtattggagaggatgtggaggaaagggaactcttgtacactcctggtgggaatggaaattagtacagccatatggaaaataatatagaggtttttcagaaaattttgaaaataccactacaatatgatcttgtaatctcacttctggatatatgtccaaatggtatgaaattagtatgtcaaagagattgcctgcattcccatgttcctcacagcattattcacaatagccaaaatatggaatcaaactaaatgtttgtcaacatatgaatggctaaagaaaatatggcatatacacacaataaaataccatttggtcttaaataagaaggaaatcctgtcatttgagatgacatggatccacctgagggacattagtaagtgaaataagacaggctttaccacatgatctaacttacatgtgaaatctaaaaaggttgaaatcatagaagcaaagagtggaacagtggttaacatgggctgtgggatggggtggagttggggaaataatggtcaaaggatacaacattgcagctggataagatgaacatgttcaagagatctattgtacaacccggtgagtggagttaatagaactgtattcctgaaaattgcttagaaagtattttgtgttcttaccacaaaaaaatgttaactatgtgaagtaatgcatgttaattatctggattcagcctttccacaatgtatacatattttaaaacatcatgtggtacatgataaataaacacaattttatttgtcatttaaaaaattacttaaggtttagaaagtagaaattagaatagttacctctttaaagatatttgcacaattaaaaagatttttcatgtttcttttttgaaaagtaacatatatacaatctagtactaaaccttaacagatagttattattttaagacgacagaaatgtgaacattttacttctgatgaagagaatctataagagagaaagatggtgatgctaaacaaatgagaaattataattattaaaatacaacaaggtatctgggatagaagcaagacaggtggaaagattcactcatgctttgccctgccaggagggaatattccagtataatgggcagaaaggaagaaaacatggaatgaatgcagtatgattaaaagtctggtgataggataaggatgcatctctagtctagtggcttcaattttctcagcaaagtaggaggacaattctgatagtaaggaaggaatggcaggattttaggtttgagagggtgaagcgggtgaaagcactgcagagacactgagggagataactaggaattacagaagaattgccaaagagcattgaagtctcaaaactcatcttaagttggataagtacacaattttaggagcagtgataggtaaatggcagaaagtatatacaagtattaagtaacttcaggctcaattccatccaccgaaatgttgggacttacagaaaagcagattcaatatggaagacgtggctcatatctgtcataggaataacagaagaagtagtagtaaacgtttattgagtacttactgaatcttctgtttaaatgttttacataaattttagtacacggccagtaaatagtgttattattttcagtgttctaatgagaaaaccacagcacaaagaagttgagtaattttcccaaggtcaaccagctacaaagtgcagagttttaaacagtgaatccaatgcatgtccagagaaaagtgagcaggacagcaaaggatctctgcaatataaggaagaattagataattgaggatattttgcctaaataagacaggcagcagcaaataacgattgcttcaatacttaagtagttgctatatggaaaaggaattagagttttacattatgtttcttcagggagcaaaactaaaactaatatgcagaagctgcaatgaagtagatttcatctggaaagaatgatttttgtagccatgagaaatacaggtgaagtagaaggagcagcttcagaaagtgaagttccagtgaccaaggagtttgagcccagaaagggatgttaggaaggactttatacataggtgagagaggacttgctagtttatgtaaagttcaacacccattctaacactgaaagtctgcctctagtgtgcattttattaaccccaataaacatttacttttttattttctccccagagtaagcatgttggcagatacatgaagcacttggatccatgtcatgacaatatttggatataacagataagacataatgctttgccaggactgctagacctgggctttcaattgcttccagggctataataaattcagatgttgggggaagagagaggaaaggagagagtgctttttgttgttgttttttgtttttgtttttgttttttgcaatgtagccccttcccaagagtaagaaaaaatattcttctgacaattgtaaagctgtttcctgccaaaattgtcattgttaaaacttttaaaagataatccatatgtccccacacttcatactcttgcactttcatgcaaagagctcaaataagaaaatttgaagtttttctctgagtagaggtcagtgtttctgatgcagtgccagttttaatgagaagattttattttctctctctcttaagagaatggcacgaggaagctacatgttaagaagttaagatggtctctacttggacctgatgctaaaagaaggttcatgccatattttatttgacattgtaatcttgatttggctgcccaatttattgaaaagattaatattctctacaggttttagatagcaaattttaagttttgatcctgacttgccttagagagcctttctttataaagcagctctcgttctttaatcttatagcaaccttactgtgttcttgctcctgttcttcaatgtggtattgtttgtttacctgtttgtgtagaatgttaggatgccacagttaaaaacaacacacatcccaattcattatgatccataggcatcacatgctgccactaatatgtacggtaaagcttacaccatccaatctgaagcaaatgacaaattcctgactctttatttcaggcacttctctccttgatttgtcttcttcaacagctgtcatctttgcaatttctcccaaatcagaccctatattactgagcaatgtacttgcacactttcatctttgtaaactactgcatgtctgctgctttataatttttattttattaattgagaatagatttccacccatttttcaataacatgcagcaatcttagtcactaaatattgtttaaaataaattctgcaattttcttacctgaaaatcagatagttttactttttgcttcaaattattacaaagctaccgtatgggaaggcagtcgtgcaattaaaccctggttattaagaattttgagagggaaatcgaacatggaaatatcacagctgaaatatttacacttaagtccttgtactttttttgctgattgttggaagcaaacccaatcagcaattttggcagtgagtagctatagtgtaaaacaaagatggagatgtggatacttatcatggagatgtgtgtccctttcaatttggtctgtctgatgaacagggagagaaacattgctactttattgttttggttgttattgttttcacaactttcacctaactctagtactctagtaacttgtctgggagacctgggcttgagtctgatttccatcacttgtcaatgactagaaaattctctctctctctttctctctctctctctctccccctccctctctctctctgcattcatttcttcatttgaaaatgaagagctagattggatactctctaaaatcctttccagctctaaaatcttgtttttatgagacactatttctggaatgagcaattaagaaataaataaataaaaatttaagtgatgtgataatcaagattatgtaactaaaaagatatgagagaataaattaccttttaaaattcctgaacaactcagtgggggaattattctgcctcagtgaaaatataagagaggaggtcaatgttctgtgttatcacataattttgacaaagccaatgagtgaggctaccgttaagtgccagcattggagagtttgcatgcaaacacaaaagaagtaaaaagcggaaaaaagaagaggtgtgacaaatggaaggtagcctgatcatctgcctgcagcctggccttctctctcttttctaaaatattttttggagacagggtctcactctgttgcccaggttggagtgcagtggcctgatctcagttgactgcaacctgtgcctcacgggttcaagcgatcctcacacctcagccacctgagtagctgggactacaggcacccacgaccacacctggctaagttttgtaattttagtagagacagggttttgtcatgttgaccaggctggtctcaaactcctcaagggatccccccgcttcagcttcccaaaatgttgggattacaggtgtgagccaccatacccagcagtttttttcttctcagtcatattcattcatttattcactcattcaacatgtattcactgaatgaatatttattaaatgcttatgatatacctgaaactcttctaagaactgggactatatcattgaacaagaaaattttccataccttatgaactttacgttttagttagggagacaaaaaataattaagaaaacacacacacacacacacacacacacacacacacacatacgtgtagttcaatttaacttcagatatacaatgctcaaataaaaaatgaagcactataataagatagaaactgactaggtatttagatggagagagaaggtctctctgaggaggtaactttgagtagagacctgtataagtgaggaagagaaccatacaaagatttttagaaggagctaaagttttatttagaaggagctcagttttgtaactgagatctttgcttctattatattttctaacaggttgttgtgagaaaagacttagaaagacctattgtgtacttacaaggaatatttaaatgccgaaagtggagctgctatggtctgaatgcttgtttttttacaaatattcatatgtttaaatcctaacctccaaggtgatggtattaggagatgggacctttgggaggtggatggttaatgagagcagagccctcatgaatgggattagtggctttaagaaagaggtcccaagggagcatgtttatctcttctgccatgtgaggacacagttagaaagtattatctatgaaccagaaagtgggccctcaccagacatcaaatctgcccgagctttgatcttagacttcccaacctccagaactgtaagaaataaacttccgctgtttataagctacccactttatggtattgttttatagcagcccaaatagactaagaccctaggagatttaatgaaaataaagtacttctaggatctaggagtcaaaatatcattatgacaatattgacaatattcctgggttttttttctttttcatagtgacagggtctcactaagttgctcaggatggtctcaaactcctggtcttaaaagatccttctgccttagtctcccaaattgccggtattacaagcatgagccactgtgcccagcctattcctcattctaagagagaatagggaattaacctatgcacatgggttccaagatcttacctgcccatttgctcatacaactggtgactgctcattgactaaaagaatggagaaaggggctttgctctatttctacttgtgtacctcaagatgccagtgtggttcttctgtgagatcactaaaatattagttgatagtcttttaactcactggtttttgatccatgaggcagataagatagcctaatttgtgatatgcctccaacctcttaacttgtgataactctaaggttaggtgggacatccatatttctttagggacaaccttcatactgctgtagttcttagagttgtgctagagagacaaagttatgggattgagccttgcaaaaatcagtgaccaacttgtcatctcataaatatgtggttggttacaaaaggtccctgataagaaagtatgaatgcatacaaaatttatcataaattccttcaacatagaaggtatgctttttgcccaggaattttaacttgttatttcttctccctagaatgatttctcctcagctgataatatgtatcacttctttaattcttttcaggtttttgctcaaactcagagaagtcttccttcacttccctatttaaaattgatctctactctcattatcccatatccccatttcctgctttattttctctccaaagcacttatcaccatctaatatatttattccttatttattgacttttgcctattgaaatgtgagctccatgggatcagggatttctgtatcttttattcaatattttcccaaggcctatggcaactaatattggttaagtgaattaatgagttcttagtgtgtttttgttagagtttggtatattaagtgctcagtacagtgcctcgtacatagtaaatactgaataaattatagctataattattattcataaaccaactgaaatatatattttttgatactaaacaattagatcagtcatgttagaccattcatatcactattttcattctgccaattttagaatctaatattatattagtccattttcatactgctgataaaaacatgtctgagactgggaagaaaaagaagtttaattggatttatagttccacatggctgggaggcctcagaatcatggcgggaggcaaaaggcacttcttaaatggtggtggcaagagacaaacccctgataaacccatcggttcttgtgagactgattcgctatcacgagaatagcatgggaaagaccgccccctatgattcaaatccctcccacaacacgtggggattctgggagatacaattcaagctgagattttggtgaggacacagccaacccatatcaaatgtcattttctttttaaacctcttaaaacatttatattagttaaaaataatttcataaggcagaagaagtaagtcttgaggtataaagcattgatctctactctcatatcccctcttggtctccagggttttaagtgcaccaaaacaaaacaaaacaaaaacaaaataaaaaaccaacaactatgtacaatgtacaccttggccactattgctggaaggctaacttttattagcctgaaggttgttgatgcaggctttatcaccgaagagattaatgtaaaattgctgagagtctgccaacagggtaaatgttcccagagagatggcaaaagcagcaaggtaagagatttaagtgcctcaacatttcttattaatttttagtgaaaatgttaaacagtcgaatcaacgtatggtggaattacaattcagctcacagttagtttgtaaaaatttcatgcagcttcaaaaagtctggttcaaaaactggtgcactgctcaccatccatacacattataaaattaaaaagttctggatgccgcaagtgacctctacatttgcagttgttaaatccaagaactttagaaactagaaaacatatgcttaaaaacgaattgttgtttatctaaaattcaaatctaacagagtcttctctattttatctggcaagtctaattcatggggaaaatacattctactaaaattctgctgctaaattaacttttcttaaaacaatggagacattggtatccttaacaacattaatcaattaattaagacatacattcttgcaatgacaaaacatatacaatttgcttactggtctctctgaattcataatcactaactttaagagggcgtttagcatacacctgcaatcctactacattttgctggaacttccctactgtcctagatgaccatctcctaacttttcttcacctcttaaatatgcaacaaccctaccattttcttttgtttttgcaggtacactttcttcccctttcattaacaaatagaagcaactggaagagctcttctacttactttctcaacatctattcactctctcagtctatgcccatggccttccttcctctgtcctttctgtctcagtcctaaggccaatccttcctcttaagcaccagatcccatctccttttgcctcttaggggtatttctactacaattgttgtctgcttccctccttcaagatcctcaactttatcttctctaatagattatttccatcagcattcaatcatgtagcaatattttcatctgagagagagagagagaaggaggggaggagggaaaaaacagggaaaggaaaggaaggagaaaaatgcctcctttggtctcatatctaccttcaagtataatttcatttatttgtttcctccttcacataaatcctgcttaaaatgtttacctacttactactttcaattcattctatggtctttcctcccttgaacccactccagtcaagattttgacccttcttcactgaaattgcttctgtctaatttaccactgacctccaggagctgaatccaatggcacattcttcgtcctcaccttaattgctgtatgagtttcctagagctattataataaagtaccagtcttatcttactataatctattctctacacaacagccagaatgatctgttaaaaggtcagatcatgttacttctccatctaaaacctctaatgattcccccttttttcagaataattaacaatgtccttacaatggcctaaaagctggcccctccccagtcatgaccatcaactcccaaaccaatgcaccgttccccttatgtccctttcacatacctcagaatttactcttcccactctttgggaccatcgtcctccaaatttgtccaggatattttcatgactttctcacttagtttcttacttctatgcaaaaatgtccacttaaaaaggtttttgccttttacaaaaaaaaaaaaaaaaatcctcaccagtaacccaattatgcctttcccactttgcttttcacctaggcttaagaccacctgacacattacaaatgaataaaagcaattattttgtatctctccagtttgctgcctttctctcccactctactggaaactaacttctaagaagactgagatttttatctcttgttttctattgctagtgttgaaagaatcactgaatcaatcagaacataactctaaaaagttaatcagagttcagttctgtacaccaagttaaagtcttgtaaccagtgaatacctagagcaaaattaagaaaagattgtcctttagaatgcagaaacttctgcatacttataaaatcttataaaattgttacactgtgaattaaacatagttttctcctttttaaattagcattagtctccaaagaattttttctagttggacaaagactgctattacttatattttctctcctttgtcaccttaaagagtaaaattttttgccagttattcttttgtttcccttaatataagattagaacctctgtagccatttcaacatacaaattcagcctatatctctcctgccaaatgtcttctgtactaattttatattttatattaattttttatcatatacaaaaggttaatcttttatacaaaagattaatctttattctgtgtcctgctgaatacttatcagaagtttaatctcccccagacacttttatataaatatttatagggttgacattgaataataaaatgaaagctcctgatactcttgccctgtcacatctcaaatagtttttttaaaaagtgtcaatcagatttatagcactaactaagtcacataattgagcacagcttgaagaccctaaatttaccaaccataaaaggaataattttaggaaacgtttggagctctgtatgtaagttactggcagagaccttcatgaatattggtcccatctccatgcagagaagagaagatcttggcctctgatctagttgtggggttggatgaagctagcctagtagttgtgagccttgtcaggccctttgggaaatgacagatacaggctcattatctttggtgccatgactacgacaagcctgaaatctagaaacatgactattaactgactggaatcatctaggtatgttccgtctctcctactcttcctggtagggagcagaacatagcattcagcccagaagctgatgttgctaggaagaaaaatcccatgggaaaaaaatctctctcactgatatttctcactgggaaatgctcattgaaataatgcctttcaggatcctttgataatattattcaattttgtccttacgacaatattataaagctttgctcatccaccctggctgaatatgagtcagctgaaaaaattaaaaaaaaaaaaaaaaaaaaacagagatccagaccttcctacaaactggataggacccagacatctctgttttgtaaagactctcccagtgatttaatacaaatacacagagcggataaaaaattatgtaaaaaagattggctgggccaatgtagttactctgtataacaagtaagaaaacaggtcagacaggttaagtgacttacccaaggtcacactgccaacacaaggtcttctcttgccatcatatcatggtgccctctcccagcttccccaatttctactatttcatataaattttctgccttttcagttaatgaagcttacttcagctcatttcagctcagaggagaaaaacatgaacaaaattggactaaaatgggtgtaagaattggttcatggaggataaaaagcattggatttctgccagacccttcaggatgtgaatcagtcaaagaaatcaagtcaacacataataataacaacaaaagcaacaactcttttggtattttacatagtaaagccctttgcatgctgtaatttcaataatgattcctgcaaatgcaaaagtcacacaattttatctctgtctttgtattcttttttatttcagacattctttgtataggcttagatttaaacaacataaatatctgagaatctttacccaatcatgagtctgaaaaagtcaattgatggattcttataaacattgtctaacttccccgacccatctgtttcaatgccagcataggccagtaaggccacatttgtccattgaggatttaaaggcctgatgttctaaaagtctgaaagatcctcagctgtggagagatgacagtgtcagaaattcctgactagcaatacttttatatgatcataacttctttttaatcataaaacacctcttttgttttataaattttttcccttcacctttctaaactattctcagagattacactttccaaaaaatgatatttttgtcacatattacaactcaagggccaaaacagctggtttatgacttataagtactttgtgaattgcttgagctggtggggaaggttagacaataggaacgaagttttcctactataaatcattgagtcacagaatcttagctttctagaactagaaaagataaacacaatctaatataagtccaacacattgcaggcgagaaaacaggcccctggatgttggtaaccagttggggccaaacagggaattctggacagagcagacagtagaagccaagttcgtttgccttgactcccatgtattttcctaagccagactgtctactttggagtatgagatcctctgagcacatctaactctgtcttctccttcaagattcaattcatttgctgcctggtattacggaatttcaggaatgaaagagatgctaaaatcatcctgtccattcagggtttgacttttttctaccatggtccccaccacagggtcaagtactttagtaacaaaactcctaatgaagcagcctgttccatctttggatactttggattaaataacttataatatttagctaaaatgttttcctaaagcaactgttaaaaaattgatcacttttgtcatataagagtctcttatatacttgaacataggtataataaggacaccttttttgcattttccccagaataaccattgcttgcctttaaaatttcttcatgttgtgccatcctaattgctctcctttatatgccattaggttttgaaatatgtcttaaaatgtggtattcagaattaaacacattattgtaaggactgctaagaacagaatttttctttcttctttctagaatattctctattaaataaagcccataaatgctcaacaggagtgatatcacccccaagaggctgaaaactggttcttggggaaaaaaaacttacttttttaatgtataaagcacatataatgtacataaagtacattaacagatatgttatgtacttaaatatctgtggtattcaaatttcattggggaagtgatcagaaaaaaacatttttagggactccttaaagggataatagttttttttaaaaaaaggctgtgaaacagtgatatagcctaagatcacactagcacattagctattttatcagagaatcatactattaacccctattgagtttatagtcaagcacaatccttaaaactatctatctaacctacttgtacaactgttgaaaggtattttcactaccgcgaggtttccagtgtgtttggttggttagatgattggtttgtttttgaagagtagtaattttttttttgcctaattttgttactataagagcacaaagttaaatttatttctgataaaattgcccttgttaggttttatctattcccgcctgtccagatattttggaatgtaatacattcattattttctgaagctctgattatttgcaaattttatctcctatcatcttgattgctcatgccagtaatttgcagaaacaacgttaagagaacagagctgagaatattgtcccgcacacaacttttccattttgtgttaaagtatcagcagtatgttttgactaacatttcttcatcgaggtattaatgttactaactgtacatttccttacataaaatccatagttttctatttttttttatttgtacactctgagaaagaatgtcaagtgtctcacagaaatccagattgcctggctctagtatactttctaacagcctagtaagccaagtgaataaagaagcaagatttagtcttttgtttttctttaataattctgtgctggctcactctcattacttcttcaatttatctatacttaagaggttctttttagtagtctgtacagacatctcttcccagcacagcttaaatattctattgactgcatttctccctataacagtatttgtcagttacatctagttggctcttgctctgtttgttttcatgggcatatgccttaacttttcaaaaaagattataaactcccagggttgaagcatatactcttatagtgcccacagctgcccattaaagtatcacagaagatgataaaaataaattgtttgatttactaataacaaactactcactatcaaatcagattgatgaaaggatcatgaatcattcactcacaccctagcccaggtttacagattgttttaaatgcttgcttctaataagggtgtattaaaagagttaaatgctttcttctaataagggtatattaaaagagtttctttccaacactcaatttactaatttatcactaagaaatagcgtttttgctaagtaataaggaaattaagaactgatgatggaaaaggaaactatataggggaatataatgggaaacataaaagggaaatatgtctgcaaaaagtaggattacaaggtcatgtttctttagaatgaggagcctgtttccattttcacaaattaaaatcatttgaaagcacatatacttatcaggatgggttcctaaaacttttttctcaactctcatatgtgtgtgtgtgtgtgtgtgtgtgtgtgtgtgtgtgatacacatccacatatatacatacatacacatatatattcaaagatatataatcttatatataaaatatattggccgggtgcggtggttcatgtctataatcccagcactttgggaggccgaggtgggcggatcacttgaggccagaagtttgagaccagcctggccaacatggcaaaacccgtctctactaataacacaaaaattaaccgggtgtggtggtgcacgtctgtaatcccagctatttgggaggctgaggcatgagaatcacttaaacctgggcggtggaggttgcagtgagctgagatggcaccactgcactccagcctgggcgacagagtcagaccctgtctcaaaaataaataaataataaaatatctcacatatatattctatatatatatatctcattgtgcaaagttcccaaattagacattttgactacattaaaaacacaatgactacttggataaaaactggattaccaaattatctaaatgagccatttgtgtgctatttgatggtggtatatttttatatcttggatattatccatatactgaatatatatgttccaatattctaaatctctaatataattcaattacttgaaataacatattaaataatctgagagagggcggagaacgaattaagcctcaattatttttacaatatgctgtatgcttggtgttaacacaggtgttcattcattattctcaaggcctttttgtatagctaaaatatttcatattataataagttgtgtgtcatagcagatcatgttaaaagaaatctaaagttgcccgagcgtggtggctcacgtttgtaatcccagaactttgggaggccgaggctgatggatcacttgaggtcaggagttcgagaccatcctggccaacatggtgaaaccccatctctactaaaaatacaaaattagccaggcatggtggcatgtgcctgtagtcccagctactctggaggctgaggcacgagaatcacttgaaccgggaggcagaggttgcagtgagccgagatcacaccactgtactccagcctgggtgacagagcgagacttttgtcaaaaaaaaagaaaaaaagaaaaagaaatctaaagttaaaaaataatctaaagtttccattttgccattcaactgccatgtttacccacagctcctcttttctggtagctgttttcagttaaggaaagggaacactgggtggaggatgggacaggaacactcctttcacagagggctctgcatatagcagtccccttgagcatgaattttccaagctttgataaaatctattgaggaggtaaagagaggattcatctttaaaatattgtcaatgtatagttaattaaatagagtttattctgctgcaatcttacagccctgagaggtacagaatgctgaggttcataaatgctgtcagcaacacagtgaggcagtgagggtgaggagaggaaggggggataaaaacaattgcatgaaaaatagaataaattttgagatgtcttctaaatcaaagctcatccaatatggagaattgaaaaaaaattaaacaaggaacatttgagattcatggtatagaaatctccctttccctaaacattctttaaggtcttctttcaattatttctgacagttatggcaacatattatgagagtaatatgtccactatgggggggatacgcattagttcactattgttgccataacaaattaccacaaacccaacagcctaccacaacataaatgtatttgttctcagttctataggtcagaaatctggctgggttcagctgattcctggggtctaaaaggtccaaatcaagttgctggccagcctgggctcttatttgaaggtctgagcaaagaaagtacttccacgccaaggtcagtggctgaattcaattccatgctaccatagaactgacatctcaatttccttggggctcttctccagggatggttcttaacttccagagatcaatcactttccttggctcagcgtccccttcctccatcttaaaggcagcaacaataggctgtgtccttctcacattttaaatccttctaacctccccttctacctcttctcttctaggctcccctcaccgactgatttttctgttctccgattctgcccttaaagggttcatgtgattacattgatctcacctggataatctaggctaatctcctttttctttaaacgtcaatgattagtaatattagtttcatattcaaaattccttcaaaacattacctaggttagcatttgattataaccaggaatgggaatcttgcagagacatctgaattctgtctaccacagggtgtgcccaccagattcaaacagacctgccaaccagaaattggcagtttgatttatatttctcagtctatgaaacataacatttctctaaatgaagcattcttaaatagtatttgattactcaagtggataacttcatggctaatgataaagcttttctattagaagtttccattaagaatgcttttgtttgagttgttttgtgttttaaaacaggacttggatttcttgggagaagctgtttaaacaaaggagagaggatattatttgattacaattagagatgtctttttgtaggaagcaattatcagtataaattaagaaccaaactgcaaattcaattattcctaagtatttactagagaaacattagtttaactgtaattcttctggaaattaaccccataaaatatgttataagagcattaattgcatttttatagttaaaatatgacgcaataacaatattacaaaagctatttgatccatattaattttgtacaattgctgaaaaccatctattgaaatcatttttttaatatttgaattggagtgcattaggttactcctttgaagatttatgcattacccaagaaagagaaaaccaatttttaaaaataccaattaaatgaagatactcagttaaattaaaaaataattctaatgctccaaattcttgctgtgaatttgcttattgtggaatcagaacatatttgaaagaatgaaaatggccgattttaaagtacttttgaattttctgttacttttcttgttaaaccctaaatagttataataattgtaatgaaaatgtttttagttactgacctccacatgagtggcaacatgagtttcacacagttacatatattcagctgataaaccaggtagtaaaaggaaatgattaagatcacaggactctgaagtcagactacctagatttcagtcccatttgtcactttatctgaatggcttgaggcaaattattcagcctctctatgcctcagcttccttctgtaaaacggggataagagtagtacacattactcccagggttgctgtgaggataaaataggataatacatacaagtaaatacatgtaaagtcatgtaaatgtttcatagttggtatggactaaataaatgctggttattattcttgaagtgatgtccaatgttaggccctagactgacaaactgagacctcaactcttcaaacctgtcagcattaggatatagaggcaaacagccttggcctcagtagaactgacctgtagtcaagtcagctgatcaacagagagaatggaggaaggggctgaagagtccctacagaactccagcaattagctctgtactcctactggctagctatgttttcaccgctacaaagatgctatcgatatatccctcatcctggccattcaccttggtcattcattttttatcaaaaaaaaaatagtgagtacctaacaaagttataggctctgtgtgaagaagatataaagagctgaattttaaaattataagattttctgctcttacggagttcacagtcttgcaaacaaacactagcaaccccaagccatccttccttttgactcactgatttaaattgaacaagaaagccactttcctattgaaagtaataaaaattagggaaaaaagatgaaaatggtatcatgagatgtcgaagttgaggtgctatcaatgctttgggggttatgtatcaaaatttccttaagacttttttacgacattgtcactcacagttttattaaaacagacactcaaaggaaagctatggaaaaataacacagtgtctctggttcctacaaggtatttggttatggtgggagaggagacgtaaattacctctttacttccacatacccacagagaccctccatcacatctgcttttctccacccacccgagcaacacccactatcttaataccaagtgctgtataatcaactgagttaaactattttcaatttaagctcaagaaagtttagaagagctccttaaggagtagcagtttagatccaaaaagctcttaagattgatcagccttctttcatgcagtctatattctgagggtctcagaattttaggcttagaagaaaattttaatatataataaaattattttattcttctaaatatttgaataattttctcaaagccatatggatgttagttgcaaatccagatctgggccttaaattccatttctatttcaacttctttccacatcagcatgtattataattgaatataatgggcatttactactgccaaggatagattctaaagtactgattcaatctattgctaatgaggcattaaatgtccacagctgataacaaatagcatgaaaaatatttgaaaacagaatttatcaccatttagcaccactttagtcagattgcataccacctttgtttatgtattccatcatgcttatctctttgttaaagatttttgttcgttaaatcaccatatagacatattacatacattaatgaaattataaacttgactttgaagttgatgtagctaaaaaatattgggaaaagagtaaaagattcattaagtgttgctaaattgtaagtggttctatgttatgtttccaaacaaaagaaatcgtctacattacaacattgtaaaagtaatgaccacaaataaaataacactttaatacaccaggcttgctccaatactgaaatttttcttttagtttaagatacaaaactcctagacacttgtttattaagaatatctttactggtggaaaatgatatatttaagcttccaatttatgaataattaaattcctatgattagatataccaaatacagccacatcgtcaaaggatatactacataatcttaaaggcaatgaagattagatatgggccttattatattcatcatttcaaagaaacatcaaaagacatctgaataaaataaacaggagtttttatttttatttttatttttgcttgtatcaagaactttctgagcacactgtctggcaaatttagagtgtcagattagaagttcaatggcaatttgattcttgtctttgtaaacatttttacattctaccaggaagtgtataggtttttctttttattattgaaatttagaaatctcacaataatatctagatgtgagccttctttcattatcactatactaactcagcacttgttaattttttttttggtctgaagcctcaagtctttagctcaagagagtatcttctcctgtgactattgtttctcctcaatcaattccatctattcttataagatttatgtattgggtgttagtgccaagattctctaatatttgctgagattttctaacttcttcttttaaaatctgacatatgggataactccttgggtttgcttctgatttttattgatagctgttgtgctcttttcttgtcctagtaagggtttttatttgcttttgggtttttttgttgttgttcttttattatttcttcaaaacaatggtcatcttcttttcagtttctaagtccttggtattcagtgtatagtgtaattaaggttatgggcactgaatgtaggtctttctagagccttgggttagcactttcctagctattttaccttgggcaaggtatattaactatgcctcagttttctcaccacatagagataatgtgcaataatcttcagtaatattaccctattgctcctttgcatagcagtgtgtttgctcttttacagagtgaagaaaaaaaaaacctcccaaatatcaatgaggacatcaattagaattctaaatcattatcttttgtctacctgtaatatctatatttcatttgttctaattcccagctttatccctattctctccaatgatgggtaatactttattatctgttcatatgtatgcgttcagcgttagattgcccatcctagtggttgatacgggctccctctgcttaggccacctttgatgtcatgaaattgctgtgttcagggcataaagaggaacagaaaggttgatttattcccaggtgcatatgctggaaatgaacctgatacatctgtttcaaagagaaaaagcaaagttaaagtgggtaggaaaagctccaactgcatttagaatgccgatgacaccaagtggaagaagcaccagggcaaatatttcagctatcttctctctgcagagctctaataaatcctagagggcctcttgtgtgattctctctgacattcccactctttcaaatgggggttaaacaacgctacagcttcccaagcataagattcccacagttttctgctggaaagactgtctacttgcctctcagggcttccttacctggtttatattgagcaaaacaaaagccattgtcagctccttgattaaacccgatccatctgctgctgcttttttttttctttttaaataaattactgaaagagtatgcttgcttgatgttacccttcctattttctagtattactacatacctttttgctcattttgtgcttctttagtcattttcatggggttaagatatgaagggaagaaaaaaaatgagttggtttaacttcccatcctaaagctggaaattatattttggatcttgaaaataaccaaaatattcattatttttatggcagttgagttagtcgaggaacagattctatgtaatgtcatgttaagttgcttatttagctaaaatgatgcaaagtaaatagctgtcaacatgattaaaattacttgcaatctgaatttaattaaattgagaactatgttattttcctactttctccaacctctggccacttaattagtaagatttacttttagttcatctcaaaatttctgtgcttatggtcaagagtggttatgtgaacaactcaaaagagacatccagcctgaatcatttttattggcacagataccattatgtgactgtttgggttactatttgccttcttaattatattatcttcagcctaatacatgaaaataagatttcaatccctgtggctatgacagaatatttgggagatactatctggagaaagcaaaggctatgccacccagaaatttgaatctggaaacacagaagttgcaacctgactatataaaatcaaaaggaccaaagagaggtgcaaggtctcagagctattgtttacataaaaccagtcatgtctaaatcattggaagaaagcttttgtacaacggaggatttattttctgttaacataaataatgggaatttctacatgttagagttaaaacctttaaaacacacacacacacacacacaactgcaatttatcttattccttccaggttgtgaaatggactgggggaaaaagaaaacggtgacagagaaagaggttagactggcttgttctgtgtaggcaggctgtcaaaatggctgctgggataggaaaaggtattcaactttatgcagtgaaggaagctgtacagactcctcctgagcgtctgtgaggtcaaatgctatgcaccccaatctacttcctgaaattaatagccaggtgttatgctagttactgtaccttaatcattaattatgactgtggcagcaagagagaaaaaaattctaggatacatgagctagagtgataaagggaaagcatcaatcacgcatgacaggaaagccaaaggtaccctctctctgcctgggatactttcatttgtgactgcagattttctcctacatcagacttcaaacttcagagaaaccatttctcatagcctgcctctctctctttctccctctcacaaccagctatggtcctaggactcaggaggatgaaaacaaaataaaacacatttgttagtaatgccatattttccatgtactaccaccaggatctatttgaaattaaaggtaatttatacaaataaaatattcagtcaagagatgatttattcaaaaaagcaagctacagcaagaatggagtttagagtcaatagttaataaacattctggcagcacaggctggcccacatgccttcatttttctacaatgtcataaatgtgttgcatgtcatcttaaacaagtgggcagagcaggtgaatctccctcaaagtctcatggcacagtctagtatgttacaaatcttgataagcagaaacccaagccacattctggtggtactgagtggtcagaaatggggtatttggaagtaggaagaaatacattaatttagttgaatggaaggaaactaagttgggttctactttactatggtattgtggatagattacttgacttctctagcattggtttcctgtttgtaaatgactggtttgagccagatcaggaacccttattctggggtgacataggagcttcagaggatctggcaggaaactcaaattataggagaaattgttcagcatattatttaagtgttactaaaaaaacatacacactaaaggagtgcttctctaactatctgtagtgaagaattagcactttgtaatttccaatctgctatgaaccacctccttttaaaaatcatacaaaaatgaaataaaaaataattttatacaaaatagaagcccactttttttttaatcagactcaatagatataaaaatactccttcaagttgctataaagatgatatggtatggctgtgttcccacccaaatctcatcttgaattgtagcacccataattcccacatgtcatgggaaggacccaatgggaggtaattgaatcatgtgggcggagctttcccatgctgttttcatgatagtgaataagtctcatgagatttgatggttttataaaggggagttcccctacacaagctctcttacctgctgccatgtaagatgtgcttttgcttctcatttcccttctgccatgattataagcctccccagccatgtggaacctctttcctttataaggtccattaaacttctttcctttataaattacccggtctctggtatgtctttattagcagtgtgagaatagactaatacaaaagattttaaaatcttcctatcaacttgggtcattgtaatggactgaccagaactggaccataggtcaaactttgagtaacaactattctaaggttccttccagctataatcttaaaactttctatgtaaaaaacagatatccctatgtccattctgcctcaactcctcctgccaaaaccatacaatctcacttgccattgcattcagcactataaacggaactcaatctaaaggtccatcttccttgaaatgcaatgaaagattgtaaataataatgacaatgacaacaaaatatgctttcccttgtcactggtgattatttatgttccctgaacaacaaggataaaaatgagggaaagcctgtaggactacttaccactagaacctaggccatctgctccctgacctagtagttccctcatctatgcttttgtgctctcataattatcctgactcagaaagcctttactagcctttcccctattccctacctgcagtcttttcaagatccttactgcatttattgggtactcaaagcttatctattaagcacttacaaatagaagaggataaaattataattatttggtccctgtcacatacacacacacatgcacacatgcatacacatatatacatatatggcccctgcccttaagttgtctagagcaattcaatgtttataagtatgttatatgaagaatcacaacagggaatgcagaaggggcaatgacaaaagtcaaagttagacaggaagggtcacataagacttcttagaagaacacttttggggctatttcttgagtcatgactatctggtgatctggctgtaatattaaagaggcttagtcagctcactgaactattacttgcagttcttcccttcctttattgctacatatttggtctagaagtacattctttccaaagagtcgactcctctttcatcaagagtgttctaattaactaaggggggaaaaacatgtgtatgagagtgtgtgtgtgtgtgcacgcaagtgtgtcagttttatgtgtttggtgggagaaaggcaaagaatctgggagagcagcgcatgtaaagtaatgtttaaaggctggagaaggagggaccaccaggtcatgaagcttcttgtatatttccctaaggattctggattcatcctgagcacactggtgactcattaaaaggttttaagtaagggtgtaatatggtcaatgttttgtttttaaaagatcactctagcagcatgatgtaggatatctaggtggtgagcagggtggatctggtagtgccaaggtgttcatctaataattcaaatgagaaatcatgaaatcctagactaagtcagtagcagacaggaatgcgaagccatttcaatctgagacagatttgaagcacaccaagaaggcagaattactggctatgaatcatggacaaatgaatgaatgaatgatgaatgattttgaggatactagcttcagcaattgggagattggtgatttcattccctgaaagagaaaaacactcgtgtaaatacaagatgagagtgtaacaaacaagaattcagatttaaataagttaaattcaaggtgtctgcagaatgtttatatggagaagtctgttgggaggtagaaacaggagtctgtagttagaagttgggtctggactagagaaaataagttgatcaacagtaactgaaggcttgagatgggtgtgattacttcagcatgccttgcctgaggaacttcattccactccaatagatttgattttaccccagaagtattcttcatttttatcacctgtatgttttccttaataggcattgtataaaaatatactcttttttactaaataaaaacataagtgggaaaaataagctaaagggccaatgaggtacagcaatgaagataaagttggactgtgacttacacacaacatgcaaactacttgataccatttactgatctctggatcacactctgacactacactttcaagcaacaatgcaaagggtgacgaaatcgcaagttacatatttaatactcatacaataaaagtaaaccaatttctccaaaacagaattatttatgttactgtgagctgagaaaaatttctcctgaaggtcctcataagaagagcattcaccatattaatggtgagcagtatcttttttttgacacggattctctgtcaccaggctggagtgcagtagcttgatctcggctcactgcaacctccacctcccgggttcaagcgattgtcctgccttagcctagcctcctgagtagctgggactacaagcacatgccaccatgcccgactaatgtttttttttgtttgttttttgtttttttgtttgtttgtttgttttactagagatggggtttcactgtgttagccaggatggtctcaatctcctgacctcgtgatcctcctgcctcagcctcccaaggtgctgggattacagacatcagccaccacacctggccagtgagccttattcttaatcacatccccatagtgaataaaaaataatacttacacaattattatatccatcaatgtaaggtgatagtataataacaaagaagagtagaggaaaggcaattcaaaggaagaagaatggcaaaattctgtcatttatgtggacagcccatgtggattggtatgtatgaatgaacagcaacatttccttcaggtattcatctataatacttgggatatgggatgtattttatctcccaaactagactggtatgtccacatctgcctttccactatttaatgtccacaactttcttcaagatgcattcatttgttccttcaatagtcaataattttctgaactaaagtcatgaaggactgagtcttaaaggatacttaggaatgattcagacaagatgggagacagggtaggaatagaaacacttccaaacagatggatacgtagcatgaacaaagctaccaaggtaagaatgagcttggtatgcaaagaaatataagcaatttagcatggcaacaatgataataataaggcagagagaatgatgagagaggaagctaaaaaggtagacaggagagcattgaaggaattttttcttatctctactcttggcaaatacaactcttggggactgagatcatatgtagccttaaatgttgcataagctgtgtatatggcacagaggtgatctccagtgtctacataaactttgtggaatttcactgatgaaacagtttgtgccatggctggagaaaagcatttggatgcatatttattgactgatgtatcggatgtgatgtgatgtttgaaatatgtcataagagtgctttctagaagaattacccatttgttcattatgtaagagagaaattgtttctggtcctctagaataggactttggggagtgactgcatattaccctgactcattctgccatcaatgtgctggagtcaccattcaacaactgcttcaactcacttggtcctaagtttggcagctcaaaattccaacaacctcacagaatatacctggggatccaaactggaaacagctcattagattcaaaataggagggtatattttagaaaataaaatctagcatacctttactggctcttaaaaaatcagattggaataggtggtctgaaaatgaatttatccagcaaaccatattaaaaaacaaaacaaaacaatatcggagtcctggcctaaataaagtggttggttactacctccctcttcaatcaccttaggctcttgtagcaaaaggacttttaccatattagctgctacaagatttaataaggatatgatgtactatatccttcattttgctaggcaacgcaacattctaaataagattgaatgtttgtcaatatttggaagaggaacctcaggggtttctttaaaaatttcctcttttcctattcctctaagactgattttaacctaaaactgattttttcttttcatgtatacaagatacctttttgggggtttgtgtttatttcccctgaagaaggctttacagagcttggattttaatggaaatttattgctggatgtttgatagccaaaaggattgtgttttgatcacagtcaaaatggcaattttctccacagtagcatagcagcatactagtacaaggccactgcagctagaaacctgtgggcgtgtcaggtcctttgtagtgagtgtcagtagcacctgcaagagcccaatccctaactgtgctggaaggaggtttgatcctattaagtttcaaataatatgtcagcttttcagctttgatacaaattcctccagaattatctattttcccacttgtgatataagacttcgtgaaatgtgtaaaatctaagagggtctgcctcattttctgtgttgggagagctttggaatgacctcggactctgtcaagactagtatttcttgagctttccccaaaccaattaatcttttcatctgggggttatacaatgcacaataataagaattaaaggtaaaaattaaaagaaaataaagaaatcttgttgtataagaattaatgcaacacaaacatagaggccatctcctcaaaactgacctggatggctacagattaaaatatggatggaaggaccactgagaaaaaagacagacatagagagcaagaattaatctaatactacatgtttggtacacaaacaacaaatcaaattgagcaaattattttctcaggagattctctcaatcactgtattttattatctgtgaattccagtaaaatcctcattttctaggtggaggctttcttttttttttttatttctgttttctttcttttttctttttcaggttttattttagattcagggggtacatgtacaggtttgttatatgggtatatttcatggtgaagccctttcaataacaaaaggaagaggtaaataattatacaaacaaaacaaagaaaagcaacattaaagaatacatttaaatgtgagtcaaaagacctaaattgagggccaacaagcatttgctctgtcacttcacttttctgtgcctcagttttcttttctggaaaatggaggtcatgaaaatactcatacctgccctcctcatttcacaggttgtggagcaaatgcaatgagtgtggctcaatcattgccagatcttaacgttgtacataaatgttagtgactgaggacaattatttaacccctatgagctttcatatatccacccgtcaaataaagcttggatactggcctgcctatccccaaaatgatcttataaaaatcaagtaaggtgataccagtgtgtgctttgaagtagtaggtgctatcaagtattagactgtcaaatatattcaaacaactgtgtgtgggaaaagattgtggtggactagaaatagccaaactttagaagtattctatagtctttgggaataaagctgggatgtatgaaaaaccttcttatgatattaaaatgttcacctttgaggaagaaagtagactagcagaaagtttcactatcaaaattctagaacattaactactgatactattacaagttgttaggaaacagtaaattaaactttgtaatgctctcccaaaggaagtagaaatacaccatcattacttatagtttaaattggactgggaacagtgggccagcatgtattatggagaagcaatgcttcagtagtagcaaagtgaaccaaatgacactgcagatcttatccatatttaatgtttgacaggcaaaaatacttacattaatgcagtaatgtgctatgcaagtcatcaacatgggaatgctcaaagctttaatactgtttaataagcatcacactatgagagcatattttccctttcaagtacgactcattcaagtttgagggaactgctaaattgtcacacttggcaaaatcttgaatgacagccaatctaaacaaaagcaatcattttgtattttgggctggtttgaagaaagatgggaagtgtgaggtaggcagggggatgtaggataccccaaaaggccacaataatcagacaaaacccccagcaaaattgcaaaggtaggatagacaagaaaaggcatcaatgctttgcgattgaacctacacaatgacctgatgtatacaaaaaagatgggattttggtcaatggtaaagtttatttcaggggctggaggtgtgagacatggctcctaaaagtaggtgtgtcaatgactaattatctaatttacaataagttgacctctctgtaattctgtcccactttttcaatttctaaaccagcagttctcagttggggaggggaaggaggataaattttgtcagggatattggggttatctggcttgtcaccacaggggaagtgtggtgctactggcatctagaaagtggagtccaaggatactgctacatatcctataatgcacagggtagccctccacaatagagaattatctagctgagattcaataataccaagcttgagaatacacgtgctaaactaaaatcatctgagaagtatattatggggtaaaatgggacctaatcattcttagcataaaagcaattttctaaaaatcagtattttattaatattactgttattgcttaagcttcttttctactgagtttccttttaattataaagcacttggcagaaaaataagattcatttctataataggcttagtgctttctttttcagcagtctttttcttcaattaattaacatttaactgctttcttataatgaaggccaaaaaaacaagctgtctccttaaacttctcaggagaagtgataaaactctgtgagtatattaaatttttctgataaagtatttgtaggacatagatttaggaggtctttctctcttaggaatgttacttataaacatttcttggaagtccaagataaaattaaaaacacgtgcatgattctagaggctacatatgctattgatgctgaaaatagaatgttggcaccggagaagtccttactatatatgtggatgaagatgaactcctatttattagtaattatgtaggaataaacgtgatgattctaaaaaaattatcttattgtctttgttggcatttattttaaaaataagtgaaaaaaaactataaccaatatgcaattcatagatcttctatcatggctaatagttcaaattttgcaagctattggtttgaattattgcatttgctacatataaaaatggaaggtttctaaaagaaaatgaataatagaaaatattcagatgaaaaccaaagcaagctataaggcattcttagaagaactatatatatatacacgtatatatatatatacacatatatatatacgtgtatatatatatacgtatatatatgtgtatatatatacgtatatatgtgtgtatatatacgtatatatgtgtgtatatatacgtatatataagtatatatatgtgtgtatatatatgtgtgtgtgtatgtgtgtatatatatatatatatatatatatatttttttttttttttttttttttttttttttttttttttgagatggagtctcgctctttcgcccaggctggagtgcagtggcgctatctcggttcactgtaagctccacctcccgggttctcgccattctcctgcctcagcctcccaagtagctgggactacaggcacccgccaccacgcccggctaactttttgtatttttagtagagacagggtttcaccatgttagccaggatggtctcgatctcctgacctcgtgatccgcccacctcggcctcccaaagtgctgggattacaggcatgagacaccgcaccaggccaagaaccatattttttttaaaaagtttgccactgtaaacaagatatttaaaatgaccatgaacaatttttatgtatctgtaggcttctctctttaccagaattaaagtgtggggtcctggaagaagcagagggctagaagccacgacacttaggtttgtctcctcatcttggcactttctgagatgttaaattattcaacttcactgattcttcattttcttgataataaatagaggggattagatatagagatgcacaaaatccctcccaactctaaattttcatagttttataagactttgagtttaaaatcatttgatctacttatataacactcataatttttgtatctttatttccatatgcacagtttatgttatgacaagaaccaactcaaactagcttacgccaatacaggaattgattggcttgtcttccacacaaattcagtcagcatgcggatcctgctccagggactcaaatggcatcctcagtatttgttttttctatatatctcagctctgcctcatgctatgtttatttaattcttgaggtatatgtagtaattccctattgctccaagaatactcttcagcagcctgggcaacatggcgaaaccccatctctacaaaaaatatgaaaactagctgagcataatgacacacctgtcagcccagctccttgggaggctgaggtaggaggatcaattgagtcttgcaggttgaggctgcagtgagctgtgattgcactactgcacctctgcctgggtgacagagtgagaccctgtctcaaaaaatatatattttttcccattttcaaatttcagcaataaataaataagaagctgtttttcttttcttctctctactgtcctagcaaaagtctgcttctttctagtttgctttgatcaggctataggcctctctttgaaccagtgattgcagacatagaaataggatacacagatttaagtggcatgaatgacatgtcttctcctgggaccagagatgaggtaaatggaaagaatgttcttgaagcaacaggaaaatacaataaatattttgagtattaaaccaatatagtaaaaagcagagctgagagagagaaaccaaataaggacaataccatttgaatccctgaaaaaatacctgtatgaagactgaaatttcatgaagaacaaaccaataaatctctgtgatttgctttagtttgagttgttgttgttttttgtttttttgtcacaacataattagtaccaactgaattaaagataattttttaaattacagagtattatatcctatattaaaatcaataaaaaattttaagctcaaagaacttgatgatatctttgatacaaatgacatactttatacttaataggttcccaataaatatgtattgtttggtacaatgtaatgaatatagaattaaaagaaatatgtatgtaccaaatgagtatgtaccaactaagaagaagggaaaaagggtacattcatttcctatctatataataatatggcaaaaagaatggaaaaatatatacataaatgatgcaagaaggaggcaaaaaaggtgataaatttcaaagtggaaacactcaagatatatatgttgtccttcaccaagaaaattacaaaagaccttgatattgaaggcttcttctttgtcttcttgatgcctcccatttcttctcagcgaatttcattggtacatacccatcctaatatgataagagcattttaagaaatacctgtaaataatattttcccctattctgttagaatataagctccataactttagaaatctttgttttgtttactaatatataccttatactactaagtaaatccctagaataaataaacaagacatagtaaaataattgtaggatgaattacaaacaggtgataaaatgaagaagcctgaggagagggccaagcaggatatgaactgttctgaattctttcttctacctttttttctcaccttaaaaactctggtccttatcacctgtattgattcatatatatatatatatatacacacacacacacatacacacacacacacacataccacttaagtcagatttcaggattcagaacatatggaagatggtgattatcttctagactctatattctaatgaaagataatattttcttttgggaggcatttcatatattccataatttattgaggaaaaaaatgatattgaggtcaattatactatagagtttgtaggataacttacttaattgtgttgaagattttagatttgctgagcttggaagaagaaaggaagagagattgtgtcaaacaccaaatgagaagctgttttgagggtaaaagatcctagaaataaaaaatatatggtagaattaaagtaaaaatatataaaatctaaaagaagattcctacccttgcattttgacttcttccctggtagacaaggctagaaggaaacaggatttacatggcaggagagtataaaagatgactcaagtatttccgtgaagaaaataaaaagatcatgtccactgtgtcataaaatcacatcacccttctgatcaaaagcaatcaagaacttcccttaggttttagaataaaatccaaatgtttcccctgcctatgtcctttattattacccatttgccctcatgattttctagtcacaccagccttcttgcagacctcaaagtcgccatgcttgttttcatcccaccggatttttgcatgggttgttcctctttcctggaatgttctgccaccctcagcccccaacattcccgtaactagtccttctcctcagttaggtcaaagaacgaatgatgtcacttcctcagagtgacatcttctctgacactatctacagtagccaattcaccagttactttctatcagctagactgctttattttcttcacctcagcagaagattttttgttcatttattgtttgactttactaactttattttctaaaattaaagccccataagagcagagaccggccgggcgcggtggctcacgcctgtaatcccagcactttgggaggttgaggcaggtggatcacgaggtcaggagatcgagaccatcctggctaacgtggtgaaacccgtctctactaaaaaatacaaaaaaaaattagccgggcgtggtggcgggcgcctgtaatcccagctactgaggaggctgaggcaggagaatggcgtgaacctgggaggtggagcttgcagtgagccaagattgccccagcctgggccacagagcaagactccatctcaaaaaaaaaaaaaaaaagagcagggaccaaatgcctattttaatacccccaaatacctagaagaatacttgacatacagcagtgaatcaattattattgaaatctcctgtgtgtgtatgtgtgcacgtgtgtgtatccatgaatcaatgaatcaatgaatcaatgaatccattaatcatccaaaattaggagaacttggggcaagcctgagacacttagggcagagggggaatgaaggttagagctgcttctgaaataggcagagtaagcagtggtataaaaattttttttgaaacatactgaattgaagcagaactgagtatcaagactttcaacaaatggcctaggtccttttaatgagtttgttggcctggacagttgtcccataaagctctctccaaaattaggtaatcaaagaaaactattaattcctgagaaattgccttgtattgcctttatttcaaatattttaccatgtcataatcatatttatgcaaatgtggcttaaacaaacttttggaacaatcccaattatttgttaagagtcacttgctattaacatgaacaaaagaaaatttaaagaggtgatattaattatatcatattaaaatattatggtcagttttctagtagcccaagagtccttggagacatttaaatagacaattttgatatctcaaagctctttgacatattaataatattgaatgttgcctcactccttaatgaggagtccaataatcttctaaatcataaataacaagtggattcaataaaataacaagacagtaactgctgatattgaaaagtaatgagaagaccaataaaggagaatgcagtaagactacaagggagagagggggaaaatgagaagaaaataactcagtgcagctgggatttcacagtattcctaatacttgtgatctagtcccacaaacaagatagaaaagacacagagaaggcaaaatgctacagatctgctttctccacacttgttttaatattttgggaaatttctgaaaatagaacaaagaggatagcaatgaaactgcagagaacaaaaggacaaagctgatgagtattaggcccagagaaatttggaaaagggaaattagacacaggagtcttaaagcttaataaagtatccctcaaaaataaagaataagaggtgtgtaactgggagtatgcatgtatatgtgtgtatttgggtatatgttgaatgaaggttcatcaatggtggctctagaaatagatcatgggaaggacttgggtgcagactgaattctaatataattttatttacagatacttaaatttgaattttacattatttttatatgtcacgtcttttaatttttttctttttttattattattatactttaagttttagggtaaatgtgcacaatatgcaggttagttacatatgtatacatgtgccatgctggtgtgctgcacccattaactcgtcatttagcattaggtatatctcctaatgctatccctcccccgtccccccaccccacaacagtccccagagtgtgatgttccccttcctgtgtccacgtgttctcatcgttcaattcccacctatgagtgagaatatgcggtgtttggttttttgttcttgcgatagtttactgagaatgattcccaatttcatccatgtccctacaaaggacatgaactcatcattttttatggctgcatagtattccatggtgtatatgtgccacattttcttaatccagtctatcgttgttggacatttgggttggttccaagtctttgctattgtgagtagtgccgcaataaacatacatgtgcatgtgtctttatagcagcatgatttatagtcctttgggtatgtacccagtaatgggatggctgggtcaaatggtatttctagttccagatccctgaggaattgccacactgacttccacaatggttgaactagtttgcagtcccaccaacagcgtaaaagtgttcctatttctccacatcctctccagccaagatggccgaataggaacagctccggtctacagctcccagagtgatcgatgcagaagacgggtgatttctgcatttccatctgaggtaccaggttcatctcactagggagtgccagacagtggacgcaggacagtgggtgcagtgcaccgtgcatgagctgaagcagggcaaggcattgcctcactcaggaagcgcaaggggtcagggagttccctttcctagtcaaagaaaggggtgacagacggcacctggaaaatcgggtcactcccaccctaatactgcgcttttctgatgggcttaaaaaacggcgcaccaggagattatatcccacacatggcttgcagggtcctacgcccatggagtctcactcattgctggcacagcagactgagatcaaactgcgaggcagcagcgaggctgggggaggggcacccaccattgcccaggcttgcttaggtaaacaaagcatccgggaagctcgaactaggtggagcccaccacagctcaaggaggcctgcctgcctctgtaggctccacctctgggggcagggcacagacaaacaaagagacagcagtaacctctgcagacttaaatgtccctctctgacagctctgaagagagcagtggttatcccagcacgcagctggagatctgagaatgggcagactgcctcctcaagtgggtccctgacccctgacccctgagaagcctaagagggaggcatcccccagtagaggcagactgacacctcacacggctgggtactcctctgagacaaaacttccagaggaacgatcagacagcagcattcgcggttcacaaaaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcgccatcatcaaagaccaaaagtagataaaaccacaaagacagggaaaaataaaaggaagaaaaactggaaactctaaaaagcagagcgcctctcctcctccaaaggaatgcagttcctcaccagcaatggaacaaagctggacagagaatgactttgacgagttgagagaagaaggcttcagatgatcaaactactccgagctacaggaggaaattcaaaccaaaggcaaagaagttgaaaactttgaaaaaaatttagatgaatgtataaccacaagaaccaataaagagaagtgcttaaaggagctgatggagctgaaagccaaggcttgagaactacgtgaagaatgcagaagcctcagagccgatgtgatcaactggaagaaagggtatcagcaatggaagatgaaatgaatgaaatgaagcaagaagggaagtttagagaaaaaagaacaaaaagaaacgaacaaagcctccaagaaatatgggactatgtgaaaagaccaaatctacatctgattggtgtacctgaaagtgacggggagaatggaaccaagttggaaaacactctgcaggatattatccagaagaacttccccaatctagcaaggcaggccaacattcagattcaggaaatacagaggacaccacaaagacactcctcgagaagagcaactccaagacacataattgtcagattcaccaaagttgaaatgaaggaaaaaatgttaagggcagccagagagaaaggtcgggttacccacaaagagaagaccatcagactaacagcagatctcttggcagaaactctacaagccagaagagagtgggggccaatattcaacattcttaaagaaaaggattttcaacccagaatttcatatccagccaaactaagcttcataagtgaaggagaaataaaatactttacagacaagcaaatgctgagagattttgtcaccaccaggcctgccctaaaagagctcctgaaggaagcactaaacgtggaaagcaacaaccggtaccagccactgcaaaagcatgccaaattttaaacaccatcgaggctaggaagaaactgcatcaactaacgagcaaaataaccagctaacatcacaatgataggatcaaattcacacataacactattaactttaaatgtaaatggactagatgctccaattaaaagacacagactggcaaactggataaagtcaagacccatcaatgtgctgtattcaggaaacccatctcacacgcagagacacacataggctcaaaataaaaggatggaggaagatctatcaagcaaatggaaaacaaaaaaaggcaggggttgcaatcctagtctctgataaaacagacttgaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaacgagacttagactcccacacaataataatgagagactttaacaccccactgtcaacattagacagatcaacgagacagaaagttaacaaggatacccaggaattgaactcagttctgcaccaagcggacctaatagacatctacagaactcttcaccccaaatcaacagaatatacattcttttcagcaccacaccacacctattccaaaattgaccacatagttggaagtaaagctttcctcagcaaatataaaagaacataaattataacaaactgtctctcagaccacagtgcaatcaaactagaactcaggattaagaaactcactcaaaaccactcaactacatggaaactgaacaacctgctcctgaatgactactgggtacataacaaaatgaagacagaaataaagatgttctttgaaaccaacgagaacaaagacacaacataccagaatctctgggacacattcaaagcagtgtgtagagggaaatttatagcactaaatgcccacaagagaaagcaggaaacatccaaaattgacaccctaacaccacaattaaaagaactaggaaagcaagagcaaacacattcaaaagctagcagaaggcaagaaataactaaaatcagagcagaactgaaggaaatagagacacaaagtacccttcaaaaaattaatgaatccaggagctggttttttgagaggatcaacaaaattgatagaccgctagcaagactaataaagaagaaaagagagaagaatcaaatagacacaataaaaaatgataaaggggatatcaccaccaatcccacagaaatacaaactaccatcagagaatactacaaacacctctatgcaaataaactagaaaatctagaagaaatggataaattcctcgacacatacaccctcccaagacgaaaccaagaagaagttgaatctctgaatacaccaataacaggctctgaaattgtggcaataatcaataacttaccaaccaaaaagagtccaggaccagacggattcacagccgaattctaccagaggtacaaggaggaactggtatcattccttctgaaactattccaatcaatagaaaaagagggaatcctccctaactcattttaatttttttctaacttttaaaaatatgtaaaaataattcatagattgcaggatatacgaaaacaggtagattaggtgctcgcaggccataatttgcctctgccatcaaacaatagcataccataatctacatctgtgaattccaagggatcacaaacagaaaagcacaatggcagctgagaacaatagtggaagaatacatttttattactgttattacttattccacttatacaaatggaaaatgccatttttaaatttggtatttcctcttgtgcctcctcagaaattatactaaatttctttcagaattcatttattattaatgtgcccagattgtttcagtataagatttcttcattaaggtgatttcattttgaacagaggcaaagaaatacatttggctatttactaactataaaatatacaactgctgaaagctcgatggcacctaaaggaattgaccactttgttatcccaaaatgttctgacacttcaatgtcattgaaataatgccagagatatttcaagggatttcttttccttttcaaagatgcacattaaatagattgctatgtaaagctgatacatcatttagtcctccccaaaagggaaatgcaggtacaggcatgtttgcctcctgactcccagacaccatggctgggaaataaaacaagcaaggctgggaatctttggagtcaggcaaatctgggctctgctcaataggaagtatttgtttctttgggcaacatggagccttagttttctctccactgaaacttggaccttagctccctcacttctaaaatggaaatagaaatttctacttcccagggaaaatgagaggtttaaacttaaatgaaatgagaaagtatatgtaatattcacattgctagcacaatgtgtagaatctattattatcctcgaataccctctgtgatacacatagaaatagacacagcttctcccagcagcctagtagttggttgaaaattgttctatattcacaataaaagtcattcccagaagttgttgcaaggaaagaagtgatcctgttacaggtttgttgagacaggaagatacaagaagacaaaaataaaaatatttctttaatattgttattgggccatctgaccttagaagctagattcctgcttaaaaattcatgactaatttttagcatgaaacagcagaagtttccaattctcaagagacccactgcattgaaaatcctggggtctttttgtatggtccaaaactaatggagacaacttagcccatctaaaaattgggtgaaagagacgtaaggggggggggcaataaaaatgtatttttctaactagttttcaggtatccatattccaaaatagaacagcatctttgccagaagttcaagtcattaaggagttggtatggcattctcacttacataaagtatgggcacctctgaacaatgacctgaggattactaacaggtatgcaacatatttgaaatgtcaggtacagcaaagcaaatgactttatcaaaatataaatcacacttttagcagaaaaaccaatagttatatgaatttaacttcatctttaagtgcaaagagtaatattttgtgaattttctaaccgttttttagatgtcatcagtgtttcagaaactggtttctttcattttaaaataaagagatgctatttacttcatcattttccagccttcctgataggcgtatactcacatgaggagatacaaaactgaaaacattatctcattatagactatccacgatttaaaccttcaagctggcaatatgtatttaaataatatgtcataaacacctcttggtacataataatgtagtaaatatgagaatgcctttaaagtgaactaacttattctcccaactgttagattattccctgctatgatcccatcaccaagtgaaattttaggcatattcctctaggcaaagtaaatagttatgaggaaaaaaatattgctaattccagttgaaataagaaagcctcttaatcatctaaaatatttctggggcagatgcagtggctcatgcctgtaatcccaacactttgggaggcccaggcaggaggatcatttgaggtcaggagttcaagatcagcctgggcaataaagtgaaactctgtctctattaaaaaaaaaaattaaagaattatccaagcatggtggtgtgcgcctgtagtcccagctactcaggaggctgaggcaagaggatcacatgatcccaggaggttgaggcggcagtgagctctaatcatgccacagagtgagatactgtctctgaagaaagaaagaaatacataaataaaataaaataaaatgttctctatgggccagatttctctctgcttaggtcaattaaactacaaatttctcagtaatttttgaacgctctatctcccaagatgcctaggtggaattgttaggaagcaactgcccatccacaaaatatacctggagaatctcagatttcattcactgcttttaaaaaaggaaacaagaaaatcttcctcttagaagaaatttaatcttttaccacttttattacttttattatagaaatatatatgtatatatacatatgtgtatttatgtgtgtatatatatcagatatatctatatatatatagatatatagatatctatcagaaagcaaaacttaccttccttagacaaatggagatttggggaaattgtattggagtctagaagaataaatcctaggaaaagcaaacacacggtatacacacgcacacatacaaacctccaataaactttgggaaaaaaatttatatacacaaacactgatacacaaaatatatggattatatatgtatgtatatgtgtgtatatatattaaaatataggtttattcaccaatcactgaaaaactacatcataaactacaccaaaggagtagttttaggacaaatggcaaaaaatagtaccttacagagttgacagtttggaattgcaatacttcagatgatcacaagctttaaaaatgctcaatgtgctcgtctatgaatttcaaaatgggtataaattaaaacttattacactttttttaagttgcattcccagtacatgaaaaaacattgtcctaagactacctctttgaagcaattttcaaggattcgtgaatgagtatcgtgagcaataaactaaagctgcataagagagatatagtgtataaactgtgctagcatattatctttggttccaatcgcctcataagcattgctacactgactcaggccaatggtggtctcaaaacaatgttttcatctccctgaaccatttattcttttagaacataactcattgttgggtttcaggtgactattctgactgccattccaaggaaacaggccttctgaacaagaaaaaaatctgaaaacggaatatttcctttcagagatgtatggaaacaagctctgcctttttacccatgccataatgggtcttgctgagagtttgcttcaagaaccagaactcagtaaatgtaaacattcccttaaacagatgcacatatgttcttaatataaaatcttccagatgtaagtttcatgcaagaaagcaaagtgacctagcaagaattgagctttccatatctggtgaagcatttttcttagtgtgtgccacaagcagttattctgagaaatcatgcatctgctcctcttcacatggacattccacttctgatgagactacattcttggaaaatgtaggcaggagctgaattcaatcttacaatgtgtgtgcgcttattccttccatctatcacttacccaaaatacctgcaggtggtatcagaaatgagctttaaagggcctgtggcactgattacaaaaaaatgttaagtggtatttcatatggttgtggagtgggcagactcctgcttaagattcataatcctcatcagtaacacaagtgtatcacactcacaagataatattgaagtaatagaagaaatcgtccagaaatgcaaaaaatagttcacgtaagatgcaaaatcttatgacaaaatgaaatcctgaactaataaatagctctgtactgatatcaggccctaaagcctatattactgagagataaaacgtgggggacagcaacttagagatagggctattacattaaatctatgattacattagctaaaaagaaaaagcacaagagatgaaacaaaacatccaagaaactcatcaagatttatgcttcaagcaatgtcctaatatctgagaatatcaagatatgaggacactaacaaaagtattattattctaccggatcatttaaaaaattccttttgttctgaaatcaaataaaaagtaacaagactggcctgagtagcagaatatacatttcatactttatatttgtgtatgtctatatatatgtacctttacacatacacacagatacacataaacaatcacatctgtatttcatatctgtatttcaaccttctccattcactggaacagacatttaggttgattccatatcttgtatattgtggctaaggttgcaatgaatgtaggagtgcagatatattttcaaggtgctgatttcatttcctctggatatatacccagaaaagggattgttggatcatatggtagttctatttttaattttttgaggaagctccatacattttttcataactgtaccaatttccattatcagcaacattgtaccagggttcccttttcttcacactctcgccaacacttgttatctcttggtgtttttctttttttctttttttttaaataacagccatcttaataggtgtgaggtgatatctcattttggtttgatttgcatttctctcattagtgacattgagcaccttttcatatacccgttggctatttttatgtcttgtttagaaaaatgtctattcaagtactttggtcattttttttataaatacatacacatatgcacatgtgcacatatacatgggtatgcacatacatatgcatattttaataactatgagtactcaatgatatttaccttttttttttttgagatggagttttgctcttgttgcccaggctggagtgcaaagtcatgatctcagctcacaacctttgcctcctaggttcaagcgattctcctgcctcagccccccgagtagctgggattacaggcttgtgccaccaccctggctaattttgtatttttagtagagatggggtttctccatgttggtcaggctggtctcgaactcccgacctcaggtgatctgcctgccttggcctcccaaagtgctgggattacaggtgtgagccaccacagctggcccactttggtcattttttttaaatcaagttacttggtttttttttgttttgttttttgctattgtgtgagtttcttatttattttagagattattaactccttgtcagatagtttgcaaacattttttccaacctatagtttgtctttttattctgatgattgttttgttatacaaaagctttttatagtcccacttgtttaattttgctttcagtgcctgtgcttttggtgtgatgttcaaaatatcattatgaaggacaatatcaagaagtttttcccttgttttcttccagtagttttagagtttcaactcttatggttaggtatttaattcattttgacttaatttttatatatggtgtagataagggtccagtttcactctttgcctgtggatatccagttttcgcaacaccagttattgaagatactaccctctctccatcgtgtcttcttggtagccttgctgaaaattggttgactttataaacttgggtttatttctgggctttttattctgttccattggtccatgcatctgtttttatgccagtaacatagtgtttggttactattactttgtagtataacttgacattagggaatgtcatacctccaactttatttttctttctcaagattgttttggctattcatggtctttgtaattccacattaattttagaatttttccatttttgtgaaaaatgctatttaagtatgtccatcattctaaattaattataagagtgaagttatgccctaaattgttcattttgtaagatgtgccttgcagttttgcaccttgcaaaatgagcattaaaaattaggaacagtattttgctaatttgttcctgtgatctagaatacataattttattctatagcaggagctgtatattctcacatcggaagaaagtaatataatctgcttatatagcacatggtgtagccaataaatagcattttacatttcgtcccttttttcctttctctctcatactttcctactatttttaacagctttattgagttaaaattgacataaaataaacatcccacatttcaagtgagtgtacaatttgataaatttttggtaggaggttattgattgaattttttatattaataaccagttgttccagcaccatttgttgaaatgattatcctttgcccactgaattgcctttgaactttggttgagtatcagttgtctacatccatgtagatctttatggactctagtcatttctattgatctatttttctgagtttcctttaacactacactatcttgataaccatagttttataatgagttttgaaatcaggcagtcttagtccccaaattttgccttttatcaaagttgttttgactattctaggtcctttgcatataagtttcagaaacagtttttcaattactagccaaatgaatgttgggattttgatctggactccattaaatctacagatcaattgaggagaagagaagaccactttaacactgttacagtttcaacactgtacagtttaacatcataatctgcatttatttaggtcttccttaatttctcttggcactgttttatacattttgtgtacaagtcttgttaattttttatagacatatttcatattattgatattattgtaaaaggttttactatttcaactaatttcaattactcttaatgatacatgtaaatactactgatgtttgtatacggatcttatatcctgaaaccttgcaaagctaagttttgagttctagtaagtagtagaggttgaataaccctatccaatacacttggaatcagaagtgtttctgattttgttttttaattttggaatgtttgcatatacataatgagatatcttggagatgggacccacgtctaaatacaaaattcatttatgttttatatgcaccttatacccatagactgaaggcaacattatataatattttaataattttgttaatgaaaaaattgtatattttaaatcatcagaaggcaagtgtcaacatctcggccacccatatgagccatctgtggttgtttggcatcacaatcattcttgattttgaacttataagctactgataagcaacaattttcttaacttatttacccataagtacttatctgtaaaaaatatggcatgccatttacacagtaaaaaaaaaacaaatgtgtccagggtaactaagcagcacagcagcatcaccagaattcccgtaacagctgttgaacatcagcaacaaccaacaatggcaggctttcagtctccacctatgatgctgtgttttgattaataggttactgtgtgctgatttttttttaggtgagagaaaaaaaaaatcaaaacagttgaaggaccaggaagtgagtcctctagggatgaagaggcattttgtggatggcttttaaaaatgtttccttcagagtcatcttgcctcattaacaatggtttttgtcttagaagtctccctttgggattacaggcatgagcatgggtggatcacctgaggtcaggagttcgagactagcctgaccaacatggtgaaaccccatctctactaaaaatacaaaaaattagccgggcatggtggtgggtgcctgtaatcccagctactcaggaggctgaggcaggagaatcacttgaacttggaaggtggtggttgcagtgagccgagatcatgccaccggcactctagcctgggcaacaagagtgaaactccacctcaaaaaaaaaaaaaaaaaaaagaataagtagtagtagtagtagtagtagtagtagtagccatcgtcgtcgtcgttgtcgtcgtctctctttggctttataaactgacatgatttcttgtgctgttataaatgtacagtgctgtagtccttcaataagcccgtcacacatttttaccttatccataggaactttttcttcagtgttaacaatgtcattttaatcatcactattatcacaatcaacttgattcaaaaccatctggactatttccccattggtcaatgaagaattggaatctcattattgatgttaaaaataatcaagttctttgatatttacttctgctagcctagggaaagactctgaaattatattttttgtgtatgtaaggaggtcagacaccatctttttttctcagttggcccacagaattcttcaaagtcactaccttgttcatcaagatcacttaatatagtcacaggcaagaggttgtgccaggagtgtactactgtgtctttagtcactgcgttccaagtgttagcaatggcataaacagcacccttcatgctaaactccttctagaaaccttccacacccacacctctcttcactggtgctggcatgatgttcaagaaagtgtttttatatttactcttcatcaatctaaggataccttggtcacatgactgaattaatgaagtcacatttggggaaaagtatatggcataagcattatttttgatgaaaatttcagctgaaggatgagcagaaatgttgtcaaggaataacaaaaatctaacagttgtcatccaatccagcttccttgcagtaaccttgagcctctggtataaatgtttgtgaaaccaatcagaaaatatgtccgtggtgatccatacctttttgttaacataatagtggactgctgagaaattcactccttgaaaacagtgaggatgcaagcttttgcttttcagaacaagtttatacttttgtatgcctgctgcattagcacatgccagcacagttattgtccttggaatccttaatttttgtaggggctacctcattagcttttgtcagtgtctttctggggcaacagtaccaaaacagtgatgtttcattagcattatagactagttctggcatcagattttcatcagcaatgactctggcaaatttgtcaatgaatttttccactactacatgaccagaagatgctttatcactacaaatctttaaaaatgtaatatcatagtttttcttaattttctgcagccagcctgttgagtactcatggttcccttcaatattcatttcctcattatagatctttgcttgtctcccgattcgtattccattaagtgacaagtgttcactgcaatggtaatggatccactatttaaatacacaatcaatatttttattgttagctgtatacggtgtttttctatttttcattgacttctattcatcactttcagtataaaacttcaacagtttatccttctgtttcttcaggtcatatatggtagtcaacactatactcttccatagaacatttcaacttccgccactgtccagtttcttcttcttcaacagtttgactttctgtgctgtagagaaacataaatgcttctttttcttatcactgttacccaatactgatatcacagagggaactgcaggagtttttaatatttttaataatctttacaccatagagcagataataagaaaataaaaacacagtaatgcatgtaggtcttggccccatgtgacacattattggaaacctgccattggtgtgtttggcctgcatacatgccattttattaccctttatgagtgtgcctgcatagtgggggtggaggaatctgggtacttaagaaagatatatttcatagctgaaggggtctgggagggtcttcttccccttagggatgctgaataaactgtgtgctcagagcctgttttttgactacaccagtcacatgaagtcatgtatagaattttccacttgtggtattatgtaggtgttccaaaaagcatcttggattttcacattagcaatgctcaacctgtactagtagattccatcatattttctacataaatgatctcatgtcatctgtaaagctttacttcttcctttccaatctggatgtcatttgttcattcattcattcattcatttattgctttccttagtgcactggctatagcatctggtataatgctgaacagaagtggtaagagtgaatatccttgtcttattcttgatcttaaagtatccagtctttctgctctaatgatgtttgcattttatagacccctcttatcaagttgaagaagtttctttccattcccagtttttactttagttgaatttggtcatatttttgtctgttgggataatcatatggttttcttttttaatttgttactatggtaaccttacattgatttgttttaatgttaactaacctagtattcttaggataaatcgtatttcattaggatatgttaagcttttagatacattgaattagatttgcccacatcttaaaaataaatttttgtatctatattcatatcgatccatatatttactaattttttataatgtctttggttttagcatcaggatagtgttagcctcagagaacgagttgggaagtagtttctctgctcaattttttgaaaaataattgtatatacttggtaataggtactatttcttacttaaatgtttggtagaattcatcagtgaagccatctgggcttcaaattttctttgtgggaagatataaatgttagctggattaaattgataatgatgccgtttaagtcatctacatccttaactaatattttggtttgaatgttctatcaattattgagattgaggtgttgacatctctaaatataattgtgtgtttgtttaatactccatctttttttggaagcataatatcccttccttaacaaattatcttcttttattctatttgcacttttactttttattatgttcttttttgatccttttaagaatactggttgtactaaatgctacccatggttacactgatttttgtcttaggctttattcatttctagcccaactatatcttcctacctcttgtttgaaacagaaatattcatttttctccataaagcaggcatcccttctaatcctaagcaacacaattctcctagacacaagtattttcaagccagtcatctttgacatcactttatagaaaatacatcttctcagttaaatctttactcaagtagtgtattatcctccctctgctatcagtccctgactgtacttcatgttatgacattttaaattattgtggtaaacctcttcagcctctagaacagtatttcatacatcatcagtgtgcagtagaaacaagaacatccccaggtttactactgcctacaaaaaacaatggaaattcttcagtctatccaaataaaccagttgtcctcccttggcatcactctgtctccttccatccttcatccattcattcttccttttcttctttccttccattcaacaaatatttatactcgctcttaaatgcagctttcattcaattaatctactcattgttgtcaaaagatagcttatctttttttttttttaattggaccatatggccccactactcttcctatgcaagtcttgcaaggcccacttttagcccatcttctgaatgaacattttctgtctccaaagacagcaatttctctcatttctgagcatattattgactgtgtacataaacacaccaaacagcagtggattaaaaaaacacacagaagccattactgcctcaatcagttaaataagaatggttaaaaataatctgttgtttaaactgatggaaacaggaaggagaatgtcagcttgctttttaggctattgtcttcctgataacactggtagaaagataatcctttaccctaaaaattaatactgaattatgaggaataaatgcatacatagttcttcctgccatgcagtccatatgaaaagggggagggggtcacaacagcttaaataaaagagaagtttcagtttgtctgtaaatgtctacaccataaggaaaaaaatatttgaagccacagtaatgagagagtgtttcggtagaataaagtgtgaaatttgtaggaaggagaaccaagactgaaaatacaaaaacattattaggaaagagacattgcaaaacactataatgtgtacagttaacagaattagcagagaatataagagacacacaagaagattatgaaagatatcaatactagaaagacagaagagaatgtttaaaatagtaagaatactaatgtgtccaatttaagcatttaatgatgtttaaataaaaaataagccaccctttaaaaattccttctttattttagagttccaagataaaaatattgggaaggtatttttcaatcagtaaaacaaacttcagttagaaaaatttactattagataatcttattaatatctataaaagctgcattcatattgatttagcctacacccactttgtgcacaatgtatagagaaagaacagcttataaaattaatatctaggcaacgatggccacagtgcattttaggtatggccacttttacagtcttttgtaataattacattttaattttttttttgtcttagcaactggatcgtaaaatctttgagggcagggctccctcttacactctgtgtatcatatatagtatctagcaaggtagaaattaaataagatttcctgaattattccctggctgctcatcttaattgtaggaatccataaatgtctttcctattgattctaacatgttgggagtgccaagtatccttaagattacatccttggactagagatttaatagaaacacttcatttaatattaatagaaaagaaactaactcagagtaccaatttcttgggtggaaatacatggataataagtgacaaggtggtagaaaagcaagctacctatttcaaaaccatatttcatgtgtcagctggtgttaactaaccaggcaactactatggatgtaaacaataactacagacaacactttccaagtcttcatatcgtatctccttagaaaaaagctattatcaagcagttttgaaatccacttaaaccttttcaaaatgtattatagatttacttaggacaaagtgttctggtgcattcagtcataattggtaggaaatatcaatcaattgtttcatttgtcataatgttaaagtcactcaatctagggtcttagctgatttctcttttctgaagaactataaaacgtacaaataaactttatagaaatgggaaaatcccaagcatgtattaaaaataattcttgccactaactataaaacacatcaactctggcaagagcctttcctggggagcatagtgtacaaggtctagatgtgactatcatacagagcttttttggcttgccaatgctgccaaaaaaaaaaaaacaccactgactggatgtagcttaaacaacataaatttattttctcctagttctagcggctaaaagtccaaaatcaaggtgttggcaggtctagtttcttctgagacctcttgtctttgcttgcgggtggcggccttcttgctctgtcttcgcatggcctttcctctgaactaacacacattcctggaatttctgtgtgcccaaatattctcttcttacaaggacactagtcatgttaggtaaagtcccatcctagaagtctcattttgtctcaattaccccttgtaggaccctatctccaaatgcactctcattccaaggaaggtgctaggagttagggcttcaacatatgaatgaggaggaggaaggaagagatacaattcagcccataacaagaggccagagagctgtcatgaaatttcaggaaagatatagctctctcaaataatatttttactgagtatcactgaatttagagccaaaagagacctcaaagttgatcatgtctcaccacctaggcaatgctgaaatccctcgtaaggttgtaaggtttcactgactagtctcagcctctgcttccttatccagggaattcaccactaccatggaaatagatgccatttatagagagttaatcattgtgtggtgggataataattttgaaatatcaaccgttttttcttttccatttttctatcttgtattttctcttttcatcaactccagtgagcttttattctatacttatcacctcaccaagtgatatacactagaagcttttagtgtgaaaacgtctaggccccgtaaagaccaggaaggatctggcatttgcactctccaaggcctgaattcctctagaccaaattcataaacacagcagcagaaccttatacacaaccttatataaacttgagaaaacctaaaatatagggaaataagatttcagggtagaatggcttgctctgtgtctgtttcagggctctgtgtctccttagatggacctaaaacagtccacggaatttcctgtgcttggatgtggcacaggaaaatgaatcccatcttccaaaaggggccttgacatagctgagataggacttgtagataggaacaagtattgattcagtagcaacttgcatgggtgaatgactagaaaggataatgagtctcagcaaatgtcagatgaaatggaagcataaaggtcgtcatcccttggcaatatggaaagccccataaattagagagctgccaaatggctaaggtttagtttttgccattctgtctcaaaacagaaattatttcgagaaaaaacctctattttttgaatacttgggtttatgactaccattaaacaaaaatatttattccttattacttcttcactcacttatattgattacaaaagtatgaattatattaaaagttggtgttgtttattacaaacaagaattgaaatgagatcaactagtatatttgttcttatacgtaggtgacacacggtcatttcaatgcccactctttaagaccccttgggcttgtaaaacatgaagtacatattaagaggtgtgaatatgtacaataccaacaaacatggctgattatgagcctcccaaacattctttaaccaaatcagaaccctaatgtgtaaatttcgctgttgtagtaagaaatatacaattatgatatttgaaatgctattagaaattaagaaagaaactaataacactatacgttgcttttgaccctaataaaatactcataaaaataaattggatgtgtcaatgtgtccatcctttgagatcaaggccaattgtagcgacatagaatgttgaaactgaaagggttcttagaagccatctggcaaacactctcataaacagatgtgagaattgagatccagaaacatgaaaagatgtgtttagggcaacagcagtcactggcaaatccagtgtggaagatggtgtcttcacacattccacttctttttctgcaggcatctcaaggtcacagcagaatcatttcttcaaggtttccttactcttctataagggcaatcacatggttgatgcttatttaaaatatttaaaactatttataatcatgaatgaaatttaaaagagtcaagacactagctaacccaaaagttgggcttttcccttttgagaaaatatttttctaactgatagaacatttggtttctcaacttttatctatcattaatgatatgctccactgctagaatgatggaatggcctagattgtttagagtacacgaaattatctttaatgaagataatttcattatctttgtgataatgaagaattagcctatctttgtgataatgaagaaataaagatttcttcacaatgataagcttagttgaatttagaaaaattaatatgtggctcctaaagcattcataattatatataaatctctttaataatttttttcctaaagttatctctgtgataatatatattctagacatatattcaaatatatttaagatatattaaaagtagtaattttaaatacagtttgaggaaagaattaaactctgagatatttataattcaacattgaaacaaatcttaaaactttgtcatgcgcttgttacaattacagttttgtaattctgtttgcatcaggtatgttgcaaataataccacctctttattcatttagcactttctatctataaaacatcttttaaatatactactaatttcatccatgccttgctgtagaatctttaaaaatgtgttagcagtttatgcagttttttcttctagttatagatcaaaagattcagagttagccacctgaggtaggcagtgtggaaacctactctcaaatacatttttggtgagtgaacataatcctattttctaccaattgacacaaatctcaaactgatttgttagaacatgtattctgcaatagtcaagcaatacaggacctggaatacacaattagtctcttcaagaaactttttcagcctttcaccgtgaacaagaaacaaaaaaaaaaaaaaaaaagtaagaaacttcagcaagataaagaacataaactcatcatgacctttagcttcagaaatttcagaaattttaattgaaacattaaaaaacagctatatatcatgaaatatatgaatttaagtacttgaactctctaataatgtatcttcctaggtgtccctcattcatatgtcccattattcagtctgcttttgtcttccttgtgcttctctgtgttgcttctttacccattcaacaacataagttaggataacttggtgggcttttcttttttctttttttgttttcttgagacagagtctcactctgtcatccaggctggagtgcaatggcgtgatcttggctcactgcaaacttcacctcccgggttcaagtgattctcctgtctcagcctcctgagtagctgggattataggcgtgtgccaccacacttggctaattttttgtaaattttagtagagacagggtttcaccatgtctggtctcgaaatcctggtctcaccaggatggtctcgaactcctgaccttggtgatctgctcgtctcggcctctcaaagtgctgggattacagaagtgagccactatacccaaaccttactttcaaaagttcttacctttcttgtgtttttactatttagaatatttggctgaagtttttactctttctttttgccttccccaagcctaggccccagccatcttttctgactgctcccatttttgctaggcaaaacctagcaagaacctcctttacaccaaaaacaaattttcctaatgctctcttgtcaaggtccaacagtggtagagctgaaacagagccaatggagttgtttatatcatccagcttcgtatttattagccacatatgtgctgcaaatcttagaaagggaaggatggtgctaagttctctgcagatgctcaaatgctaaataataaacatgtgatacaagctgagattcacaataaagacagggaatatccaaaaatatgtacttcaaaattatatcagttatttcccctaggcagtttagaatacaggattttaaaattcttgatgagtaaagagggaggaattaaatgataggcaaacatgtagcctgcatattgagtaagaatttattgtcccaaagagctgttatcccaaatcagctggttctgatatttcgatattattcaagaaggtagttagtcaccattttaggaatggtttaactttagctgaaactgattagcagttttttctgaatataaaatatggagaagttattaataaatgtcaaatcagtctctctcttaatcgctctcactctctctccctctctctctctctctcacacacacagcaagagacatttgaatataccatcaactttcattggcttactaacgctatggcacagcagagtgtgtttctttcctttggagctctatagtagcataagaaaaccttgctgaaaattgagcaacactttttcatgctgaatgattttgttttacatttcctctgatacaaatagaaaagacgtctcacattcagctacctatgctagactacaccacaaataagctcatacctttataatgtgtctacatgacagtaacaactgtggtgagcatagaattattcatatgcctatacttatttcctatgtctttacttaacatctgggaaccactctcaaggtagtgtctctggtagttctgggaaagctgggtgcttctgtgttactagtatactaagaccttaagtaaggggtcctcttatgctctagggacttctctaacctctctctgaaaccctcaaggtaacagagctttagttccacacaggaggctcgagaaccacaaagctagcaggctgctatgatctgggtctctctaatgcctgtgcccgcccatatcttattctccttctcaacagacagaaatgagttccaaaatcttttcaaatcatttcttcctctggcaatattcaatagcagggccctcaccttggttcctgcaattgcctcacttcccatctctcctaatcactgtggcttcattccttttcagttttggttcccaaagtaactctaaccagggatctcttttatatgacagtatttagcagattggtattttaaatgttttagagtgtggttcctggcaggcctttttttgttgtttggtttttgtccacagtgtgagcaataaagatcttaattaaagaaattaatgaaaatgtcacctagagttggaagctcaattcacagtgttgggttgctggttccctactaatagattatatcctggcaacactgtcacagtacagcaataaaaactgttctggcatcttccaggtccaccacagagtctcattcttgctgttatgtctggactgaactcagagtaacccagaatcttcctcatacaagccttgtccacctatattctattctcgaatcatatctgaatcagcatttaaaactcaagtcactcctcccaataaaaccctccagtaatatcccatttaatttttggcttggcttataactttcatatatttacatatttcaacatatggaaggagacaccttcatttatactcttgccctggttcattcaaacattaagggtgaacatgcatcctgctgcctgttaaagagagtaatattaattttactaagcctaaaataatattttaaagtataaggacatactacagagaaaatcacatgatagaatataatgaagtaaaaatacccattctgaacagatctaccttgtaagagagtaattaagttaaaggcttgaggcactctccaaagaggagaccacacccaaaatgatcgaatcgtgatggtgtattgactgttattgataaataacattagcatattaactatatttacctcaaacttttcctaatggagctagtatattctgtaagtaaataactttccctcttctttggttcagcacacccaaagttcagtaatccagttgttgcatgatattcaattaaattgcacctttacgccaatgactacaattaaaatggaaatccattctctttctctctttctctagattacagacttgggctctttcatacattcaaaaacaagcaagccagatacacagttatcctcaacacttgtgtcttccttatccagaccttgcaaattcagttaggtactgtttctcaaaactcttatttagacccttcatcactgcttccataaaactccctttatttttccctgctttgttgcagtaatcccctatcttgtctactttctgtagattcatctttctaaaccattcaccatccacctctgcttttttgagcagtgcttcttaaagtatggttcccgtatcagcagcatcacatcactcaggagttgttagaaatgcaaactcttgggttccaccccagaactactgagtcagaagctctggaggtggggcccagccatctgtgtttcaacaagccctccaagtgattatcatgcattttaaaatttgaaaaccaaggttctaaagtcatatttttaaaaggcaaaaccaatcatgtcatttgcttgcttaaaacttctttaatgagtctcttctgaaggataaaagccaagttcttgggaagacgtgtaataccctttctgttctcatatttcagcccttctctttccacttcctccttcccacccagtgttttagtcatataaatgttttgaaatattgtgaagcaacctgctttttctgcctttttgccttttcctagtgcacctcttcccacacacaattcatccacctggaggggttccattcatctttccagatcaagctcaaatgtcccctttttcagaatgatttctgagggctaatttcaataacttacttacagcctattccacttcttccaggtccacctacataattttcccaaattaaatttttatacctccagctctttaaaaggaaagaaagtctgtttactgggcaaggaggcataggaaaaaatataaagggcactgcttatcccacctcacatcctcccacccctagttcacaagttaaagattgtcatccatctcttggaatagttatggctccttaaggatgttaatgccccctcctagatgttgtctcaattgtttattggtaagcccactcctagatatgcaggacccaaagcaatagtagaaagggaggcctacataccacatttaaatatttaaaagttatttaaaaactaagaaactttaataaaatatgttctatcattgtgctgccttaaatatataatttttaatgacaaatgaaaagtattatgtaaggcaatagtttttagataactaaaagctggcaaaatatcaaagatattcagtgcaatatttgatagcatacctgggcattctcttgatgagatagcaatgtttaggtaagtaataaaatgaaaccagcttaattcataaacacacatgtgttccataaaatttatatttctcctctttatttcatcaaaattatattgctatggtcaagatttttaatttcttgacagggatgagccaaaggatttaaaataaaatgaaattgtattgaagttagaaaattcaaatatatttcattaaaaattaaatataaaaacaaaaataaaattatttttttcataattcttaaatattcaaattatctattaagtcaaaaactgaaatgcatataaggaatatcacattttaatttcagaatatttcattaaagctgacattttctcatttaattttgtctcatttaacattgagcatccactatccatttgcttgccaatatgaagaattggtagcacacttcatacttattttctctaaccctacatatagacaaatgtaggagtactatgatttatttaataatccaaaatatacttatcgtgtacaaatgttatgctaatttgtctggactttcaaatctaccaatgaaacatgaacagatacaagaaaatggatgttcagctctacccaggaaaacaatcctcgattctgcaatgatttggtgcgttcattccacaaggaagaatttgaaaataatttatgtatattttctctatagtgctcaaatcctagcccaccccacccacctgctgcaaaataagatgttcatctctcatattgacagcagttcaaactgcaaatgttcatggcatttgagctttgttatctttttgctactaggatgtaagaaaaattgtggagaagaattttccggtagcccgagtaatattaaccacgagagtgaatgtttagagttacagattgcactgagccagtgctgtaggccagaattgaggcaacagaggcatttatgtttgtgtttttgtcatatgtggggccctctaatgcatggggcccaggacaaagacctttctttcctggatctaagcatggcactacctaggtgtttgatggctttaccctaggagtaaggttgagttttaaggtgctatcctagggaataatttcaatatatcttggagttggaacttctatacatttgcagtgcgtcacccgactttggtctatcaaagcaaaaaaacttggtcaggctttggtgcctagctatctggtcaaatatttatctaaatgtttctgtgaaggtattttacagacgtggtgagcatttcttaatcaactgactttaattaaagagtttacccttgataatgtaggtgggcttcacccagtaagttggaagccataaaagcaaaagataaaaacagaaaaaaaaaaaaacagaaaactgaggtatcccccataagaagggattctgccttaagactaacatagaaatcctgcctgagtttccagcctgccaacctgccctacaaatttcagatctaatattgcaacatcaactcttgcctgagtttatataaaacctacgcgatagatttcagacctgccagcccccgccatgtaagccaattccttttggaggaccccgactgacacaggtaaataattccatcttcttttatcccagtccccaaaggcagataaagaaaatgtaaacatatatatgtactatataccttatctttataccttctgatagcacgttggacaaaccacggtttctagaatttatggcatagtattataatcataggtttcaaagtctgtctcctattctagactggaagttccttgtgtgcagaggctgtgttatcacagcgctttttgaggctggaaataaacgttcaatacatgtctgtcaaaggttagagaatcaaaattaacacattacctggataagctggcatgtggtggggacaggagtaggggatggtggaagagcaaggagaaagaatcaaacaatgtggacgtaggaagcagtctccctgaagctaagacaccccatgagatggtactcatccagctttgccaagctcccagcacagtcttaatcacctctctcacagcgactttgatagctctggctaaggaacttgatacctgcaagcaattaactttaataagccagcaggtgatttccttgagaatgctgacgattcaatttgctgacagcagctctagattctctggctactcagccatggcttctacctctgcccttatgaacccagtgtgtggttgtgagtaataaatgaaaaggtagccaaagtgtgaatccttttaacagtgaaaattgtaatcagctttaaggcatgattatatattacagacagaaccaaaaggtcttttaaagttatgaagaaaaacaaaagccaacaagttgtacagctacattggcaccaaacttttatagtttctgtgaatgtgaaatgaagggatataaaagtactttcacctgtattaaccttttttttttctgttactcatcatagcattatctaacgcagaatcctaggaatgattctaaactctttctctctgtctcaataatcctaaatgttgcaattgccttattgtcctattttactgcattattttttacacaatggcagcctaatgagttcccccggcatcagtctcaggcatcacctatcaaacaactccactgcttgcgtcctcttcccaaaatgcaaatattatttcatctgcatgtaatttcttaatagttctccattgttaattgactacagtggagtcaaatcttagaattaaattttaaggaaaaagaggcaaaagagctattttactcaaaattaacactgaatatttcttaaattgtccaaaaaatacagtatgctccccattatatatgaaactgtgcagcaatacatgtttgtatatgtagtaatttatggtaaataaatttataataaaactgtaatattataattaaatataataatataatgtaaatatcattaataatataataaaataaacttataataaagagaatgtaagctttgtgaggacagtgattttcattcattttgttcaccgatgtaccccaaaggccaaaaactgtgcttgtcatagcaggtgatcaatgaatacttgttaaatgaaaatcacataacaattgattaacaccattttaacaattgatttgacaattgttatgtcactgacaattgtttgttaaaatcatttcaaataactttattttccctttttgtgcaacacatttaccactaaagtaacatagaaagtctgtgtgtggtggaaagtcattaatttacattgctttctaggtactaccgtcttccatgatctgcgctatccgttctgcacttatactttgacttcagtgtatcaaatcactcaatgttctccaaatatgctgtgcaaagatctttgcactttgattcctcaagccaatttaagtgtcctgtgatcttacgaactttgtttttcctctattttcaatgtttatttcattgcatttttatcgttttcttgtgggtctgccttcttgatcagattctaagactcttgattataaaatctatgtcttaatagtgtttttaatagtgtctctagtacaatgtcggtgtatcaatagacacatacagagtatctgatttatattaagtgtttatttgtctgtctgtgccattatgaccacatatgttacacttgaactttctgaccctaagttaacatctgataacatgtgttctacattttaggagcaaaagatatacttaattatttcaacaaactaatgagcaaacaattttagtatcagcctgcagtaaatactctttgatccagtatccagaatccagtacacagtatccactgtgtagcagcttctgcacatggggcatcaagggtaccaccccagaaaaactgctatgaccagaagtattgcagagaccagggtaaccagaagcacgatcatctcagaatatacctgcagcagcatgcctacagtggccttatatggtttgtgggcaagagaccattgtgaggaagtcagagaaacatatttgagtcactttgttcctatgcaaatatatgcctcccagagatcttcttgagttggcagagagggactttgctgtgggagaggggagatatgttttttggcctcaatggtagcagctaggcaccagtataatttgatattaatctagatgcctgcatttcaactcacctctcaggcgggaatatggactcaggcttttagaaagctttttcacaatgggggacaaagtagcaagtgaaagaaaagggtaaagtggaaggaaaaccttttcctgatggttaagcagttcctaacttacatgtatgaatgcatacatacaaatataaatactagcttaaagaagaataccctatcccatgcactccaggtaattaaatgtttatttcactctgatttgagatgtctcacgatgctaaggaaaatattggaaagaccttctctctcgttatctcaccttcagttaaaaaaaaatgaaagagagaagaagagagaaaagagataaatagaagggctatttgaaggtaagaaggtgaaggcagtcaccttttatgccttcctcccttcctcctgccaatcatccactctatttggttgactcccaagcttgctttataaacagctggagagcaaagcaaaacttcaactttagaaagataaggtcaactcatcctttcatttgcaacaagttgatagggccattgccgtgcaggtttggctggtcctggacaaaaccgccttctccagaatgggatttagaggaagacccttctctctctaatgtgactgaggaaaacagaaggaaggtaggcaaaggagatctgctctaggccaggcacagtggctcacgcctataattcaagcactttgggagactcaggcgggtggatcacctgaggtcaggagttcgagatctgcctggccaacatggtgaacccccatctctactaaaaatacaaaaaaatagctgggcgtgatggtgggcacctgtaatctgagctacttgggaggctgaggcaggagaattgcttgaactcggaggcagaggttgcagtgagccgagatcgcgccactgcactccagcctgggtgacagagagagaccctgtctcaaaaaaagaaaagaaaagaaaagaaaacaaaaagacctgctctccagtagcctctgaggccccaacttcccagaatgggagtgttgatcaggacctatggtaaatgtttcctactccagtccaacagctcactgggctaaacaaaagaggcccttcacagcctcggggcagacccacaaatatttttatttaattggtttgagatggggccacagactttttggactggtccccaggtgaatcacacgtacagacaaaattcagaagcactgggttagagggccagcatgagggctagagtgagagttcagatactgcagggagaggctatgggatttcctcacggaaagagacccaagggtgtggaaggcattttctggaagatgactgaggtacttggttatgggcaagacagtctaatttacaaaaacatgataaacctctcgagcaaagcttttcaagctgtgcaccccagaaggtgtgcaagatgagccatgacaacatataagaaaacaactgaatgtaacatttccattctaatttttataaaatttctttgttttacttattagtatagtagtgcatatgtattatttataaataaagaaacatttattaggagtatagcctcaacatcattttactaatgggcataaataattctaaaatttggaaactagtgttctaaagaaggaccatgattcctcactgaaggctcagctgagaaagctgtgataaccaggcaaaccagagaggaacttcatccagttgcctggtaagaatgatgaatattctgggttgctaagaaaatacatcagccagaagggagcaagagaggctgccctgctggggaatgtttgggagaccataaaaacagaaggtgggagcaacgagagggctcttcatcgctactgttaataacaaaacaatagcaacaaatgtaatacctgctcttacttactgaattcccagtaaggtcaagcactgtgataggcactttttgggcatcactgttaatcctcatgctgtcatacccattttacagattaggaggaaaaaaacctttaaaaaccataagtggtgcaacacagatattctactccaaactcaatgttcctgacattatgtcatgcagtttcaagagcatggatcatgagtgacattaggaaactgagagaagaagcatattatagcacttagagggtattatagtataaccaggttgtatttatcagctgtcttttctttcaattaaaatgctaaaggccgggtgcggtggctcatgcctgtaatcccagcactttgggaggctgaggcgggtggatcacgaggtcaggagatcaagaccatcatggctaacatggtgaaaccccgtctctactaaaaatacaaaaaattagccgggcgtggtggcaggtgcctgtagtcccagctactgaggaggctgaggcaggagaaggatgtgaacctgggaggcggagcttgcagtgagcctagattgcgacactgcactccagactggacgacagagcgagaccctgtctcaaaaaaaaaaaaaaatgctaaactgtggttgatgttttcataaacagagaattggtgctagcttcccaggcaatttgagagaatagattttcctgagtgtaagtaaacctacaagttaaaagaagtgacatccactgggagactcaggccaaatgtgatttcttccatacaaagtcaggtttatcaactccctccccccaccccaccacacacagaaacacacttttaatacttgcttttacactctgcatctgtgttcactttttccattgaccctccaaccaaatttgtggttctaaagctctgacatcaacagtgcattcctgagggtacttctctaggactgtcttcattttaagtctttgctcataggcacaactgtaaacttataagaagtttcaagcaactgtagagtaataagaatcagatctgtcctggggttgtggcgggggtgggcgggggaagtgtggctcttgagtagacagagacttggcatgacagtccttgtttaggattgggactcaagagattccaggaaagtcagtgtcccttccgtccaatcacagtgtgaggcccggtgattctggccttttctgctctatcattcagaaatgaagtcttttctgctctatcattcaggaaagaagtcttttctgctctatcattctagcttcttagccaccttgttggtttttatggattttctttttaccctgctcctgcctagcaagaaagaataaagaaaagggagaggaggggagagaaaggagctgactctgcagaccacaactttataattatttgaatataaaattagctggtaatgtctctctctttatgcaggctatgagatacatgatagttgtttctagtaacatatgttttctcatttttatcttttgaaatgttgttgaagtattcctaacttttatggctattaatggaggatgctgctaccatcctacccaagggcccatttttctaaatcctacaatcctctacgaatggaagcaatagcactacagttaacactctaaattgtacccttgtgcacacatacaggcctaaatcacttggccttatagccacaaaacacaattaggaaggactaaggtcatcaaaaaaaatcctaaatgccagttcactgcacagcacattctatagtcatcttacttacttgttcttgataaaaatgaatcccagcagggactagaatggtgaccctgattgtgaataatggcacacatgcagtgtccctcaatggctaccagaaaacaacagcatcagttaatagcctgtgttgtctcttaactgcccattgccagcaataggttttgctctatatagtctggattcccagtttcaagggtcttcactcctaccaggcaaaagtgctgtaatgagaacaagccaagaaaggaatgaggcaggcaacaagccaaaatccaggcagtgttagaacagccttgtcagggaagcagagaaacaaataattgaaattagaaaaaactagattttcagaggagtctcataaatcagacttgaaaatttaatttgagagcttttctctttctttcatcatattttttcccctcctggagctgtgctacaggcctgaacagaggaagtggaatgtaattaatcgatgtaaatctgcttcattaatggattgctactccctgtgtttcctctagtcaagaatgtttctgaaagtgctctctgacaacaatgctattcacagtctggataatggtaccaagcaggagaagaaacgatgaagtacttgcatgaagggagcccatgtttgctattgactggtagagaaatttagttagctcattaaatgttctgcttacaaaccctattcatgctttttaatcaattgatacttgtcctcctttctcacattgattaaataccaggaagtcctcacaagatagtgagatgtgaagttcccattgcagttaacaaatggtcctaagacccttagaaaacacatggttgtgcatctttatgcccacagggaatacgccattaatctgaactaataaagaggaacagcaggctaatcatagctcatttatatttggccctggaatgtgttatgtggtttttggcagaagatttaccttactaattatgtcttacttaaattaataatacagttaatttgcattcccttagcacacaccaattgacagtgagaagaaatgtgctaagtgataaggggatatcatctcgaaatttaaaagcttcattgaataatttgtgtatatatgtatgtgttgacactatatacatttaggacaaaaactctcaacatactttggaaagagaagttaaaattatgtgtgaaaatcgctatcaccttttggctaatttgcatcatcattgtttcaatattttatctcactacttctgagaccaataaattagaaagttaaacctgtaatcaacaaatatgtgtatatgtaacctaccatatcctgagcactgttctcagtattgtaaagggatttgaagaaatatacagtcattactctgtttcaaagtggggactggttccaggacccccatggacaccaaaattcatggatgctgaagtctctgatataaaatgatgtagtatatgcacaaaacctatgcacatcctcctatttactttaaatcatacctagattacttataatttataactcaatgtatgtgttatgcaaaatagttgttattgtactctgcattgtatagggaataatgacaagaaaggaaaagtttgtacatgttcagtacacacacaactactatagacctaaccacatttttcatctgtagttggttaaatacatggatatggaacccatagatactaagggccaactgtaggctattttctatcttaagatctaaaaatctggagaaagaaatattaagagatctagcactaatatgctttaggtgatctttgccttgtttgtagagactacaactcatttacaaaccatctcctatagacctggattgctgatgtggggaagaaaaaattaaggggtttacctttaagcagagtcaaggaggttaagaccaggtatctgattttccagtaaatgaagttgatgaacacaataaacccatgtatcattgctaaagtgctgtaaagtagagctttaatgccctctgtcaacttagaatcaagagtaaatatccactagcaattctacactggtataacaacattgcccagttactccacctttgaaatcttcccagacggacagttgttcaccatggcagatatgaagattcaaatatgtttgagctatacgaagtacatgataatgtaatgttgatctatctggttttggatgcatgaagcaatggtccaaacttggatatggaaaggaaacctcacttgtttcacaaatcacaggcatatttgtttcagatattgtaacacaatgattttcacccctctcacttttagcacaagtgttgcataagacccttggaagttggcctaatactagagatatcactaagtcttttttataatctatttctgattaattagtcctttaggataacatatacttatcaatatcattatgacattgcaggaaaaacaaaagcggtatgggtggattcatctcctctaaacttctttctttatggtcttgaacaaattactaaattgtaatgagtaaaatatgtatgttaatacccacattataatgtagttataagagctcgacataatgtatgttgagtgcttttgcaaagtgctttatattttagaaatactctccttttagtgcagccatactttgattctttttcattgcaatgacatggaaatttcaggacacaaaaatcagagtggccaaagaatttcatgggttcctttcaaaggataaaacaggaaattagaaagaataagtatgatataattcaaaatgtaaagccaatatctcgccaacttattaatacataaaattatatgccaatcttaacagaaatgaatgctacaacgtggtttgctaagctaattcaataggactacattaataaagttcctataacaattgagatggtaatctcatgttacagttggctagtctggccaatccaacaatactacattctattttgaacatcacttggagtggtattaccaaaaaataaactggaaagcatttagacaagaatggctcagacaaggtaagagctaaaagtaaccatttgaagggactataaaattcacctcagagaagagggagcatatggaatacatgagggctgacttcaaatatttcaagagttgttgccaggaagaactttaaacatagagtaactgatgtttaactcatgccgtgaactcatccactgtatgtttgaaaaccagtagcccagtagcctgttgggaagacagatttgtttcatatgtaagtaaagacaattcttcttattgaaaaaagcatggacataagatctgataaatccagcagaaaatttcaccttcaatcaagtagcaatgtgaccctaaatataaaacctctttgagcttatttttccaaactataaatcatgtcaacaataaggctgatacaaggattacctaagagaacatgtttaaaagcaccagcataatgctttaaatttcatagatgtgtaacaagaactaattctaacagtcatatgtcaaagatgttcaaagatggaattgagtgttatgggagacaataattttcctatgctagaaattgtttaggcaaaggctaaataaccacttggaagaatacaaaagaggaaagtcaagcttcagaattaaaattagattactttcaggattcctttcaactctaaatctgaagatcttgtgatacaaacattaaaaaaaagtttgcctaggaaaaaatatcaagaatagcaacagttatatctacaagagtaggtaaaaattgactaatatttgaaaaattagtctagctccctattaaagtatatagtttattactcttttaaactagtcaaggggaaaaaataaataatattggtaaaactcaatgcagatcatatttcattaaacaagaacatctttctttgccagatgtataggttagttatacactttcagaggatactatgataatgatcatatacaataacccagttgtcccattctttgatattaataattaaagcaatatttcttttggagaagttattcctttaaaaattcaactggtaggataaatctaatagagaagtagcacacagctaaaaacagaagttttagtaaattaatgagtggaatgttgaattcagcagtagctttaactaatgttgtgaactcatccactgtatatcagaaaaatttacagtacgttagaaaataatttgtgaaaccaatagcccagttgtctaggaacaaatgcacatcaagtaatagggaatatttttaataaaatttagtagattatggtgtaaggttttatacacaaatgtaaaggttttaattcaaatgtgataaaggagatgtttgtggatttatttagggtataaaaagccacatttttaatataaaactttattaatgtgacgaaattttggaattaaaagtagtaggacgcttacatcatatccctcactaaatgaagggcgtattgtttatgaaataatgttacatgagaaagaagacaatattgcacatacatattaacaaagtccttagctatccataaaatctagtttttccttcattactagtaacagatgtgtagcttttgcaagtggctaccagaaacactacatttcccagtctagcttgtagttggaaggaatcatgtggctaatttcaggagaaggtaagcagaaataatgtgtgacactgatacctgtaagaccagccctgtatttttcttgtacatttaagttccctgtacactctggatattagacctttgtcagatggatagattgtaaaaactttctcccattctataggttatctgtttactctgatgatagtttattttgctgtgtagaagctcttcggtttacttagatctcatttgtcaatttttgcttttaatgcaattgctttgggtgttttcatcatgaaatctttgccccatgcctatgtcctgaatggtattgcctaattttcttctagcgtttttatattacagttttgggtttttcatttaagtccttttttatttttatttttatttttggcagagtctcactccgtcacccaggctggagtgcagtggtgcaacctctgtcattgcaacttctgtttcccgcgttaagtgattcttgtgcctctggctctcgaatagctggaattataggtgtgtgcaaccatgcccagctaatttttgtatttttagtagagacagggtttcaccatgtttgccaggctgatctcgaactcctgacctcaagtgatctgcccacctgggcctcccaaaatgctaagattacaggcatgagccatggcatccagccttatttaagtttttaatagatcttgagttaatttttgtatatggtataaggaaggtgtccagcttcaattttctgcatatgactagccagcactctcagcatgatttattaaataaggagtcctttccccattacttgtttttgtcaagtttgtctaagattagatggttgtaagtgtgtggtcttatttctgagttatctattctgttccattggtttacatgtctgttcttgtaccagtgctataaaaagtggacatgaacagacatttgtcaaaagaagacatacatggagccaacaaacatatgaaaaacagctcaacatcactgatcattagagaaatgcaaatcaaaaccacaaagaaataccatctcatgccagtcagaatagctattaaaaagtcaaaaaacaacagatgctggcgaggttacggagaaaaaggaatatttttacactgcaggtgagagtgcaaattagttcaacaattgcggaagacagtgtggcaattcctcaaagatctagaggcagaaatgccatttgacccagcaatcccattactgggtatatacccaaagaaatataaattattctattatgttcacagcaatgtggatggaattggagatcattattctaagtgaagtaactcaggaatggaaaaccaaacattgtatgttctcacttataagtgggagctaagctatgaggatgcaaaggcataagaattatacagtgaactttggggactcaggggaaagggtggaagggggcgagggataaaagactacaaattggatacagtgtatattgcttgggtgatgagtgcaccaacatctcacaaaaacaccacaaaagaacttactcatgtaaccaaacaccatgtgttcccccaaaacctaaggaaatttaaaaaattttaaaatcattctattataggccaggcgtggtggctcatgcctgtaatcccagcactttgggaggctgaggcgggcggatcacgaggtcaggagatcgagaccatcctggctaatgcggtgaaaccctgtctctactaaaaatacaaaaaaaattagccaggcgtggtggcaggtgcctgtagtcccagctactggggaggctgaggcaggtgaatggcgtgaacccaggaggcagagcttgcagtaagccgagattgtgccactgcactccagcctgggtgacagagcgatactctgtctgaaaaaaaaaaaaaaagatcattctattataaagatacatgtattcatatattcattgcagcatgagtcacaataacaaagacatggaatcaacctaaatgcctgttaatgatagactggataaagaaaatgtgatacacatacaccatggaatactatgcagccataaaaaggaatgagatcatgtcatttgcagggacatggatggagttgaaagccattatgctcagcaaactaacgaaggaatagaaaactaaacactgcatgttctcacttataagtgggagctgaatgatgagaacacatggacacattgttggagggaacaacacacactggagcctgtcggcatggggtggggacagggagtgcatcaagaagaacagttaatggattctgggcttactacctagatgatgagatgatctgtgcagcaaactaccatgacacatgtttatctatgtaacaaacctatacattttgcacatgtacccctgaacttaaaatttaaaaaaagaccagtcctgtcttttcacattcccctgatctcttcctatgagctggaataataaaaaccagagtgatcttttatatcacatggtgaataaggcagaggcactaccagaataagaccttgagtgactatgtggaaggaaggcactgctaacccagaatactcatttgcaattgttatgtgagaaaaatacacttctatcttgtctgagctattgaatcttactttatttgtttcagtagtttagcatttgaccctaaaaactactctgactaaaactatgcaaaaatgcatgtttatctaatcatagagataacaagaagccctaggaaagtacaaagtgattgttttaaggtaatattttataaaatttaagtattttccaattatgtgacaacatttcttttggataattattatggatcagtcaagggccaaatacacaataaattgttcaatagattcagtcttcctctgaaatccaaggaaggccatatataaaaacaggagcaaattgctaggggaattcatatttgattcctaattgtacatttaccagaagaaaatttggcatttgaattgagcatttaaattcactactattcaacagcaatctgaatccccaagttcaattaaaaaggtcattaccctctagaactggaggtgctcttttaattacaatattgctaatgaattgggagacaagacattttggcttagttcaattagcacatttaagtcaaagcaaacttcagccaatatgggtgactttcccagtggcatgctttttctttattccctccttccctccctcccttccttctttttgtgtcttccctacttccttctttcctcggaaatttaagcataactctggcacgtaagtctctcatttccattttatctgtaaactgctgcaaagctgttaatagctaaggacctacaaccacatttttgttttgcaaaactcttcaaatttatatgaatattgagaaaacattttgatgagaaatttttaacatagctttctgaagcagagtaaaacataaatttcactttccctagctaaaacaataattatccaatcactttatcatggtgtattgcacatgcttttgctatgggaaagggggaaaagtgaacatatttaacactttgctaccaacaatggtttattgaggttaatttatattaggaaagtggagtttccggatgacattccaaactaaagaatactaatgaatagctcctgagctctgagctttcctgcctggctagaattcacaggacatgaccttaaatgtaacagtttttggtaaaaaagagaaaatcttcccttcaaagtgatttgaaaagttcagaaaattagctcttatgctcaaactaatagtaacaaaaacactgctaccagattaaatttaaataaagttcataacagctgtttgtaacatctagatttaactttaggggaaataattgactcaatttgcccaggttattctcttcctttgctatgccagtaaagggcttggagaggttgcccatgcaacatatcctacagatttgagtcagctagactaggtgtttattcatttattcaggaaatacactgagcagcctactgtgagcttggaggtgggcaaacaaaacagagaaaaatctagacctctctctctctgtaaattgacataaagatagttttagccaaggaggaacaatttccttctaatttagcactacagagtgttctccttggaaaagccatccacttggctttgtaccctgattagtctgttctcacactggtaataacgacattctcgagactggttcatttataaagaaaagaggtttaatcgactcacagttcagcatggctgaggaggcctagaaaacttacaatgatggtggaaggagaagcaaacaggtccttcttcacgtggtggcaggaaggagaagtaccaagcaaagagggaaaagctctttataaaaccatcagatctcgtgagaattcagtcactattacgagaacaggagcatgggggtaactgcccccaagattcaattaactcccactgggtccctcccatgacccatggggattatggaaaatacaattcaagatgggatttgggtggggacacagccaaacattatcccctaaacaaagtcataccttttcttttttttttaaagaaacagattctcattctgttacccaggctggagtgcagcgacatgatctcagctcactgcaacctccacctcccaggttcaagtgattctcatgcctcagcctcctgagtagctgggattacaggcaccagccaccgcgcccagctgatttttggatttttagtagagacgaggtttcaccatgttgaactggctggtcttgaattcctgatctcaagtgaccctcctgcctcagcctcccaaagtgctaggattacaagtgtcagccaccacacctggtcaagtcatacctttttaaaatatattctcctttattatattcaagtaagatatgttctttaaagaaaatttagaaaaaaaagaagaaaaaacaaatatcttctttctttgccaaagcaaaaactgctaacatttttaaaattttctttcgaatttcatctctttaactctcttgtgtgtagtagaaaaaaaagttgtaattatattgttttttaaatttgtgctaagttttaatgcaaacttttcataaaacatttagtggaagcatattccttaatttataacatattatgatttttcttattgttttcttcattgcagattataattaagatgatcaacttttcagataacactttcctaggagaagtgttgagtcaaagaataaatatgtatgtttttattttaaagtatatatgtatacacgaacacacacaaatatatatgtatatattttttatttgtttaatttgtattgttaaagggcttttccaaaagattgaaacaaattatactccatctaaaaaaaatgcttacttaacctcactcaggtatatacataatccacagcttactcagatgtatatataattttctaatgagttaggaaaatgattacatgcctaagattttctctgtatttgtaactaaagtatggtgatttgtgaaaagcttctttacatctattttctattaagatgttgttaaatttttttgcctatctttgaggtttcttttcaatggcttattgtgtgtaaaataaaccatgataaaactattaggtaatctttaaaaaacaatttctaagagtgctgtacatattaaaaatatgaactttatattggccacatttattgcaaatattttcccagatataattagttttaattttatttatgacatgttttaccaaaaagtacaagttttatataactaattgtgatgtatttcttatatcaagatgttaaccaatattttttattcaattcttatttttcacttctgataaatttccatggtatttgtctcaaagctccacataattctcatcattccttaaaaaaaaatattgactttttaaagaaacttcttttacttattgaattttattactcattccaaaaatggttaattttcttctctctcttttcttctctctctctaaacatataatctaaacaacaccttttaagttgtttttcttctccagtaattatcttccttatttccactcttatcacagaagccaaacttccagaactatataaaataataataataatgggaatctgaactattagttgttaatataatattgatatttttcagcatgttaagaaaatacctttttatttctaaatttctcaaaagtattttgttggtggtgctggtggagaactatttttacatttaaagccagaaatgattagttatataaaactctgactttaaatgtaaaaaagtgcattacattatgaattttattacagccaggcatggtggctcacacctgtaatcccagtgctctgggaggccaaggcgggtggatcacaaggtcaggagttcgagaccagcctggccaacatggtgaaactctgtctctactaaaaatacaaaaaattagccgggcgtggtggcaggcgcctgtaattccagctactcaggaggctgaggcaggagaatctcttgaactcgagaggtggaggttgcagtgagctgagactgtgccactgcactccagcctgggcaacactgtctcaaaaaaaggaagactgtttcaaaaaaaaaaaaaaaagaaattttattacattacggaatcttttttaaggcatttgcaatatattcagtggctagctttgcaaaaagttcttatgaatttgttttatagataagatgttcaatattgtcagcattttttgattaaatatcttttttatcttttattgataaaacaatattttttattatatattattaaagtaagttattctgtataacagactaggcaacagtgaaagttttctaaatgctttcttgattcaccttaatattgaattttgctatctataataaaaaattctataattattacctttttgttatctttgtcaggctttttataaggtaataattatagaatttttggggaaaataaatcaattggtagctttccatacttttgcatgtcttacaacaaattctatagcataggaataattcttttaaaaaccctaaatactttgggaccaaattcttatttagaggtaactaacattttgatactactcatgactaatggtacattaagaatgtttttattttctggctcaatttaggtagtgtatattttctcagaaaaatggcttctgagaccttcaaacatactaagatttaattttacataatatttccttattttaaaaagttattcttaatatatttccattttaatttataacatttataactttatatatatttactcttactatttgattcactatgggtcagtcttgttttgtttgaaataaccagagttgattaagttatcaactcttctgatacctttcttctaataaataaattcttgcttttatctccatcattgtctttcctccattttcttctacttttttaattgaagaggatattatagaagaaattgttatttcttcacaattcttccttagctctcactcttgccatggttcactgtgggcagagtaaattccttggctccactgacctaggcctgaccatgagagttgctttaataacatttaggtagaaaagaagttgtgtcacatccaaataggggctttatggagcattccatgtgtccctctccacgtgtcttgtgttcttacccttgccttgggaacatgcttcccatttggcggctgatccttcagtcagcatcccagaaatagaaaaatgcataaagcagacatcagtccaacctgcagagtgcagttgagccacagcgcccaacaacgacccagcctctcttattcaacgtgctgggaaacaaacatttattacagccattgagattctgtactgtcatggaggaagacctagtgaaaagtgacgaatactttttttttttttagactgagtctcgccctgtcgcccaggctggagtgcagtggtgccatcttgactcactgcaacttccgcctcccgggttcaagcaattctcctgcctcagcctcccgagtagctgggactacaggcgcacgccgccacacccggctaattttttttttttttaattttagtggagactgggtttcaccatgttgcccaggctggtctcgaactcctgagctgaggcaatctgcctgcctcggcctcccaatgtgctgagattacaggagtgatctgccgcacccaggcaactaatacaattttacattattctttctatcattataaattgaaccccttctttatgctccatcttacctgtttattaataataaggctaaaattatgccactgtgtacagctttgtaaatgggccaaaaatttaataattttatgttaaaacattctaaaagtatgaaattatagttattatttcctatttgacctaatatatatttacaatatatattttaaaatttctatctgtgtgcttttatcatttaatccgtattattcgtttacagcattcttgcagtgttttcagagagatgtggtcttacaatttttgagttttcaaatagatttaggttgcttatatggcttacaatgtgatattttaaaatcacattactgttttggtaaatagttgaaaaacatttgatttttaataacactttaaatgttttaaacttaatctgaatatttgaatttaatttgggatataaatctatgtgccttgattatgatgactggtaagattcactttatctctgcactgtgtgctttaattttcttcagtgatacaaaaccaaaacattcatatcctcctaaatttttaagcgcattcttaaaccatttcctctgattaacaaatttatgaaaaatacaaaaacattggcctgtgcatgtttcatcccccaacacacactagtgtaaaataattttttatttctagttcacttaaattttcagtatttgacaagatattttgaggatacagttgttgattatgactgtttaatggccaaacttttcatatatttattctctgggaatttttttaacatttgcaaaatattccgtggccagtgttgcaaaagtttttaaaaatctttatgttgaactggaatcatgcccacaccactgtatatatgttatttaattctctagttcttagttgccgcattctcatttttcattttattggagcatattttcaagtaggattattcaaaaatgattcatcaatgatatatgttttgaatcctttacaatttcaagaatgtcttcacatagaaatgacaacatggctacatttataaatattgaaatgcaatttttttccctgtgagactccatataagtgacttcttctagcatttattatggtgcaaactttgaatctaacttaaaagttgtacttttttttttttttgagatggagtctcgctctgtcaccaggctcgagtgcactggtgtgatcatggctcaccgcaacctctgactgcctggttcaagtgattctcctgcctcaactcctgagtagctgggattacaggcatgtgccaccacacctagctaatttttgtatttttagtagacatggggtttcaccatgttggccaggatagtctcgatctcgtgaccttgtgatctgcccgccttggcctcccaaagtgctgggattacaggcatgagccatcgcgcccggccaaaatttgtgcttttaagtaacatccttctcttccctgcactgaaggatatgactttgttattgacattttaaaaatctaacagtatattctaggcataggtctttttcaccagctttccatgaaacatagtgatccttttaaacttacaaagccaaaatcttattagttctataatagctgttttattatgactttgattattctttttggtcagtttgttttggcttaattcccaaggattgtcagctatctacaaattgcatctttgttttctttccttgatatctattatgtttttgattgatctgcattcttaatgtacttttcaaagttgttctttaagtcactgactgcatttcatagttagctgattctgtttttaccacctccaatgaatacttttatcagtttgatgtattctttctaattttccttctcatcccatattttttatgctcacaagctgcatctctgcaaatgacaactttgtatcatctttaatctcttctgtagtgaatttgtcttttctggttctttattgaaaaagcaaatatacattctagaaaaaatatgtttctaaaataattacttctgtttgcaatgttaggacatcaaatttttcttatgttagctctttctgtagaaagagtttggtcttcatcgatttgaacaaggggatctttacccatatacacgtttcatgtaaataagtgtatgtattcattttaatctccatcactatttccctgtgtacatccagatattccttttctgatcttgtcaatgaaacccagattaagtgagattgtatcatctcctgtttccctaatccttgcagtaaagtaggtgtatttatttctggataattttaagcagcctgaaattattttcttctatttcccgcactactggtattttacagttctacttataatttgctttataaatgtgttgtgtggttttcccaacccttttcacctctaaacatgctgtatggaagttgcaatctccagaatagaggaagaaagatagtgatgtgtgagggggatgtggaggaggatacaaaataaatttcagtcatctcagtcacccatagacctgggattatcactaaattctctagatatatacagagattataaatctctgaacaaaagatccagagtggggatgaatgaaagacatctcccacccattctaatcacttctggatccattccatctctactgtatttagagcaatggttctcaaactttagtgtccatcagaatcacctggaggacttgtaaaaacaaaacaaaacagattgctgtcacactcccagaccgtctaatttaataggactgtggtggatcctgataatttgcatttccaacaagtcccaggtgatgctgatgctgctgctctgggcaccaaatttcagaatccctaacttacagcaattcttccaagggagctcaatcacagattgaaatattttttaactttatatcagtgtgtattttcacagctatcccacgagcatgtaaggaaaggtgaattaagcatccacagctagtgatttagttaaaatatgttatgtttatatatatttatttacattatttatgcattttactattagatttctttttaagattatcttatatatagatagctatttaaaagctagttggaaatgaaatgtgtttcattgtctaatagaaccattaaaggtacattgttaagactaatttgtaacgtactggccattatatctggaataaacttgtttttagtgggggattaaataaaaatttcctaatacaaaaattgagctaagtctgattggggaaagtacagttgtgtgtttgtgtgtgtgtgtgtagacacaaacatatacataaaatatatacatatgtgtatacatatatatctgagagacttgctaaagtttatacaaagaaaaattctaatttctggctgtgtgtattaaaacatgaagaacaaagccctcctgagacaacattaagcacgtgcaagataacgtgggaatggagtaggaaaggtgtttgttcctggctggccagattcagatcatttggggaatcatgtcttgagtgcagaattgtgggtcactgtgtttctctttctctttgttgctttgagttattaaacaagagcgggggactttattaaaaagaaaatggtattaatgttttagtcctgttaatatcttgaaagttgtttccctaagagtgaccagacatggtgagactttactcaatcagcaagaataccaccatgtactttaataatgaaagaaattaggctggggctattgtaagaacagtttctgaatgacgatgcaaaatataataaacacagaagtcccacactggcacagcatctgtgaggctctggggtttatgctccctaggtttagaagattttatgtttcaactccacagacagacattttcagactacctttatgtgattacactgtaatattcaattttgtcaaattatttttctttcatgcattgaattagtccctttttcctaattctctttggaattaacaaatttagattttccagcacatggcagttccatttaagtggaataaaataagctctgttcatttctcttttgctttctacagtttgcttttctctgtgtgaaaatgctgtttctttttcaaatgtattattattctcacagacacaaacagaagctccttttgcaattgacttgcctctctttctgccattacaaaattatcactatggtagtttcatgagttagaagataagtatgattaaattccacttgaccttgtttaacccttcattcatagaacacttcctagagcaagggattttgaagctgaaatatctctttgaagctgatacataatatggagaggaaaagcaatcttgccttgaactttgaaaagcttacaatctagactgtgccactgttctaaaagcgtggtccatgaacatcataggtatcacttgtggatttgttggaaatgcagattcatggaatcacctagtgaaacagaatttttgtttaaacaaccattccaaatacactattttataaaatcctttaggtgattcttatgcatattaggtttggaggctactgctataatcaaagataaattatgattagattttttaaatgatatcttagtagatttcagaagtgaaagcaatgccttctggtgcagataaaggaagtcttctggcacttgaactgaaagtaaagaaggctttttctgggttatgatagtggatcaatggctaggtggaagggaagagatgatacaagcaaattcccaaggccaggaaaacacagatgtatcattgcatagggggcaggtaagtcaaaatacaaagtctaaagacattaccaaagtactttgtgagtaccatggaagaaaacgtctgataccagcaagagtgaggggaggcctcacagagcaatttatataaggctgggccgagatgggtaatttcaatttacaagtcatctaaactgacggctgggaaaacacaaattcagattttcagagcggaagagaccttcaggataaactaatacaattcactacacaatgcatggattcctcctctacaacaggttggatgagtgtttggcctttgctgggttctactgcacattcactagcattgcgggaagtcagggaccccgaatggagggactggctgaagccatggcagaagaacataaattgtgaagatttcatggacatttattagttccccaaattaacacttttataatttcttacacctgtccttactgcaatctctgaacataaattgtgaagatttcatgggcacttatcacttccccaatcaatacccttgtgatttcctatgcctgtctttactttagtctcttaatcccgtcatcttcataagctgaggaggatgtatgtcgcctcaggaccctgtgatgattgtgttaactgcacaaattgtttgtagagcatgtgtgtttgaacaatatgaaatctgggcaccttgaaaaaagaacaggataacagcaatgttcagggaacaagagagagaacctcaaactctgactgccggtgagccaggcggaacagaggcatatttctcctctttcaaaagcaaatgggagaaatatcgctgaattctttttctcagcaaggaacgtccctgagaaagacaatgtgtccctgaggggaagcctctgaaatggccgctttggggatggctgtcttttatggtcgtagctgtgggatgaaataagccctggtctcccatagcgctcccaggcttattaggatcaggaaattcccgcctaataaattttggtcagaccagttgtctgctctcaaaccctgtctcctgataagatgttatcaatgacaatgcatgcccgaaacttcattatcaattttaatttcgcccaggtcctgtggtcctgtgatcttgccctgcctccatttgccttgtgatatcttattaccttgtgaagcatgtgatctctgtgacccataccctattcatacactccctccccttttgaaaatcactaataaaaacttgctggttttacggctcagggggcatcacagaacctgccgacaggatgtctcccccggacacccagctttaaaatttatctcttttgtactctgtccctttatttctcagaccggctgacacttagggaatacagaaaagaacttatgtgaaatatcgggggtgaatttcacccaatacaccaggattctctcatacattaggaagatatctaattatcaagacaaagcgtcctcttctggtgttctcaatttctgtttatttgtttgacatttttacctgctcatgagtcagtatctctggtgatggaatattttaatatgtaaacatcttaccttttaactatactgctcagatagtaggtttatattttacatcatttcctctgcccctggttttctaccgtttatacatgattttttttgaataacaacctgaaagaccaaagctctaacttattttcattgatatggagtaaagtggtatacatttaaattatgtattggacataagatccaagattttccaacacacaaaccgagaatgcatttaccttcttggtatgatcacaggagcaccaacatgactggctgaccccaaacacctccccactggctgattataatagacatgtaagatacatgtattttacagggataaacttgtaatattctttcagacatctaaaaggtgaacaggcatcattgtatccatgtagatacagaatagtacctaatctctaaagaggaaaaacccttagaattagaggaaaagatcgtacaaatttaccctctgcaaataaaattaataaagtcatcagcatatgactttttacctagatatagacatttacttatatgtaaattaacccttaatatgagatattgcaaatattttctgaaaatatgagactttatctgggtttatctgagatactctaaacccattttggggagatactagagtatattcttgaacagacctgacttgcctatttctgctttaaggaaaactataatccacctaattggattgtaacatgtctggtgtgaggtacttctagttattcataaaggggaaaactgtataggaagaatgcattcagaaagagtagaaatgagatccatagaaagaaggaggaggaggtcgggtgtggtggctcatgactgtaatcccagcactttggaaggccaaggcgggtggatcactaggtcaagagatggagaccatcctggtcaacatggtgaaatcccgtctctgccaaaaatacaaaaattagctgggcacagtggcgtgtgcctgtggtcccagctacttgggaggctgaggcaggagaatcacttgaaccagggaatcagaggttgcagtgagctgagatagtgccactgcactccagcctggtgacacagtgagattccatctcaaaaaaaaaaaaaaaaaaaaaaaaaggaaagaaggaggaagaggaggaaaagcagaaagagggaagaatgaatgtaaactgcaggtggcagggctttagtctgcaagaaactgactactatgacagagcaaatgcacgctctcagacctatgagcttctaaaatgatccgaatccatgctgaaaaaggaaactttggatcactttttaggttttacaaataatcttcatgcaccaagaactgatatgatcaatttgttaaggtttgcttgtctatttagctcttcttagtatagtttttattcctttgaattggccaaaaatactgtttcttcaaataattaaggactctatgtcttttgcacatgacattctaatttggatcaaagaattaagttttgtttttgttttagtgttagaagcaccttatagatcatcaacttccatatttttaatgaaaaggttaacattttgtcaagatcactcaactagttaatgagagcattggggttaggacattggggttgtcctgtcttgtgattcaggacaactctatttccagtgctccatatcacctatttctagacagtatctaatgatcactggcttcttagaggttagtagagaaaagttgtttgccttgcatttatattttaaatatttgactttatttcaggataatgttattatataattggctaatttgcttagtttaaaatctcaaatactgttttataaggattattgtctaatccatacccctaaaataaaatgcttaccaaatggcatagagaaaaataatcagtgtaattaagcctcttttgtgtatgaataaatgaaactcctgaatctgaggtataatcactatatctttaggagttctagggtttttatgttgaggaataaattgtaataaaatatttcagaagtcagcacccaaaaatgattgtttaatgacctttgaaatatcttacttgatttcaaggtgctaaattgttttaactacactaacacaaaagctctttaaaagctaagagtcacaattcaagaccgtgggttcattattttatatggattggcacaaactcagtcacctgttcacagccagctccacccccagcgcttctcagctctcatccaccatgctgtcatcacattcttagttttcagtcaaacaaggtctggagctctctttacactgcatcatgttaacatcttatttgttagcttcaagtgtaatgcctgttcaagtttggcatatgcagaagtaaccacataggttctaaatattttaaaacttgatgtaaaaagtccagattacctcatatttagttattctgtgattggccaaggtcaaacagtaaacttggtaaaaatcacaccaaagaacaagcttatctgctggtattaactctaccatttaaaaatacattgtcaaggtgtgcagaatatctaaaggactaaagtttctgctcaccatcccttaaaagccaggcctgctgacaaaggatgtgctccataagtgtctgcatttattaaatcatttaattaattgtagaatggctactatatgtcccatacatggaggatctaatggtatataatgcagacagccttttttttttttttttttttgagacagagtctcactgtgtcgcccaggctggagtgcagtggtgtgatctcggctcactgcaagctccacctcctgggtttacaccattctcctgcctcagcctcctgagtagctgggactacaggcgcacatcaccacacctcgctatttttttttttttttttgtatttttagtagagatggagtttcactgtgttagccaggatggtctcgatctcctgacctcgtgatccgcctgccttggcctcccaaagtgctgggattacaggcgtgagccacagcgcccggcccacagacagccattattttaagtgctgataacatagctgggaagaaaagacacacaatattatccatgataaggcattagataataagtcatattaatggtatttacaattgagatatctggtagtcagttaaccttccaccaactaactatatgccatcggcatgttccttaattttcttgtttgccaaatgaaaaagaaatgcaaactagaaggtctgttaagcttttccatctctctggctgtcttcggtccaatcagacgtaacaaagttggttttgccattgggagcaaatgctaacaaataatactagataatattaggaaaacaaatttcaaggtaaaaattattagtgaagacaaagacaaatattttatgaaaggtataatagaaaacaaaagattatggactttgaatccatttagacctagtttagacctaggtacaaattctagctctactatcttctaacagtgtgatgtcaaaaagctgattcaccattcttaacattctataaaatttggcaaataatatctaactgagataaagcctgtaacatagtctggcatgcaaaagcatttacacaggatagctattaatattactacaagtattatttgcatagcattttttttccttttctaagtcctcacacattagctatgtcattttatcttcacaactactctgtaaagtggtattgtccccattctgcatttgaggaaatggaatcacaaagaggttcactcactacaataggtaactataagtggataccttctatgtctctctacacaaaaattgtggtagagagagagagagatgaaggtgagagtcccttgactccccataagtatcaaattttgcacaactatttttctcccaataagagtcaatcctaaaatgtctgcactcacaactttaaaaatattccttttctatgttgccaaaaatggatgcagtgtgtgtgtgtgtgtgtgtgtgtgcgtgcacacacatgtgcacaaaggaatgcagtgtcatggaactgcgattagtaattagtagggattattcatggcatactttatagatttttagtcagtaatgtcaagatgttttccaagagaaaaaaaaaagtcttttcatcaatataatggagattaaaagcataacagaaataaaatgctggtgaaatgtattttatacaaaggcataatagccaaagtcaagtgacagagccaggaatagaacctaattcaaatgttttgactttatttcacttaaatgttgcttacaagcttagaaagtatatattgtctcgggccttaatgctttttaattttttactgtgtgttcatatcttggatagaaaaggcactcagtctgttaacaaggtcaaaataactccttcctactcttaggaaaataataaataaatttgaaattcttcaagactaaatggttaatagcagccacacttgtgagtaggaagtctgcctttaaataatgatcacaaccatggaaatcttgagacctgtctagctccggtaaaactgcctgcaggtcacactctcactgcatcactacaatcctgttttaatgcagcaggtagctttatagctgtgaattttctgaacataaattgaattatggaaaactgacctatgcacgtcacttagctaccttccagtcataactcagatctaatctttcttagctccccgcagaaaatgtctaagactgaccacaaattccagaaattacatgtgggttggtcatgggaatgtggttttcatatactgggggatttagaaaacaggactccaaaagcagagtcacctgggcctgtgatgaataactactctggtgtgggctgttctgctccagttcttaggaaggaaggtatcctagaaacaagcaaagaaatagataaatcctgggtgatccctatgcttttcctcatttatcttcctcttgctttctaaaaaaggtttataacaatcataaaaataatacaattacgtccacagtgaggggatttttttctccactggcaccaactcataggtcaaatgggagattcatactgacaagagtccagacttctctacacagcagaattgacagtgacagtccatttcttaaagaaagctggtgtctgtgcttcctgctgtcagtccttaccacagagctcatcgactctggcatcaaaggtatcagcaccatctcatgccaaacctatacgagggaatctaactgcaaaggggctttggaaattgaaaaagtttgattacaaaaaacgttcgaatctggagattaataaccttcaaagttctgaaaacaaaaatgtgagatccatttgtgtgtctctgtgttgaaaaagcaattccgcagacattttcactgacttcaaggttaccttttttaaaaattatactactgctttcatgtttctgttctgctccttgccaatgtagttaaaaattgttccatttttgaaatcagataaatctgctaatttgagtgtgactgtcctcttgtggctgctttcctaggtatattttatagctgacagatgtactgcagctcctatataattaatatcctggagtttctatgtttaaacaaaaatgcttaaatcatattatttaactgttgatcagagataaattaaaattttcatgaataaaagacatttttaaatgggacattgtctcagcatttcttttatcccaccagatgttcattttacctgagatttgttaaatgaataaaccaattaacaattaataaaataattaattaattcagtttatttttagagcaattttaggtgctcaaaaattaagcagaaagtacagagagttcccatacacccctgtcctcacacacagacaatatacccctctgtctatatcctgcaccacagcggtgcatttgttacaatcgatgaacactgacacttcattatcacccaaagtccatagtttacataaagattttctcctaggttgggcacggtggctcacacctgtaatcccagcactttgggaggccaaggcgggcggatcacctgagatcaggagttcaagactacctggccaacatagtgaaaccccatctcttccaaaaaaaaaaaaatacaaaattagccagccatgttggcaggtagtcaccatgtagtcccagctgtcacctgtagtcccagctacttgggaggctgagacaggagaatcacttgaacccgggaggcagaggttgcagtgagccaagattgtgccgctgcactccagcctgggcaacacagggaaactccaactcaaaaaaaaaaaaaaaaaaaaaaaaaagaaaaggaaagaaagaaagaaagatattctcctggtgttgtacattgcatgcggattgacaataataacatgtatccaccgttgcagtatcctacaaaacagtttcactgccctaaaaatcttctgtgctctacctcctcacctctccctcttcactatcccctggcaaccactaatcttttactgtccacatagctttgtcttttccaaatgtcatattgtggaatcagataggatgtatcctttcagattggcttttttcacttagtaactatgcatttcagtttcttccatgtcttttcatggcttggtagctcatttttttgtgttgagtaatattcccattgtctggatataccccggtttatttattcattcacctactgaaggacatcttgattgctttcatgttttggcaattatgaataaagcttctatgaacatccatgtggaggttctagtgtggacataagttttcaaatcccttgggtaaatatcaaggagtgtgattgctgggtcttatggtaacagtatgtttagttttgtaagaaactgccaaactgtcttccaaagtggctgtaccaccagcaattgcattcccaccagcaatgaatgacaatgcttcttgctcggcatcctcaccaacacttggtattgccagtatcttggattttggccattttattagatgtgtaatagtatcttgttgttttagttggcaattccccaatgatatatgatgttgaacatcttttcatatgcttattggacatacgtatatcttctttggttagagatttgtttaggccttcagttcatttttcagtttggttgttttcttattgttgagttttaagagtactttgtacattttggatgataatagtcttttatggaatctatgtatttcaaatatattattcatgtgtgtggctttgttttcttattctcttcatattatcttttgcagaacagattgtttttattttaatgaaatccagcatatcaattgtttccttcattgatcatgactttgatgttgtatctaaaaagttgttgccattctcaaaatcatctagattttctcctatgttatcttctaaaagtgttatggttttgcagtttacatttaagtctatgacccattttgagttaatttttgagcagggtgctggggatgtgtaaagattcatttttccacatttggatgtccagttgtttcagcatcatttctgaaaaactatcttttctccattgtaatgcttttgctcctttgtcaaatgttggttgactgtctttatgtgggtctatttctatgctctctattctatactatttatctatttaccttttttgttcaaataccatactggttcaatcattacagctttacaataaggcctgaaggcaggtaatgtcagtcctccaatgttgtacttctctttcaatattgagttggctattctgtgtcttttacctgtttatataaactttagaagtaatttgtcaatgtccacaaaataacttgctaggatttgtattgagattgcattgaatctataaagttgtgaagaagtgacatgtttgacaatactgagttttcctgtccacaaatatggagtatctccatttatttagacttttaaaatatctttcatcagaggtttgtagttttcctcaatttaaatttatacctaagtatttcatttttgagggtgttaaggtgtaaatgataatatgtttttaatttaaaattccaggctgggcgtggtggctcatgtctataatcccagcactttgggaggccaaggcgggcggatcacaaggtcaggagttcaagaccagcctggccaatatggtgaaaccccgtctctgctaaaaatacaaaaattagccaggcatggtggtgcatgcctgtaatcccacctactcagaaggctgaggcagaagaatcgcttgaacccgggaggcagaggttgcagtgagcctagattgtgccactgcactgcaacctgggtgacagagtgagactatcttgaaaaaaaaaatttccacttgtccacttgtttgttgctagtatataggaaagcaattgacttttgtatattaatcatatattctgcaacctttctacaatcatttattagttccagaaagagttttttagtcaatgctttggatttttgacatagacaatcatgtcatctacaaacgaagacagttttatttctttttcccaacctaggactttttaggtttatatttattgtaatattatttgtactacctcattggattgtcccaataaatgaataggtgtgctgtccatagacattgtcttcatcttcctaatgagagaatgatgggctaagttgctcagattcacatggtattgaaatcagtatttgtttcactctatgctctttcctactacattagactatactgccttccaaggttctaacaagttttgattttaaaagcagcatcacatttcttacttaaattagtttatacatcaaatcagttaatttaatgggcaactttcctaaaatttcttttaagtgtactacacacaaaaaagaaaaacccataaactaacaaaataagttaaaaagcttacaatggatttatgtagtataaaaataggtggcaaattttttggcaattaaaaatgtttgaatgctaaaaactgcaaaacattgatttaaaaaatcaaaggaggcctgaataattggagagatataccatgtttgtggattggagaactcaatactgttaagatctcaatcctttttaaactaatataacgattcaatatgatttctatcttaatcttaacaatagttgtgtaggtactgataggcttatactaaaatttacatggaaaagctaaagaaatagagtagccaaaccaattttcttaaagaaaaagaaagaggactgacaacacctgatttcataacttactataaagttacagttttaaagacaatcttgaataaatggtagacacatagatcaatgaaacagaacacagagaccagagacatacccacacatataggccaatagatatttcacaaaggtacaaacatgatttaatagacaaatgataatcttttcagcaaataacgctgaaacaattagacatccatatgtaataaataagtaaactttgaccctttatttcacaccactaattaactaatatacaataattaatgcaaaccctaaaattatcagacttccagagaaacatagaagaaagtcttcataattctggattaggcaaaagtttcttatctaagtcataaaagcataatccatatatagtaaatttaataagtttgatttcattgaaattaaatgttctgccatggacaagatactctgaagagattagaaaaacaagccatagaaatagagaacatatttataaatcccataaataataaaaaacttgcattctaaatacataaacaacttttaaacaatacaaaataagaaaatagggcttgaaaataaaataaaagatatccacttcagaaaggaagaagtatagctatattctcagatgacatgatcttgtatatagaaaatcctaaggaagacacacacacacacgcacacacacacacactgtatgaacaagagtgactctatttaaatgctaatctgccatgtgactcctgactaaccctaagtctaggaatgcctccaagatgtctagctgatgtattactttttatatagaaatacctgttcactgtaagttttccctttcctccaaaacaacccttgatggtgttgcatacatcataggctatgaggcccatagctacctactcattccttctggagcacatatactttttccccaattcaagcctggactaagggggttgtggtgcagagatctacctatcttgcagctgtgtaagacatgcttccatttgtaagttctcccaataaatcactattttcctataatctagatttgtctgcctcactctttgctttcttcactgttagcctttggaggatgctttgtatatacagccctttcatggaacacacattcacacagcaacaattagagctaaaaagttcagcaaggttgcaagattcaaaattaatatacaaataacaggccaggcacggtgactcatacctgtaatcccagcactttgggaggctgaagtgggcaggtcacctgaggtcaggagttcaaaaccagtctggccaacatggtgaaaccctgtctctacgaaaaacacaaaattagccaggcgtggtggtgggcacccgtaatcccagctactcgggaggctgaggcaggagaatcgcttgaacctgggaggcagaagtttcagtgagccgagattgcaccattgcactctagcctcggcaaaaagaatgaaactccatctcaaaaaaaaaagaaaatatatatatatatacacacacacacaaataacaaattatatttcaatacactgcaataaaaaaatctgaaaatgaaattaagaaataattccatttacaatagcatcaaatagaataaaatttattgataataaaatttactgaataaatttaatgaaataagtgcagactgaaaactacaaaacattgttgaaaaaaattaaaggagatctaaataagtagaaagacaactcgtgttcatggatcagaagacataatattgttaagatggaaatactcccaaactgatctacagattcaatgcaatccctatcaagatttcagattgtcattgaataaattacaagtttatcctaagattcatatagaaatacaagggacctataaaagccaaacaaccttaatggaaagaagaacgatactggaggattcatactttctggttttaaatcttactacaaagataaagtaatcaagatagagtggtactggcataaaggttgacatatagatcagtggaatagaattgaatcttgaaataaaccctcacatttatagttgatttatttatagcaatgtaattgaaaaataattgtcttttcaagaaatgagctggaataaatgggaatctacatgcaaaagaatgaaattggactcttacctaacaccatgtacaaaaaataactgaaaatagatcaaacacctaagtgtgagagctaaaagtataaaactcatggaagaaaatataaaaataaatctttatgaacttggattaggcaatgacttcttataaatgaaaccaaatgcacaaatgacaaaagaaaaaaatagataagctgcatttaatcaaaatgtaaaaccttcatgcttcagagaataccatcaaaaaagggaaaagagaacccacagcatggaagaaaaattttgcgaatcatatatctgataagggggttacatcaagaattcataaaaatgggcaaaggatccaaatagatatttctattaaaaaggtatacagatgaacaataagcacatgacaagctattcaacatcattagccaacaggaaaatatagagaaaagccacttcacccccacgatgatggctataatcaaaggcaaatagtaacaactgttggcatgtagagaattgaagccttcatacactgcagatgagaatgtaaaatggtagagcctggcaccactgaaaaacagcttaatggtttctctaactgttaaacatagagttatcatatgaccgaaacccagaaatgccactcctacatatatacccaagagaaatgaaacagtatatctacacacaaacttgcatatacatgttcatcagaattattcataacacccaaaaaagcagaaatgacccagatgttcaccaacatatgaacagagaatgaaatgcagtacacaacagtatacatcagaactgggcataagccggaatgaagtactgatgcatgctacacataggtgaaccttgaaaacattatgccaagtgaaaaacaagtcataaagaccacatattgtatggttcctttatatttaatgtccagaataagaaaatgtgtagagatagaaagtagggcttgaaagtagattaatagtttgatagattaatagtagattaatagttacctagtttcagggagatagaaaaaatgttttaaaattgattgtagtgatagttgcacaactctgtggaatattggaaacaatcgaaatgagtgaattgtataaaacatgacttatatctcgataatagatatctcaaaaaagatcattgatatcatttgtaattagggaaatgcaagttgaagcattatgagataatattacatacatattaaaaatggaaaacagaacacacacaaaaattatcaatacgaaatattggcaagggtgtggagcaactggaattcttatacattgttagtgggaatgcatgtgccatatgactcagtaaatccgcttctgggtgtctacaagagaaacaaatatttatttacagatagaaatctatactcattcctcagtctaaacgttgccagtccttctgtctctaaactttccctctattctcatctccttttcctaattcaacttttaacccccaaattctctttagttcatagtttagaagcccacttctcaaaattggaatgtttaatcctaaactaattcaatctgcatataagttcccataagacccagtaattacaaccatacacaattgccatttacttttatttagctcctcctaaatgctaggattcaaagaggtagagtatatttcttctgattgtgattgaatctctagcaccagcagtgcttctgttttatttttaaatttatttgaagaacatttgcccttttgcaagcataatgcaaactttaaacatcatattgctagctaagaaaaatttaaagcaacatagataattctcctttgacacaatgatctgactagaccaatagctggaataaaataatgagaggaagacattagagtgaaaaaagaggaggacaggaagagagatcatttgcagtacacagtcactaggctgattcaaagcaccaaagtgaaactctctaaggatgtttcacttttatattggaacgccatatataatttcataaaaatgtcaaagtgattttgaaaactcaaatctcttcaagttgcttatacttaagacaaagcgatcaacgcaattcagagtaaatttgactttgttttttagtgatgggagcatttcttaaaaagcatcaaatctaacatttctatcttgcagaaatcaccaagcctagttaattttctcatgaaagggactttctgggtatacacagctacagatttaactaggtctaacatacacatgaataatcctttgcaaggtcccccttcctctctcctgacccctaccctaacattgcttgcaagcagcagaggagataaggggaaacagctgatctcctctgtgtttctctaatccacttcaattcacctcctaattcaagataaatcactacaggaaagaaagctgggaggaacccacttccctaaatcaagttcccttcctgtattttactagatagttgcaatacctgattctcaccaaaataacgtcctctagatcttatagacatctttaacaaaaatccaccttgttgagccttgtcttttcaaaacttgaccctagagcagaaattgcaaaactagtgattcttggcattatgtattgtcataagtgatgggattgtgtttttgctttaattttgctttaaattgattcagctctctacatttcaaaacaaacaggcttttacattgaaatccatatttcttagttcttttgagaaatgtgaatgtctgtcaacactaggcctgcattcatgcacagcaataattgactggggacgagtagaggccaacccctttagactgagtgtatactcattatttcagcacagcctcatgctcctgagccctttctttcactcattacttcttggtaacctactgtaagcatttgaattttctgtctccaccttagggctgagagggggctgagtgatagggagtggcaactctaaatgcattttagattaggaagaatattcataacaaaatgcccttcgagtctatacttctattaggaactcaatagcctattgaggattaagtaaggaagctaactagtatacatagcactggttaaaagacaaaatggttccaatcaacttacaaatggactacttgtactttctcattagaagaagatgactgattttcttaggtcttgtgtcctgggctaatcgctaagcaatagctaagcagttacttaagagttagaaagaatgactgcatgcagattttacaggcagaagtgtgggcttcccagctctctgcttctctaattaaggaaggtggaataagaagaaatctaatcaactcagaatttttgcagcctgatgtactcaatagcaggtctcttgtccaaaagcgttcagaaaggtttctcctctcttcatttaaataattaaacatataaaacttgggctcactttctacttttaaatttattatgctacctttatccctttaatctctggcattgatagaactgagctgatatctacttttccatatattagctgtgtgatcttaagtgagttgcttaatttctctcagctagggtttccttatcagcaaaatggtaataatagtatttatctccatcattgtgagcattgatataatgaggtaatgagtgtaaagtattttgcatgattttggcacagattactaaatattttattttcctttattttcttcccttttcttttctttttattatttttaaagttattttcatcctataaaagccataaaataaccactcctgcagtatgtctggttaactagcctcttccattcaccatcaaattacctacatgtatgaaacaaataaaagaactctcccctttggtttttagaactttcaatgccaggaatggagaaaattattttaatctcacatcttccatttatagataatgaaactgaattccaaaatttagtgatttgttaaaagcacttcagcatgggagtagaactcattcattttaaaacacaaaagacaaaaatggaatgaggctttaaccagcagggttcagtatatataagccctaaagagcacgtcgtagggactcattatgcttgtgtttaattgagtggaatagtgaattgattaaaaagaacagatcatccccaaagtgcatgatcaggctgatgattaaaacaaagtttggtttcaagactgggattattcttcagctagttgtcagttagcatgtttgcttgttacctcttgaccaaataccatgttggaggtcaatctggggaagttttcaagttcagagaagtttcacccaccaattaattgtatatcaaaactttgggccgggcatggtggctcacgcctgtaatctcagcactttgggaagttgaggcaggcagatcacctgaagtcaggagtttgagaccagcctggccaacatagtgaaacctcatctctactaaaaatacaaaaattagccatgcgtggtggcaggcacctgtaatcccagctacttgggagactgaggcaggagaatctcttgaatccaggaggcagaggttgccgtgagcctagatcacgtcactgcactccagcctgggtgacagagggtgagacttgtctcaaacaaacaaacaaacaaacgacaacaaaagaactttgggtacataattttagcagagaattttgcacatgacaacttttgacctgttaatgttgctgaaaaacaattctatctgaaattgaaagttggatacaagggtccaacaacatatacatttgaaaattaccttatgaagtgaaattttcaaaaggaaaatgtcaccgcttgtcagagctatctgaagattcaggtgatctcttttcaggcaagatttttgaaaaaaacatttagagaagaaagggaagacaaatgtttcctgaacgatgatgtccacactgtgtggcatttggtactttaatgtgttcgtattcattggatcctacttgcttcaggttgcagtggaacacttcttttacaaggcagatataagagatatcaagtgtttttcctaagaacacctagccaggattcaaacccaagtctgtctccatatttcatactttactcaataaatcacgttgttgtccacatttcaagattttctatggggttaatagatgttcgtttattcaataattcattcaacatttattgaacactgcacttactaaatgtcagactaagaaacaaaaacaaaggttctagacagtatgtccagggtccagcacagtatatggtcacaataggctttaaagacatatgtattaaattaatgaataaagacacttctgctctcaacttgctcattatctacctagaactgcactgtctgatatctggccaccagccatgtggctattgagcacttaaaatgtggccagggtagattaagatgggcttcaaatataaaatacatcccaaattttaagtcttagcataaaaagaaatataaaatatctcattaatggcttttatattgattatattgaaattatagtgtttggggtatattgaattaaatgaaacatattaaaaccagtttacctgtttagttttttactctttttagtgtggatcctagaaaatttaaaactatacatgtaatttctttcaattcctattggccagccttaacctagtgctgttaagtcctggggcacttgcttttctgtttcaagttcattattaaaactagttctattctctctcttttatgtatgataataagttaggtttaaatgcagtttattttaaatgcaatctatgtttgtgagattagaatcaattgttaaaggttagaaatttttgtattcagatgcaaaatagtccacacgcaggctctactgaaatatgacttccctttagtccctttcctggtgagaagctaccacagttctccagatatgttactgccagctatacaagaggaagtctaacccgtgcagcctgataatcaaatatttaaggctgttcaactgcctctatcccatctcatgctcctgccaacttacctatctagatttcctttctacagtattcctggaacacaggaatgagcactgtacctttattcatgctgttatctctacttggagttttttgtttgtttgtttgtttttcaattccaatgcctgcctagttttcaaggttcagcttattgtttacttcttgccaaattcccaaactactataatcccatataattttctcttttctccgaattctaagacactaacattccatttgaaaatatctatacttgattgtgggaaggctcttacttttctataaatgaatcattacccttttcttatattccaaagaccgtaagtagaaaatttataaagaaatcactacaacatggaaaggaactcaccgtgcatttggttaggcttttaaaggtcatgttcagccacatctttttaacagtaaaaggactaagatgctgagcagtttataaccaagggagtgggcagtcacaccggtgtgctctgttctacataagtaaagcattcccgcctatagcatcccttccctaccaaaacaggagagctgccaagatgctcacttagaacagttgttggtttgtgtacaagtgttaagtatgggtttgttctttttcttttatatttttttgagggaaagaagaaggaagaatggaaggggactggaaaagctgtatttatttataatcaaacatatccttatttgataacagatgaccaattaaagcaatgtgtgaaacttgaacagcattctgtcaaaaagcaaagaaattagcagagctcatagcaatcagcacttcttgcaaactgcaagagtcccctctaaagccttctgtcttggcactggggctttgctaaatagggctcaccattttgcgagtgggaacaatcagctttgtaggtggtagggaagtattataattaaatgtccacccactttttcctttctgatgaaaggctcccatgaaacttactaaaataaggtacataaagatagatgaatttttgatgagtaagtcaaagcaccgacaaacctggctttccacatagagaaaattctttaatttatagaaaaatttcggcctagatcattaatactgtcatatttaataactaatacgataaaatccatagggtaactggagatttcactgttttcgttggtagtgattgtagtgctcagcatgaattgacttgcagaaaacaaatataattcaaaaaaagagtgaaatttttcaaaattgattttagagaaatattaagtgatagccatttaatcataatagcctttttaataataaataatgcatttattgaatgtaatggcattcttccgaataatagttatagtaccactttaaggttagaaactatatctctgatatagcaaagggcttgaaagatgttattgaattgtcagaaactttttatgagggagctctggaacagagtctatagagtctgcttttgataattaatggtaatggcatttactaaaatcactgtgaataattaattttaagtacttatatgcagtagagtagggagcttctctgctttataactgagctcagacatatatttcaagtccagttactagcattcacaaagtcaatattttagaaagaaaaagaaattaaaattaattggtactatgaatgttttccttcattcaatgtggatttattgggcatgagctgtatagactttgctatcagaggagcctcaaagcaataatcctctctagaactaatgaatatttttatttttaagctaaatttcatatttttatcttcctgttcaatagattttattggcagaagccagtagagataacggtgccctaaatcaccaacaaggtgagatcaaagtactggggaggatatgaacacatttgtcattaattgaacacatttgtcattcattgctaatcactatgtgaagatgacttttaaaatactcctgacgacttcttatccttccccactgtggttctgtggatccaagaacacagagtaactggatgctcaaagtaggaaaagtttgcataataggtactcagctcagcataactaagataaaattagccacaaagatctagattctccagttactggcactatccagggttttataaccatcattacccatgatcattttatagtaaactacaataatagatgtggtgacacatctgaggtctcctcctgtattattagtatagcgggacacctcagatgtgtcaccaccaaggaacaggcatgttcagaccaaattcttcggccactgtcctcctcattcccgtttgtttttttgaattccccagaacttcttgtttttcaaattattacccacatacttttttaatatttcattttctgctttgtgtttagtcctactttttactatctttttgtaaaagttacacgttaaccattatttaaagagttcctttaacagtgtggaggttttcttcaaagacttgatagaaatctttaaatatgggcttttttctcatttaagtcttacttcaacatgttcactgattttagatttctctgacaaacatggttgaggtatcaaaacaaagacatgttgataatagctttttctcaaagtcatttagaatgtaagactttctgccgtgctatgtcaaattgcccaacttgggaataagatgagtgtatgtgcatgtctgtggggtggggtggtagggagcaaggaagtaggggattggtaaatagtctatacaaggagaactcatattgtcctctaaaactgatatatttaggctctcctattttccacgagtctatcatagacacttgtgtctcaatgtttgtagtaaattactgatgattttctctgttgctttggttaggaagatcctttcaaaaacagatttttctgggagataaatgcagtactttttcttcttcatgagataaacacacacacacacacacacacacacacacacacagagagagagagggagagagagagaaagagagaaagagagagagagaaacaacctagtgtgcaagcagtatgcctaaaaatcatttttattttctcctgttataggaatctataagtctgtaagtctctcagttgaaaaaaaaattgttacatcatagaatttaagaaacttggaatgaccttagatattatcctgtctaactttcactttatagataaagcaaatgaaaccctgagaagagtagtgaccacaaatactttgctattccttctattgagaaatgtagtctcactgctcccttttcctgtgtctgggcagtctctgtaattggtttgaccaatagaatacaaatgacaactgcagcttcctaattcttgcttgcatttgggacttctcatctcagaacccaaccaccatgctgtgaaaagctgaagctacatgaagaagccatgtattgatgcaccagtcgacaaccacagctaagcccccaactgacagttaacgcacttccagtcatgtgaatatgccatttagcatgtccggactaggccaacctttggcaggctccattccctgccagtatgtgacagcaatcacacgagaaaccttaagcaaaaattgcccagctcttcccagtcaacccatagattagtgagagataacaaatagttgctttaaatttcaggatggtttgttatatactaaaagctcatcagaaatgaaagtgacttagaccaaaacttctaagcattaccagagtgaaaaccagaactcaaatatcaccccaaacctcgtataatctcattataatgtgttaaggaaacatgtcgagttaaatgagatccagtttcagtctcccaatagttcataattccaaaagattttattctttcaaaattcacatggaatgcagaatttccaaaattcttgaactttaaaacaaattcttagagctgtgtctacataacagtaaaccatcatttggtataaggtagcattcccaagtgttcctcgaaggtagtgtcttagtaatgtgccatgaaagaaagagagataagctgatttaatttgtttaaactaaattaaagaggtctctttgcttcaggatttttcaagaatgtaaattttccaagaggagctatagatagtacttattttctgagaattgttcgaccaaggcacccttcttcatcaaaaaactaaactgagaaataggaagaggaattcaattttgtcagcataaaccaagttttgctttcagaggatttcataaaaagaagttgttttcataatttggtgtgtcttcagcttagagaacacatttttagataacacttttatgactgtcagggactgtgcttagttatgtcttttacaacctgttcccatttcttcccgccttacttttaacattctttggtgtctacagttaataaatctttctggaatgtgtagacgaaggaataaataaaagcagataaataataaataattcaattaattaaaaattatcctgaaatgtttcattaacaatgtcaatgactatgaagaggcccaaaggtttttgagtcaacctctcatttagtttaataacctggaaattagctccaactctaattagcttggtttgggttttatatctttatttacatctaaggccaattgaaattgtaacacttgccatatctaacagagttcttgggaaattcaaagaagatttcaaagttggaggtggaacggctttgggctacaaaaattgtagcaatcatgtattcatccactcctttcatcttctagttctggagattgagatccagaaagagagtttatagcgcaaatgctagctgcattggaaacctcctccccgtggatccacgttaaagatgttaggaaagttctctttttcagtagatgttatattgaatggtgtgattctaattcacgtgctgattattagacagactatttacaagcatttgggccgtaaaaacatatttgaccacagaattcatgactggtataggaaggtgtggcagtcaaaacatttaataacccatatggcatggccactgacaaccagagtagacaccagccatgaacaactggtgcagccatgctgatgagtatgagccatactgaatatcatctgagatctatggatctagtagataacatttcccacttcttgccactggtttgtggccttgtgaatactttcatcttatttgtattagacattcctccattcaggctgtctcttaaatatacttgtgttattgacatccataatacagtaagttctattatctctctcctgggaagctatcagcacttcacagctccttcagcaatatgctatcctgttccaaaaatcatggtgcattcccatgtctctagtttccaagcagagggaataatagttttatggtcttcttttgcccctgtggggacatgagccagttcactacccctacttacttattcctggatatctctaccctgtatattcctatattcttgttctgtagtcatgctacatagttaaatatgacttgaaaggctgacagagtaatgcagctacaaaaagatggcagagaaataataaaataatatgtgatagagtatttgatacttttaagtcagaatgggaagaaaatatttgtaaggataaatcaaagtattctgcatttagccagttcctttgtgaagctctaataaaatatgtgtttaaaaaataagacaagccaatgtggagtgatctatacaatcggacatatacaccttcatattactttggccagactctgctgtatttgtaacacggtgtcaaaagtttttatttaggtacaattcaaccataaatggagaatgggagcctcattctcctggactttagtgagttacagttctagcatgcttacctctacaagcctgctggtgtgttcatgaaatatcgcagcatattcttttatttccttttcccggccattcttagcagcttcaatgagaaccaaaagagggactgtcgtatccaggaaagagtctgacacatgatctataatagccttgcggagctgagaagaaatgaaaaattcaggttttttttttccaggaaatagttcactgtgtttccttttcttacaatctcagtagttacacaactcatttttcatttttgcacaattcctaaaatcacaatacttaaagatatacaagaatgtcccttaagaaactaaaaaacaaaatatccaggcaaaaagaaaaaatcatctagcaatatttcctttcctctcaaaagtaatttttcttaagttgtatttaacctggaagtcagattaaaaatggtaatactttcttttttgctcaaagaaattgtgttattagaatatttatgagtgtgtacacataatattgtacatcttgtatttttataattacaaattatagaatgttttctaccttgttggaggaactgatgataaattttgattagctaaattgtagacttcatagtaattaagccaagttagatcaccgattatgccagttgataacagattaatagagcaagaagaataataaatgagtttgatgtccaattttccccatttgcattcattgttcttgccctcacactttaaattattaaacaactataacattctgctacaattagttcttttcaattagattacatgtaagcttattaatgacaattaggcaattactctagtcagcagatattttctgagatttaaaactgcactgaaaaattaattcattgtgtttatataatatcgagtctttaaagatcataatatcgggccaggcacagtggctcatgcctgtaatcccagcactttgggaggccaaggcaggcgaatcacgaggtcaggagttcgagaacagcctggccaacatggtaaaaccccgtctctactaaaaataaaaaaattagttgggcatagtggcaggcacctgtactcccagctacttgggtggctgaggcaggaaaatcacttgaacccaggaggaggaggttgcagtgagctgagatcgcaccactgcattctagcccaggcaacagagtgagactccatccactccccccgacaaaaaaaaaaaaatcataatatcctgaaatgtttcattaacaatgtcaatgactataaatgggcccaaaggtttttgagtcaagaccttcatatagttcaataacctctgtacaataaaacagataaatagctgtcagacagaaaaatgtaatttttctgtcaaagttacattttagagtatttttttaaaagaatagacacttagtttagttttagattacttgggaatgaatagtaatacattttgggagagctgaatgatagagctaaatagaaagtactgtcttctataatgatcatagaataataaatccataataattacaggtttctggaagaaaaatatctctgcccaaaatagtgagcttgctcagaagcattgtgaaattttctgactatcaacaatttaagaaaggcttcaggaagatccccaaggaaggattctgcttagtatgcagaaaggcaaattactagtggcaactaatatttactgagcacttattaggacaaagtatagagtgccaaggggttacaaggcaaaggggagaccttaactgaatgaataatgtgtttgctgtctataggaagtacaccagggaagtcaggcgtaaggtcacgaatttatttgagctgggaactacaggttgtgtaagtttcagatactgaagagaaaagtagagattccttctaatttctcagagtgggggcattttttaatgattatcctcccctttattcttttcttctttcattcataattaggacatgtagattattcttttcttctttcattctaattgagacatgtagaaggaaagctcagatgaaatctacactagagatatgccatgaagggccagcatatgggaactaactcaagcggagagtgtggatgagaccatatagagtgaggagacccacagaggacctcttaggaaacactatcatttacaggagtcatgattaaagagtagggcctaaaaagagactgagataatagccaagaaacaaagagacaaattacccacaactaaaagacaaactttcaaatatatctctgtgttaatgctcttcaaatgtagttatcctaccaaacataactataatattcccatcatggacttgttaaatcttctctgctgtgtaaatgatttcattcaattcagtaaatatttctggaaaccatttcctcacctttctaccaagagaaaggtattgaaggaaatgttaagatggaaattcatgatcccttataatctagtagaagagtgaatattacaataatacattaaacattacaataaagaaaaacttagagactgacagcaaaaaaaaaaattagagtcaaattttaaagataaattaaattaaaaaaaaggaatgagacttgtcccttgggcttgaatactaagaggttattgataaacttggtaagagcagtttcagtggaaaagtgggctgaagagtcctattgctatggtttgaagagtgaatgagagataaggcagtaaagacagtgagtataaacttctgtttttaataatttgattgtgacatgaagaagcaagacttggtatttactactctgagatatatgtttaaagagtgactgtttttcatataaagacttcactataatttcccatctgcaactatagccaaaaagtcttattactcccctttgctttgctggaaatacatattgatttattgccaaagcaagaataacaggtgaaaaagaactattgtctcacattgtgccaacttttgtcatcttttcgtcccatgacagaaggaaatgcccagaaatcagtgacttgagctggatgtgaatgaaacctttaggagctagcacatggtcagaggcagggatgtatctctcccactgaaatcatcttaacccatgcaaaaaacaaagtgtaactaattcaaccaacccacaatattctcaccagtctaaccattctccctgtctaacttgctggttcctgatcctttaccttcactattatgaactacattatagacttttggtgccttatatctcatcctctggatctatctctgatttcagcttttgctggggggaacagttccatgtcctctgaagacattccatgcttcttgtgtgccttccttgtgtctctttgttattctatctcagggcctgttccaagtctctgtgaaattctcaacccagcataaacactgcctggaagttcttcagcgtccacaccactgggggaaaccctcaacctatgcggatagaaactactgcataaaattcctaccctccatccattagtcagacaattctgggaaacattctgttattctcagagatcctcaagctctcattgcctacagcagcaatctcaatagcatatcatttcctctttccctgcctcgcttttcatgttctataacacttgcttccaggaatcacctcctaaataaatgacctgcactaaggtcctagttttagtcactgctttcaggaaaacccatctaaacaggtacctttgtctggtattaatgttgtttgatcatgcaccaagtaagagactccaatgtcttatgtaaactactcattgctaattatactctactaccttggctctgtacatcactgggttttgttctgccatgccctgaattatactcactgtaaaagaggaattattatgagacaggactagaaatgtaggtagggacaagatgtgaaaggactagaatgttatgctaagcaattttcattatatgttctgacatattcatatggaattgttttcattaaattgtatagtcatatatacctacatataacagcaaagtagcctctatcttatttatttccgcattattttcctgcccagtggcacaatgcattcctttcagttgggtgatatacaaaaagtttaaagaagaatgcaatatgccaatatagaaatggaagccaaagcactaaaatctgaagttagtgggaggccaataggaattacagatacatactttcaataaatacctgtttgtggccaggcatgaaagatgttagaacaaaaccaaactgaggtgcttttcatcttttctcactacagtttaataaaaggctttgagacatcaatttttctatttcctactgatgtaagtggtttgggatctcaaaataatatatatcactacaattgaagcccaaagtgaaagccctatgtgaaaagtctaaaaaagccccaccattcccaccaaataaaggaacagaaagaatgaaattgtgatgggaaggggaatggaaaggggagaaagtgtttcagaaaggaatcatcttcagggaaacagaaaaatacatttagactaaaatattttatgttaaaatattgtattaaattttaataaattaacagtatttaaattttaataaatattttaaattaaaagccattttaatttaaatcaaatagcaaaatgtgatttttaaagcttggaattaaatgtactaataattatttcactgtgtatgtactatgtaagtttagtgaaacttgtctcttgtggatacataatgttatttgatgatgaggatgatgaccaggaggtataaaagcctacatatttttttctgagtggtgaactggtactatgcaacatggaagagagatggacctaacaattcagaaactcagcaactaaagaattaatcaagtttttgttttgtctgtttttaccaaaatcccatttgacatacttcatctttactttgatatttatgaaataaaagacatttttcttaatatacacaaatacaaattttagcctgcctttagtgaaatcaaatatattttagtatgtatagtaaaatagaaataagatatatttgttgcttaaatttttttataaagtaaagaatgtttaaaaagtcttcctccttttactgagagagttgcaataggtatacagttttcaaatgaatgatggaaaaagaggctaaagaaagaagaaaatttaactttaaaaaggcatttaaaacaaataataaagaaaataatacatgatggtaaaatcagtgtattaggcactgggaggttctgaaagtgaataggccataatccctagcccctggtgtggtgattacacatatgggctggggttggatggacctgggctagaactgtgtctctatcacgtagctgggtgatgtttgctatgttaactcattttgggggacaaagataacaataccatggcattatttattgttttaggaataaaaattaataatgtaatgaatatgcttggtagagagctttgcaaagcatttagtaaatgagagatgttgtcatagctatcattataaggacttaaaatgcagtgggaagaaaactcattacaaaagaaaaaaatagaagaatataatcattgctgtaatatgcacatgctgtaagtgttccaggaagaaaaaggtccattccagctggtgaaaacagcaaaggtttcatggaagcaatagcatttacactactctggaatttagttgcttatgagttggggttgtgtgtaaggagagtgagtggggaaggcatcaagctgtacaagtcatatgtacaaagatgcaagtgtatttgagcgggaggtgatgcaaattctggtaaataacaagtagattctttcatcagaaaacaggttaatgtgggccaggcctggtggctcacacctgtaatcccagcactttgggaggccgaggtgggcagatcacaaggtcaggagttcgagaccagcctggccaacatggtgaaaccctgtctctactaaaaatacaaaaaagtagcagggtgtggtggcatgcatctgtaatcccagctacttaggaggctgaggcaggagaattgcctgaacctgggaggcggaggttgcaacgagccgagatcacaccactgcactccagcctgggcggtacagtgagactctgtctcaaacaaaaaaaaaaaaaagagagagagagaaaagaaaacaggttaatgtgttggtgtgatgaggaggacacaacactgcgaaggagagctgaaggaaaaggaacattaagaataatggggattaagtcagggccaaatcacagagaacctagaacaccatgccaagaacatttgtctttgttctctagtaaaacaggcaagaaagtcacagaggaagaagattgaaacaaataaatactctcgcctcctagaacattccatcttgatgtcctcaaatctataatttgcttctccttagatatttctaagcaatctctgtcattcctcttggaagaaatccaatcaccctctgaactgaagctgaaatgtttctgcattactgatagaaaggccatggttaagaaaggggataaggatgaatgggcaggaagatgggctctgcttattttttactaaaaaaagttttaaaagataaaaccagttctaaagcaaacgatgaacattaaatactccaaagaaaaacattttaagggcagtgctttctctttcctgtgagaagaactatatgtgagatgcttacaacaactgttggataaacttcttaagaacaagaagtagagataacttatattgctgttttaattaactgtgacttctaccaaaaatgtaaacatcaggatgaaaaataaagtactagggggagggtaagtgaggataatgagaaagaatcatagcaactaacttcatcaaaacggaagatcatggaggtgttcaaagacagcttctaacaattccatccattcctgtacacacataccacttctcctacaacagacagaacttctgcctactcctattgaactgggacagggtttttgactgttttttacttacagattatagaggaaatagcattctctgactttggagctaaggcactaagaatgcttgtcagcttccgtctcccttttcttggcaacttgaaacagcatgaaagagatctaggctaccctgctagagattgaagccacatggagaggccctaaaacattaggcaccgtatcgagagagggaacaggaagaagcactgaggttccaaacatcaagtcccaaatctagccacagatgccatttgactgccactatgtggaaaaccacaagtgaaaacggtacagaaaatggccccgctgacgcccagccaacccaagacatcgtgagatgcaaatatcgttgctactgtttgtggtggtttgttaaacactgatagaaaattgaaacaatggagatgttaacctgtgaaaccatacagaatgttaataccttcagagcacagcagttttctacaagatgggagtatcttcttactatgaagaatagtattagtaatccccaatgctatttctatatctcactgatggtagtgaggtggaaatacaagtaggattgcaatataaaatacaagatgctcggttacatttgaatttcagatgaacaactttttaaatataagtatgtaccatacaatatttgggacataattatactaaaccatgtttgttgttaatctgaaattcaaatttaactgggtgccttgtgcttttatttgctaaatctggtaattccacacacaagtaattgcattttcttgactttatttagaaaaataataattctaaaacctttagaagtataaatgtagattagctctttatgcataatgttgttgaaggcaatatagagggaaaagacacgaacgagagacacaatcattgagagctcatagagacaacttttctgagtcctaggtgaagcagatggggtagaaatcctgaagacgatggagaatagggatcattccacgaaaggggaggatcgctctgaggatataaatttctgagtcctggtacaggttctgactcggtgccccatcctcttaggcaggtcacctcaccacactgacctgctttctcatttgcatcgtaagacaggttgtgctaagttccttctgactcttacattccatgattacaagtgtaaatggtagaaacagaattcacattaagggcataaagttgagaaactgagattttcacagacttcaacattatgtttttatgcagctattattaactggctggagatctctattccatttccaaatctacgtccaaattaaaagattgcttagccattttactaaatcttgccattaaactacgataatacattgcattaaaagttcatagttgaaaagctttttctcccttttgatgagttaatgatgaccaagtgaaagttctgcatgagaaagaactctggttattgaacagaggaaaggaatgaagagcaaatgtctttgaaaatagctaagtcttcctatttctggaaaaatgtttaacttgtggcatcatactagacttataaattgtttaatgaaattctttctaatcccatgttcctgatgacttaaggttaaaaagaaggcttaacttttacaaaaactaatttttgaagtatcatgaaaaaaaatggaaggaggaatgggtagggtctctgaattacttactagttaatcatttggatttaagcatttggatgatgaactctgatgtaatacaatcaattgatcaacattccctaaaaacttgctatgggtcaggcacttacatgcattttattgattcctcacagccctattgcatattattaatttcattgtataggttcaaagcagctcagagagctgaaatatgtgccgaagatctcacaactgatgagaacagaaccagaatttgaatgtaattctgtctgataaggcacacattctttctctgctttgtatttgccacaaaaaacatttgaggtatgaatatataaatgtggaaagtatatatttactctttttttcctgttctaaattaatttgaaaggaacaaaacaagaaacaaatatgcctgcaatgaataacagtttcatttagcccctatgtttctgactccatatctctctcttccctcacctgtctgcgaaggtctcttgtcttcttacacatgttgtctaaagcaatattcagggtattactcctttctttttttccagcctgcaaagaagaaaaaacgacataagcaatggtatcaattaatctttatcacttagcaatttgctttctaaatttcctgaaaataacagcttgaaattcaagaataggtttcaaaactgctatattatatatgattcatgagcatttcacttaagactaagtagaatggtgattaaagctcacattattttcatctttatgcttctgtaatatttccgatacggagttaggttgtattcagtgtgacaataggcagagcattatcttcatgaaactctgatcttcatttttaacaagtcaaatcttaaatcactaagcaggcaattagcttaaaagcattagatgcccaatttgtcaacttctgtgggagtttctaaagtcatttccatggtgtattgtgtaagttatgcagagccatattggaattttgctaaacactaaataaagtatgcagtgcaaattcatacaatttgcaaaagttgaccacaattttagctgacaatattccaagaacaaattgttttaagtaagaactggacgctgtttttggctctttaagataatttgtgcaacacctttttattctttgagcagaacagctctctgttatatccttaacctaaatctttaggctattaagcacatagagagtcaccttggttggtattttctacatattatttttgtgcaagacaactggattaaatctaatcatactttttgcagtgatatctcacataaaagagattggaaaaatcattatgtgattcacctctaggaaaattgctgctgtttaaattaataaactgaaaagggatcttgagagaagaccttgaaaatcaggaaggcaagtttaagcagctgataactgaagggggttacagcacgaactcaatgaaaaaggacactgaggccaagtataaaccacgaggaagcatgtctgacactttccccaatgactaaactcatgcataaacccataccctgcagtggactccctaacaagaaatttaaaaactctctatactctgtcctaacctacttttttactcttatgtactgctatatactctcctttacagtagcaatattcctataattttctgtctcttctccccagttcttacatgtaatgtacctttgatttcagagatcatcttctaaaacacctactgaagtcctatctactcctcactggtttctacagggagttcttccaacaaccctgctcaaaagtaaagtctcacttttcctttttccaacagcattttgagtgtttttcaatataatcattttatttatgtgcatcccccttatgatactgttagaatcctgatattggcaaatatatctcaattttttttctattcctgatagtaacttacataggacttatcaaatagagttgactagactataaatgagcaatttaattcaaaacacaacatagtttgattagaggcctactgttttccaggaaggtgtcattctagagactctggaggagattttagcatttagctctcaaggcacagctaaagttctctatgagctgaggttgctggtatctacctcaaactcaggtcaacctatattttcccaacagcagtgttactgatatttaaagtgtgaaaaatggccatcattggagatcattcgatacactgcaagatatctggcattcgtggacccaggtctgctaaattcaataccaaatctggcgcactgtgacagccaaaaattggcaccacatatgttcagctgcctcctataggaagacacagtagaaggccagtaagtctttaccatgttttagtttcttataaagagattgtggaatgtgtacaccatggaaactgtgtctagggaagagagaagtaagaaaagggaaataggagagatttggttaggttatttctatgagcactaataacattctggatatcagagcaatggcagcaattacacagatgaaagttgtggctaccttcacagctcctactcagcattctctatgctagcagtggggaattatgaagagctaactcatgactatacaggacaatggcataaacagatacacaatgagctctcagacagtttataattttacctaaagaacccagcccttattctctagcttcatgcagtgtttgctcttggttgtatcgctttccacttcatgaaagcagagataataaaaaagaggcagaagtgggacagacaaagagacctcctacacacacacacacacacacacacacacacacacatgcacacacacacacacacacacagtatcaggaataatatgggagactcctgttgtgttggctgtaaaaacccgctagcttctgtggtgtgattcatcagaacaactaaaaaatgtcagctttctcagagctagcagcagaagcataccaaactttaaataaaggatgacaggaggtgacagcacaaagagattcaataggaactataaaaattattccctaatttctacccagagcttaaccctagtttaaaatgtttcactgggtcaaagacatttcattgtctaggcaataataaacagtccctatcatgacaggaagtttaaaggtctcccttcttgcttttttctcccttgatcccctatccccaaccacaatcacctttctactttttcacctccggctttttattggatccttgctctatttatctagatttatttggcttcagtcaagccattttatgcctctttattccttttgcatagcataaaaataaataaggcaaggagaaatagccccgtcctgcttaaaggccctcattccttcttttttcaaagccttaacaaatcatcaatgagctcggactaaaggtgaattctgtgttctgagacaagagatggaaatggcaggatattaaaacacaactgcagataacagtcagaacctgcctatatcccgagtgctcagaaaagagactgctccttaaagaaatccttgacagaagccattattaagtcagcaaatccctgctaatggaaaagggaccacttacagtggagtgtcaggcagatagacactcacatggcacaggtcagcactgtatagggaaagcagtcacattcttcatctgtaaacaaactgccaagaaagactttattaaaaaaaaaaattctgggccgagtgcggtggctcagcctgtaatcccagcattttgtgaggccaaggcaggtggatcacctgaggtcaggagttcaagaccagcctggccaacatggtgaaacaccatctttactaaacatacaagaattagctgggcatggtggcgcatatctgtaatcccaactacttgcgaggctaaggcaggagaattgcttgaacccaggaggcggaagttgcagtgagccgagatcgcgccactgcactccagcctggcaacagagcaagactccatatcaaaaaacatttaaataaaaataaataaaataaaatagtaaataagaaatagacaaccaaaaaatcccaaccctcaaagtgcttactccctagtggagaaacataaggtctaattatgtccctcctttgctctaaaacccttcactgtatccctactgatgaaattaagaacaaagtcttgatcattgtgttcaaagcctcatataatctacttctgtatttactaaaccactaataagacaccttaatgggtcttttctattctctgcaatatgattacaactcaagaactctgctagtataaatacctctcttttcatttcttgtctcttacttttcttgttatggactccttccttccttccttctttcttttctttcttttctttctctttctttctttccaaatgttttgttctgttgcccaggctagagtgcagtagtgccatctcggctcactgcaacctatgcctcctgggttcaagtgattctcctgccttagcctcctgagtagctgggattacaggtgcctaccaccatgcctggcttatttttttttttgtacttttagtagaggtgggttttcaccatgtcagccaggctggtcttgaactcctgacctcaggtgatcctcctgccttggcctcccagtgctgggattacaggcataagccactgcacctggcctggttatggacctctttcaaggtataactcagttactaaattttacatagagcctttgttgatcttctcatttgcaattaattactctcttccatgatactttcttatagttcttatacttcttttataacacttggtttaataaataggtcaacatagtcaacaaatctttatcatctactatatgcgggacaccatgctaagaactagtcgctgcctttcaggtgcacaaatctagtgatagacataaacacagtagtttatagaggtacctaggataacacatggattgatgagagcagcactctcaataatgatgaaggaagcattcttgagtaggtaacaattgagtattacaggatatataaaagtcagccaggtgaagagaagagaaaaagcttatcagggacaggtatagcctgagcaaaggtaaaggtccttaaagattatttggttattagtaaaagtgttaggagaggcctgatcctggaggtctttgctatgccaagaaatgagcttaaccctatagacaactgggagtcatagaagttaagaaaatgaatgatacaatcagtccattatatcaaaccggctgtggagtctgcacaatggatttgaggagatgacaagcagaaatagaagcattaaatggtcacagtaatagtccacagagagatgaacagtgttgaaactaatgcaatggcagtcaggataaagaaaaaccacagacttaaggactctataatagagtaacctgggtaggaggatgactggcagatgctggcaggtgaaggaaagagaacaatctaggctgatgtcctggtttccagcagtgacagctggctagatgatggagttgtgaactgaaattgtcatttcaaggagaaagccaggtcaacacaaggatgatgatttcagcctgggaactgctgaagggctcataaagagctcatttcattagtatttgtcctatgcttaattacttacctgaatgtgtctttctcactagatggtatgatccttgaaatataaaaatatcttacatatattttgtccctcaaaggatctagcacagtgctttgcacatagtaggggctcaacagttatttgttaaataaatagagaaatagaagactggataaggttttggcagatcccattacgtttctgggccttaatttccaaacccataaaatgaatatttgtcctaaattgtttctatattcctttctaactttaaaattctatgaaagggccatgttctctaaaaggaagaattgtagaataatatgttacttttattgcacaatttcttgcataaacagccattgaaaatatgtcaaaacatgtgtgtgtaatacgaagctgaaaataaaaggagacgtttgaaataggaaggccatgatgctcaccctataaattatgaagcctcaaacactaagagatgaggtttaaagcaaataaaaatttatctaattcatagtcaaatgaaaatcagtgcagaggagccctgtgtggaattcaaacagcaggaaaatgttttttgttgttgtttttgttgttgttattgttatgttttatttttgttttgtaagtgtgtgccattttattcaaccttttaaaatgatgcattttccttttaatggtaaaagatgaaatatgatacccttaaacttagttcttctctaaagaaattgcttgaaaaatagtttatgcttagcacatagcacaggcacagattctagtctacatttttcaggcatgaaagacacacaaacagacaagtataagaaagaaaaatgaaatctctccttctagaataccactgtactgaatggcgtatcaggaagacacctgatggggcatgctaaatgatctgtcagaaataaggtctataatgtgaaaatacaactaaaacaagccaaaaattaactctgagttttgaaatgaggtttttaaaaattaaccatataagaatagaatgatttagctaacagaggaagtaggatgaagactacaaatgtcttgaacttttgtattgtttgggaaagtaagatgccatccccatgtagatgcctgctggggtatgtctggaagtcagtgagagggaaacaacattgtgtcaaatgtctaccacatataataagtactttacacgtactgtctcaactgctgttcacaataactctacacacatttgtatgtgaagacactgaggttcagtaaatttaaatgtcctgcctctggaggacacacagtaaattgtgtgtcaggtagaactgtgtcccatctcagacttaagccaccataccatgacaacttgaagccactgtaacttaaactcaatatatctgttatgtaagctttataaaagtatttataaaatataatgagcagaatataagtttgtggagccagttgaaattgtattctaatcagctccatcacctgacagctttatgtctttgaacaagtgacttaatcctcaaagtcttagtttctttgcccataaagtggagataatataaaatctatattacaaagttgttataaggaataaaaggataaagggtatacaaagctggcaaataggaagggttcaagaaatgttagcagttattattagacatatcattggtgttaccaatgtcacacttgggtttcttgaactaaaccaactggctgatttccctgtgctttttcaaacaccagccttgtcctggaatgcccccatctcttcttgttcaacaggaaaattcttaattcataatctgagactcagctcaattgtctcattctctgtatcaccttttctgaccctcctcaattttgctataaaaatttaaagttacaaatcatctcatttgttctttcattaatctcttcatatatttccactatatctgtgagacttttgttatcttttatttatactctgcctcatcttctacactgacacttcttaaatctgtcatttgtatctactataacacctgaaactcaattaatggatgtgggtaaaatgaataaatgaagaattgttaaccatacttctaataagtaatattcaagctatattattaatacattgagtgtttgtatttttaacaaaaataatatctatcctattagttattaaatattttattaaatcagtgtttttattcaaagactgctgttattattacctataagtagtacaatataaacttggtatgaggataaaaatctaacctgtgaatcagaaaatggggtttctaaaataagctctctggttgaccttaactaggatgaatcacctctcttgtcctgtctcaaatgtccttagcatgcataaaaggaggccattacactaaatgatctttagggttcctctgaactctaacagtgtgtggcattagagttctctgttggtatctagtctagtaaataactaattaagtactgagaacactacactccagcttgttgcctgtgttctcagaccagagatactcacgccagaatacagaattttaaccgatattcaccaaacatgaaataaacattcatgggtttgcactacaaaaagaaaatcaaatcatttttctgaagatgttactcacaggtatcaatataaactatgactttgtcttttaaaggtgtttccatgaagagtcaatcatatatctgaaatatagatatctaggccaaagttcataaatccttcaatatcaattaatgattaaattgcacattatgtctttactgatattttaattccaaaacttttttactgagtcaccatcagaggatctggagtaagatctgactcattctagaaatccttttggttttgtgatgcctgacccagcagccagctttagaaaagtgcctacccctgaagaaagcagctgtgatgctaatataaaagcgtctgtacgaacgtggagaaatgcaatattttatgctgtcgattacactgtgagctcctgtgagctcatatggcaacgactttgtctacaatattcagaaccactaccagagtctaataagcaatgacatagcattacacacatagaccaaataaattattttcccgcttttaaatagaatcaccattttctggcaatttttctgtctccaccatgtttttggagatagagaatcagaaaaccactgatcttgtaaaaattttattgtctgccattcctccagtttcttaagtctaattcctactctgtttcccaagccaggttttcatagtttaataatactcagtatgtcaaacttcagccaacagtgggttttatggcgtttgaataatagactgtcaaagtatttccatagcctttacatatggctatggaaagtctatgaaacttagaacagatagacttccacgattctggttattgttttcactttcacagtgaactgtaatctgtgtcttgcagacatgtttatttttaacaccataaaataagaatacaatggatgtattctttgctgattaacataaatattttctatcatttctttcctaaattagcactttcaaggttcataacgtgaagagtttcatattctaaagcatgtgagaaagttaaattaaagcctccactttaaagaaacttggcatataaaaatttttccttcaagataaattagtaggtaataattttctttacaataggatgcataaatatattcttttatagcagtcctcttagcctattgaaaatattatttgttatgaaacttgatttgtgcagacatcttaaatttttaaaaatctcataaacaggatctaacttatatactgtcagaagaaatacagatctatatggcattacttgagaggtaccagtggcttctactcaaagatagtctctcccttttttcttccattgccagattctaatatttgaaaatctccatctaatatttgaaaatttccattcttctttatttcattaaaaaactttagctttaactaaatacatatagggcattcctcatttctgtgccagaccaagataatgattttcaaaagaaataatcaaaaaccactacttggctctgaataaaacctcacatccataataaaggtataaaggtcaaaacatgtggagattagggaaggtttattggagaggatttatataaagaatctggaattcccattctcctccctactttctcactccatagtctagaaagagacacttcaatggaacatttaaaagcaaagtccctggcagctgagattcagtggacacttgtgaactctctcccaagaaatctaactagtgaaaggaggtcggctacttgctgatgaataagcagaaaaagatgtgaatgaattccaacatttgagcatttttcatggtccagatatgggccttatgctaaagacagctggtctggggtcaccttgtttttttgtttgtttgttttgtccaaggctattgcctagatcagtaaaatagagaaaagctacaaggagttatagaaacatctggatttcataaataagcagtcagctgcagaagaagatatcactcacattaagtgaactgcaggtcagatgcagacctccaaggaaccctcaaaatcacctgtgacatcaacttgattgggttaaaagatacctaggtaactggtaaaacattatttctgggtatttctgaagctgttttcagaataaaattcgcatctggataagtagacccagtaaagaacaaaatgcctccaccaaggtgaacaggcatcatctaatctgttgaggggctgggtagaacaaaaagacagaggaaggacaattttgctctctcttctccagctgtgacatgcatcttctcctgccctcagagctctcctggttcgcaggctttcagacatcaggacttatgccagcaccctccctcaccccttaaccttgtactaagcctttggccttggactgggagttacaccattggctcccctggttctctggccctcagatggggactgaattataccattggcttcccaagttctccagcttgcacacagcagatcatgatacttcctcacctttataatcacataagccaattcccataataaatctcctcttatatatgtatcctattcgttctgtttatctgtagaatcctggctaatattttatctgtgccagattttttccatttgcccctttggatccactcatcaccttttttcaccacactctcttcccccaacccccagatatcacaaaaattgttccatgttttcaggtgagcttgtgcaaagcaagggataggcagggaggaggagagtagggttgaaagatttattttcttgttgccattccaggtagttgctgtaagttggttgtgtctgtctactgaagaccacaactcctggcagaagtcttcttcctacagccaccctgtcttgttctatgacccactccctccccttgatcctacaggcctgggagtgggcagagctccctgtagttgcaggcctagggtcttgctctatcccttattgagtccctcaagccttgttcatagctatataaataggccctttaatatactctcctcaaattaccagcttggggcactgtttttttttctcttgctgggaccctaactgatacagcaagtttatgggaaaagtcagccttcagaaacctgagagctagaaataacttttatgttcccttcagctctccttcctcctcttgcttctaccccagaaaaggggagaacaataataaaaagcaattaagttctctttcaactgctggtttcctacctacaataggtctaagctgtggaaaatcagcccaattgaaatcaaggtataagttttgacagttatattctagttattgattagaagagagggactggcacaaaagactgaaggtaactagaaaagtttggccattgattgacttttcagccagggtgaagggaataatttacccaactgtataaaatcaatgagacaagaaacaaaaatataataacttcattttacctgttttttaaacatcttagttattttagttttaaattccaaaagctaccttggaaacatcccacatatgaaatatgcattattgggggaaaatacagtagaaagaagagagtttgttaagaaatatgtagaatattgaccattcttagagggcaggcctgacagtggtgttcaagtcagttaagtggaaagaagggcatgaaaaggaggacaacctaagggcaaagtccaactctacagcgctgtctcagacttactcagagccctgatcacaggatgatgcaaatttaaaattcacaatgcaacttcaaagaaaatccttctctattcaaagtgatattcctaagactaattccaagtacatctttctaagttccttttttcctgcaaaatactgatgtggagaaaaaattaaaacctctacttagtgagtcagaggagaggcgattcctactcctaacttttccacttcctagatgtgtgaacttaagcaaatcacacagtttctgtgggtctcagtttcctcttctgtaagatggcgtgtagaaacagatgtgttgatgtctcgatcagatctgatcactatgtactaaatgttactattggtggtgttcattgcctctcggtggtatttccctacaggaaagagcatttttattttactctataagagaaaatattattagagtaataccccctggttcgctggtctgtctgggtagcacaacttacttagggggtgaggttggacagaagttggagacgacttattcacagctttatctctattgggcttttctctttctccttctgcctctgtctctccttcctctccgggaagtgctaaataagttgtctttaatgtagggaggaaggagtagcaagcccctttatgaccaagacctatccccttgtctagttttgttagttctagttcctgtagttcgaaggggaggaggggcaagtgacaagccacaactaacgcacagaagtcggtagaaattggtagcaaaagatattcttgttttcatttcaaccagcaagatttaaaatgaagtatcattctggttacaggacttataatagatacatgtttcaccacatccttgcaaaaatgcagatttagtgagtgattcttctacaatcaatgtgcagagatttctaaagtaattcagtaaactgtaattaatgttattgaacagagcctggagaacacccatgtatctgagagacagaactaaatactgtctatgcaaaaagaatctataaaataaccatttgaaacacacttatgtatccaaagctgttactaccactattttaccatgttttcaataaatatatatgctattcttcatcttaggtttacaagtcaaactaggaaacatctatgtttcattattaattagcactgaacaaaactcagtaaatttcacttaatcaatgatatcatctagtttgattcagaggggttcagaatcttaagtgttagacttttatttctttaatgaccaccaccctccttcccaagggtcaacgttccccctcactgagtgggtgcaaactgacatacccatcagaaaagatgggcatttggagagccataaactaagcctctctgagcagggtgatttggacagggtgctatatatcagttccaggcgccagggaggactgatacagcagcacaaagctcccgatgaagcacagcccagttgcaggagattgctgtgatgataatcgccagaacaaaccataaattctggactcagaattaggaatggcctgtaaacatcaaataatgggtgtctaaattgaaaatgaaactatttgttgcctgtaatatttcttgcagtgtggctcagagagccagtaacattcgagacaagcgtgatctttttcaatgtctgttgttagaaagctgaggatattaactcctccttccatcaaccccagggaaacagagctaaatgaactagctagaaatcatgggacataaaatatagatttaacattatgcagcaagaacattacaggttaaaaaaaaaagaacagagaaatacaagtactgcattgaagaaccatactggcgagcactgaaggaacaggctcaaatagtttactcagggccctttcacactcactcatatacattataaaatgaaacttgactttcttgcatctggtttaagggggtgccagtcaacctggtgagaatctagattatacaaccacagacatgacatttggggatccataataattgcagattgggagataggtacttgatggattttttaaggcactttattaaataggaagaatcgtgtctaataagcacagttttaatttagtaagatcttttgttataataacaagtgcattgttacaagtgttacaagtacatgaacaaatatttttctcctgccattttataaataaaacatatttttgctctatttatctgcttactaaaccttttttttgtttatttgtttgttttgttgttgttttttaagtctcactcttctcgctgaggctggagtgcagtggtgcgatctcggctcactgcaacctctgcctcctgggttcaagtgcttctcctgacagcctcccgagtagctgggattacaggcatgcatcaccacgcccggctaatttttgtatttttgttagagacagggtttcaccatgttggccaggctggtcttgaactcctgaccacagataatccacccgcctcagcctcccaaagtgctgggattacaggtgtgagccactgtgcgcggccacctttgttcttatcaaaagaaatgaaagccaagatgcatagattaatgacatctaaattcacgaaaatttaccaaattcatgaaattactgttactcctgctaaatcaatgtacacatatactccatttgaccaagatctttttttatatataataacttgtggaagaacagaagatattgattcttgtgggttctaggtactgtaattaatagaatattttccatgtgagtataggcggatattgtgtatgaagtagttaaatagtaatgtgacgtggggatagtgatattcaaaatgtttaacaaacagaagtgcagaagtgcctgagcaccagcactcccctgcatggacaaggggcatttgggagctaagggcagcaagataggatctatttgagtatcatccatagaaaagtatgtatttaagaaatcagtgttcaggtagggcaggatactgaatgttagctcagcagtactctcgctgagcaattgctgatggaggagtgaagggaaaatatattaaaaatgacacagaggacatgcaaggcataacggggtgctctttataaacattgtgcctcaattaagaggtgtctcaatgaaaagaaaattccctatctccaggactatgactctatagactaaaaatactcaagttaaagaaagctaacagataaaaatattatttctggctgggtgtggtggctcatgattgtaatgccagcactttggggtgcccaggcgggtggatcgcctgaggtcaggagttcaagaccagcctggtcaacatggtgaaaccctgtctctactaaaaaatacaaaaattaccaggcgtggtggtgcacatctgtaatcccagctactcgggagactgaggaaggagaatcgcttgaggcagaggttgcagtgagccgagataacagtgagccgagattgcaccactgcactccagtctgggcgacagaacaagactctgtctcaaaaaaaccgtttctcaattaacaagtaaaggtgtagccaatatgttgcagagaatatgagagacaaaggctaaagagtatcaataatataaacaacaataatatcaaatgttaatggtttacttataatgtgccaaggcctggactaagtagtctataaacatcattttactgaatgctttcaatggccccattaattactggtaattatatttttgtggtatgccataactaatcttattatatgagtatattattctcatcttaggatacagtattggtcattccaaccacatattttaatcgtcttaacagaatttggaccaaagaatatcttcatgtccaaaccaaactcatgaccttcccaccaaaacgtggatcccctcactgtcagccgtgaagtgccataagcccaaaatctagaagttgcccagactcctgcttatccctccaattgtacatcaaaacctcttatttacttctagaatccattcacttttacctttaccatcgccattacctcaattctttattgcttaaattaatctcattattccctaattggcctacctgttactttttaccctcccagtgttcaagttaatgtcctagcccccactctacagccagtgtgatcttaaaataaacaaataaacaattagaatttctctttgtgtgatacccatttgtttaaaatccctctgtttacaatatgctcctctgtttaaaactccatttaaaaccccttaacgggttccctttgaaggattttaaacagggagtcaaatccttaacacatcctaaagctcctgtatgatctggcctctgcctaaccatctctccagctccatctcaagccacctcttctctttactctttgtgttccaaccattatggctttccagatagttaaacatgtcattcccttcttctccacagggctctggtcatactgatccctcaatttggaattattttcccattctttacctcctatattcttatcctggttatttcctactcattcttccaatctcaattccaatgccacttctgccagaaagccttcccaaactcagcacttacaaatgcttaacacagcttgtaatgataaactcattttttgtaattaattgattaatgcatctctcccccaatagatatgaaaatactagcagggaagaggaataaatctgcttttattcactgctctcctcacccccagcatgtggcatatgccagacactcagaagccttcataattaagtactgaatcagttagtgaattaattacttgtttttataagaatactgaggatttttagataggcctccttacaatcaaggttttctcatcagagttagcagtagtttgtgaaagatactgtcttatcaaagctcatttctatatcgttgggttatatactatacttatgcactataatccgtatacatataacttgtacaactgcaaagtgtataatatttcactgaaaagatataacatcatatgaggaaaaacaccacttctatagaactattttgtaaaataatttttaaagactcataaattataagtcatgatgacacatttacctacagaaaatatttcatcatttgcatgaatagctttaatatgccacatgctgatttaaaatatcttactctctaaaaaaatataacctcctttaacatttaccttgtaaaagaatcattttttttctgaaaatgggtaatctacatttggtcctgtcttgaggttagaaaagacatttgaagttaacaattatttgtaagaacaactatcgtcatgatgtctactaatattcctcgtatttcattattttccatttgtgattcagcatcaataattcagataaagcatattttttaagtgtcctagagtattatttctcaaatcttaatttgcataagaatctcctagaagagcttgttaaaatgtagattctaattatttatgtctaggtggggcctaaaattctctatcacccacaagctcccaggtggtactcacacagcaggtacacagaccacagtttgagtagcaaggatgtagagtaagtggaatactccaatctaaatccaacactgttcagatacccagcattttctgttcttttgcttttggctttgagttctggcacacaactctatacaatccacttaatgttgtgaatgccaagaatcaaaagtcaattaccacttggcaacatgtacaaactttctgtttttaaaatatcaaaatctatgctggagtagtagctgtaatattaggcaaaatcagagatgatattatcaggagtaattatagtattctaaaacaaacttctaaagattgcctcatcacctaggtctggacagaagtttgattaaaagccactctatttaggtaatcatcttctctagaagtttacagagatgttgaagtgttttcaattatggctttttattggccagtaaagtatgggagacaaaaaaatcttaataaatatgtacagaaatcactttgttttataaatgttgaaactaagtcagaaacttaccaaaattaaatagctaggtaatgatagggctatgagaattaggtttgtaatctatttgtgttggatgtccaatggtaatccacaggtgtaatgaggttttggggggagtaggtttttgtttcattttcttgtttgttgttttaagacagagtcttcactctgtcacccagactggagtgcaatgatcacagctcactgcagcctcgaccttcccaggtgcaggtgatcctcccaccttagcctcctgagtagctgggactacaggtgcacatcaccacacccagaaaatttttttctattttttatagagatgggcttgtgctatgttgccaggctgatgctgaacttctgggctcaagtgatctgcccacctcggcctcccaaactgttaggattacaggcatgagccactgcaactttatatcctgaaattcctaccatgaaactggcttccaatattttttttttgcttaaagtaaacttgtctaaataatatttacctacttgtccagtatctattatacaccaggaactatgctattcctctgtataggtattttatctagtttagtagccactctgaaattgattattattatttacctttatagtcagataaattacaatgttttcataagtggtggagttcacattcattacactttactatacactatgtatttgaaatgtttataagtatttttaaacattttattgtaacttttttttaacttgagctgttattgagatgtctcttaaatagacttatgatatctgctgcattgttgtgtcagtacagtcataattctgcaactacataaagaacaattctatttattccttgtactgggatcacacccttggcctttctccatactggaattatatcagcttggttttctcattagctattagtcacaaatatagcaatacacaagcaaatttggaattttgagtcactgaattcaaactttccccctcaccttctgctgaggcttccacttaattacagactagtacgttttaatactaagcatttaagattaaattacctggccagaaatagatcctgaaaaggctggttaaagcagaactagggcatggtttagacagacacagaggcaacatgaaaagaaaattcaaaatgtaaataagccccacaaaactcgagtaagatgcttcaaatgtggggccttaaacaaccaccatcctttacataacaagttgggaaaatgtcatagataaaaatcaagtacaggaatacctcaaagatattcgggttcagttccataccaacacagtaaaagaaatactgcaataaagcaagtcacatgggttttttggtttctcaatgcatataaaagttaagtttacacaatactttagcctcttaagtatgcaacagcactctaccacactatagtctcttaagtgtgcaacagcattatatctaaaaaatgtacataccttaatttaaacatatttattgctaaaaaatgctaacagccatatgagccttcagcaagtcaaaaccttttttgctgatggagggtcttgcctcaatgttgatggctgctgactgatcagggtggtggttgctgaaggttgggtggccatagcagcttctgaatataagataactaggaagtctcctgcatcaattgactcttcctttcaagaaagagttccctgtagatatttgagagttttttactagcggtagaacatctttcagaactggagtcaatcctctcaaaccatgtgtctgctttaccaatcagtgttgtaagacattctaaatccttttttgtcatttccacagtgttcaaagcatctccaccaggactcgattgcatctcacaaaacaattcctttgttcattcatgagaagcaactcctcatctgtcaaagttttatcctaagattgttataattcagtcacatcttcaggctctacttctaattctagttttcttgctatttccaccacatcctcagttactttcaccattgaagtcttgaagcccttgaactcatccatgaggtttggaatcaacttcttccaaatgcctaatataatgttgatattttgacctcctctcatgaatcatgaatgttcttaatggcatctaaaatagtgaatccattccagaaagttttcaattaactttgcccagatgaccagagttattatccatggtagttatagccttatgaaatatatttattaaatagtaagacttgaaattcaaaattactccttgatccatgggttacagaatggatgttgtgttaccaggcatgaaaacaacattcatcaccttgtaaatctctaacagagttcttgggtgactagatgctttgttaacagtaataatttgaaaaggaatccttttctgagcttcaggtgtcaatagtgagcttaaaatgttcagtaaacggcaacataaacacatttgctgtcatctaggctttgttgttccatttacagaatacaggcagagtaggcttagcataattcttcagggccctaggatttttggaatggtaaacgagcactggtttcaacttaaagtcaccagctgctctagccaccaacaacagagtgagcttgtcctttgaagatttgaagccaggcattgactactcctctttagctatgaaagtcctagaaggcgtcttcttccatgagactattttgtctacattgaaaatatgttgttaagtgtaactacttcatcaacgatcttagctattatcttctggataacttgctgcaccttctacattagcacttgctgcttcacctggcattttcatgttatgaagctggcttctttccttagacctcatgaaccaacttttgctaccttccaacttttcttccgcagcatcctcacatttctcagctttcataaaatcagacagttagggccttgcagtagattaggctttagcttatgggaatgttgtggctggtttgatcttttagccagacctctaaaactgtcctcatatcagcaataaggttgttttgctttctcatcattcatgtgttcactggagcagaactggaagagttcctacaagaacatttcctttgcatgcacaacttggctaactggtgaaaaaggcctagcgtttggcctgtcttggcttttgatatgttatccccactaagcttcatcatttctagcttttgatttaaagaaacagatgttttactcctcctttcacttgaacacttaaaggccactgcatggttattaattgacctaatttcagtatttctgtgtctcagggaacagcaagcctccaggagaaggacagagattggggaacaccagttggaagagcagtcagaatacacacccttatcaattaatttacccatcttatatgggtgcagtttgtggccccctaagacaataacaatagtaaaataaaagatcgctgatcacagaccactgtaacagatataaaaataatttaaaaatttaaaatattaaaagaattaccaaaatatgaaacagaggcatgaaacgagtttatgctgttggaaaaaatagtacttgcctgaagcaggatttccacaaaccttcgatttgtaaaaaccaccatatctccaaagtgcaataaagtgaaactcaatataagctcaaaataaattatgcctgtatgaatgcaaatctaaaagagagcagtcagaaagaccaagtaggtattaacaaataatgaataaatcaataagtgaatatatgaaataaacctcagctgtgtccaaaagcacaaaagcttctgaaattataagccatgtaacaaactaaaactgatctcagcaagatgatctagtgatcactccagcggaatatcaatgctttagcctagtacacacatgttctgagctgtgaaggtttttcatgattattatttttatccttcgtaattatctttcagtttatatttctagccttgaaacacataagttattctttgcatttagagcctattaacacaatttcaagaagaaaactacaataagcagggcttgtaaatttgttttttttttcctactgaaaagcaaagagaagtcgatttgttgacaacaaaagtgcctcaagtgattatgttttctttatttattctcagtgtttattcccaattcctcagtcccaactaaaggtctactacagagagtacatatttcttaaatctggaaaataatttaaatacatcaactaacacttgcatggtgcaaaataccttcagctagttgatgccaatgtggtacttaaactatggttcccaggatggcaatcctacatttccaccacactagcagccccacaagatagagttcactgcctcaatgagttcaaaagtaagaaaaaaaaaaaaaaaacccacatttaaatactaacactattgtgcatgaataaatggcaaaacaaaggaaactaagtgctttccaatggtttaaccaagaaccattcaatgtccctttttctgttcctccttaataactttttccctaggtgaaggttgaaaagaacagtgccattatgacttcgaatttggtgcaaagccagtaacacatattgatactgtcagtagctgtgcacgtgattttgctgtttttaaaggagagctacattttaaaaaccgaggttggagcttgctctctctaaagtgtctgtgattgtccttgccctagacctcaggttacttatttcatctctatttgaagagacagaggcagggttgttcctcagtcaatttttttttcagtctacaaatcaagttaagctcaaaattaacataacaattatttgggcatgtaaaatatgatgaattcctatttcctatctcatttaacattccttccaatttcataatgtcaataaaccagggactaaagcccttgtaaattattataaatttctccatatatgcatccagattggcctttgacaatatcttaccacaaggagactattttcattatacactctatctactttcttcatgatatgtcttacaattagctcagcagagctatccacttacaggttggaactttaaaaaattgctcaagtctccatgaattaaatgaagatttagatgaaattcaatgaagatcaaaagcttagaagtgccaaatctcatttagctaacacatattattcagtctcctctaagtgtttactaaaatacccatggaaacatattttaagttgaaaattgataacaatattattactaatatttataacaatatcttgcagttaatatatttagaactattaacctgtttagatttattaactattaataggataaggatagcttaaaaaaagttaattgatttaaagtttctgtaaagaaagatactaggcaaattatagcacaggtggtgtttaaaggtggaaaaaaattgtgaaaatggtgtaaaagtgatggaagtttgggaaactctggagtttattgccaatgccactattttagttaggtaaatggctgtataactcaattcagatcaatcttagttctttcgacatctaattggaaactccaaatcccagaaaaaaaaaatgggtagaaaagagaagaacttggaaatagtgcattgaattctaggagttgaggtgcatacaggtaaactttgattagtgaagtgatgaaaaaatgattctagtatcagtatatagtgagtattggagtcttttcaccatgtacgttacctgttcaagtctccaaggtagaggtaaaaagtaacatttcagtcctattgagatatatgagataaaagacatatgagataaaaacctgctagacaactacaatttttctataaaccttatgcatcaatctgtcatcatctatagaactgaagggtgattcggccagcatacaagtaaagagagtataattcaaagtaatatatatgtactgtttcttggtaaacaccaaactatgagagagctttctttgcatgtagagtaaaaaggaaaagaaaaaaccacatggcttaaaaattacaaatgggacctaacccaagctttgacagaatcaaaatgatctgccagtgacttaattcactgtcagaacaaacctcaacactcctgaaatgaaattaaaacaatcaagagcttctacaatatatgatccactgtgaatagcttacaataaaaaataaatagtcatgtaaaggagtataaaagtgtgactaataaaaactaaaatagacaatacatataggcccagacattttctaaataatgaagttaacggacaaggacttcaaaagagctgtaattaatatttcaataaaaatgagtaatagagagacaaaatgtatgaaaacatacagtatttccacagaaaattagaattaatcatttatgagatagatattttaaaactgaaaaatagaatatctgaagttaagaacttattattggacagaactaacagtactggacatagaagaatacaaaattagtaaatctgaagaaaagtcaatgaaaaatatttaaactgaagcattgtggtgaggagagggaagaaggtagagacaagcattagagaaatgtgggacacggtcaaaacatttaacacaagtttaataagaatcccaaaaggagagtgtagagaaaatgaaactgaaagcaatatttgaagaaataatggctgataattttccacacccgaagaaaggaaaaagcacacagattcaaaaatctcagtgagccccaactaggataaattcaaaggaaacagaactaagaacattctagtgcaattattctaaagcagtgataaagataaaatcttaaaagcagccagagaaaaagacaattacctttatggaaataataacataaatgttgaacacctttaaagtacttaaagaaaaaaaaaatcctgccaaccaagaattcaatggccagagaaaatacctttcaaaaataagagaaaaagtcattctaagataaaagttcagagaattagttctagatatcacacattatagaaaatactaaagaaaggtctttaagtaaggttgaatcatcagtgtttttgatggtatacagcacaatttggatacaaaaacacatgtacaaatcaaaaagacatttagaagaattagattgaatataaatcattctagtaataatttaacccatgtactctgcttatattttcctctttgttatatatactacactaataaatgataacacaatatgttcaattactcaaaagaactcttttgataaattaatatcaaaagcctaagtgattagaagatgcttatttggcagtgttttattttctttcttagtggtatttcagttaatgatctagtttatccatggaattataggttttataaaatacagcaatactttaaaaatcaaggcagcagaattgaaaaattcaataacacttctttagataaaaaacaatgaaacaggcaaatatttgagacacttatctatgaaaaaaatacataaacaaaataaggcaaaagaaactgatgagataaataaaatatagaaattttcaaatattcctaataaatttgaaggtattgaaatttaaaaatgtctacaagaatataacacaattttctcattaaaaagtagataacaatcaggaaactacaactatataggaactatataaagacatgaataaagagattttgaagttacccccattaagtccttcataactttaatcctacgtagatttatacattgtcttacaagtatttttatttgctgaaacaaataaaaatggaaaagcttccccattcatcctacttgctagcataagcctattcaagaaaacttgacaaaaatggcaccaacacaacaacaaaagatatcgtaagtcttatttatgaaaacagatgaaaaacattcctaaacaaaatataatttttcacatacaaaaaaaaattccagacttaactggctccactagttaattctatccaaaatttaaagaagtcatactaatcttatgcaaaatctctgaaaaaatatagaaaggagcactaagttgttctccacacctctattcaataataagctggaggtcttagtcaatccaatgaggcaaggcaaaaatattagggggaaataaatataaagtacaaagaaaaaatgtctcacacatcgtgatttacagacaacaaaataaaatcacgtgaaattaatcatcaaagtattataactagtaagttagccagatcacaggctacaagttcaacaataaattatatttttatataataaaaataagcaaacggataatggaatttacagacaacaaagtaaaatcatgtgaaattaatcttcaaaatattataactagtaagtttagccagatcataggctgcaaggtcaacattaaattatatttttatacaacaccaataagcaaatggataattgaatttaaacataatgctatttgaaacagcatcaaaagttataaaatacacaaaggtaaatgtaataaaaagtttaaaactttactctgaaaactatgaaatatttttgagacaaagtaaagcagtcaaataaatagatccctatgccctatgcatgtattgaaaatgtaaatattgttacgttttccaatctgccaagattactcaatggattcattacaatcacaattaaaatccagcaggcttttatttcagaaattgacaagccaattctaattttatgtggaaatgcaaagaatctaggatggacaaaagaatctcaaaagagaataaagtgaaagaataatagaacctgatttcaagacttcctataaaactacagtaattaagaaaatttcctattagcaaaagtataaataagtacatcaatgaaagagaagataatccagaaagagattcatatttacatggttaataaatatttacaaagccttcagagaaattaataggaaaaaataagtcttcaatatgtggtgctagaaaaactagataaccatattttttaaatgaacctcagtccctttttaataccacaaacaaaaattagtttaaaactgtccataactgtaacacctaggagcaaagagcttcttgaagaaaacataacatgtttacagtattggagagggcaaagattttttggatatgataaagaactacttaaaaatgacaaattaaattacttatagaaagataagaatatgaataagcatgacacaaattgagaaatattattcacaatgcatatatctaacaatggacttgtaagcagaatatataacttactctttcaacacattaataggacaaataaaaaccataaaaagaagatatgcaaatgaccaataaacacatgaaaaattactcaacatcaaatatcattacagaactgaataccatctcaacacccactagaatggctaaaattaaaaagactgaccgtaccaaatgttggcaaggatgtggaacaatttggaactctcttacattgctggtgggagtgttagatggtaccacgtctttgaaaaaagatttgtcaattcttacaggaataaatacatgtgtatagccagataattctacccagcatgtgtccaagaatattaaaatatatatcaaaaagaattgtacaaaaatattcatagccatctgaatcataatagccccaaaccgaaaaaaaaaaaccctcaaatgcccttcagcatgagaatggatacatttgctgtatattcattcaaaacaatactagccaattattaaaatgttccaacgattgatatagccacgaatgtggaggaatttaaaatctttttctcaatgagagaagacttacacatctagataaatctctaaatgggtaaaactgatttatgttcaaagaaatctgaaccttgatcatctgaggggttgtggtgtataagatttgactgtaagggggccccagtgaacttaatggtatatcggaaatattcatttttttttagaaatatgagttacacccatgtacatatttttcaaaacacatcaaactgtaacatttaagatctctgcatttaatttaaacatatttcaatttcaaaaatgcaaaggtgttgcatcgtttttatcttcttacaatagataatttactttttattttcaggcagggcaattattaatccatttggtttggttctggatttgtgtctcttttcctacctctaactctcatattttacaatccgccgtcatcaactacttacaattccccaaacttacattagcacatgaattctgtttgcttggaatgtccttttcctctttctccacctacacaactctcacttcgaatttctgagactctgcagagacctcacttcctttccaaagtccttccttctctcaggcaaagttaatacctcccacctctgttcaattctgcactgcataccagcatttatcactacacattgtatattttgagagtttatttgcatgtctctcaccatatatagtccttaagggtacagaccatagctacagatcctataaagcaacaataacaacatgaaccatttattgaatagacacttattgcaggcagagacaagcaccttgcataaatatctcatttaattttcaccataatccccattttacagatgagcaactgaagcatagagaagtttattgcccatcaataatcacaaagctagtgtactgaataaagttaattttaagcttttaattttcagctctttctgattccaaaatccattctcttaatcactaagtaggattaactacctcttaaatcttccatttaaaaacaaaataggcatgaataatgattgcatttaacttgccaacaattttttgccttcattatgacactgatatacaaactaaagcagttacaattaaaagatgccagttgttttttttttttttaatttaagcagtggtgtgcatgtattgtttttggttttcatctgttgccactgacatttgtgaatatgatcagacaaaagtgtattttttttacctctactaggtgtctagtttattgtttttccccagaatactgcctactataattggctctgtgtatgacacctatctgtctgtggttcaccccctgaaaaagaaataatatatttcaagctcttaaactggtttccagaatactgaaacttgaccaacccaaaacttgctggttttatgtttcaagcagttagtctaggttttatatattgttttattttgtttattaaatcgtttggctttgtgacattggccctggtctctccagctgccccagtgcctcattagtgaactccagcatcatccctacatccgcgcatctgtatccttgctcagtgtcacttctggaaaaactctctgttctgctttcctaatgataagaacgatacctcaaaccctctctcctgcaccccacatgtcccttatttgccttttatgtctacaatatacactttattttgccttttttctttgaacaatctctgagaagactagtgaaaagatgatccttcctttcctaaaatactagttggagaatataatggcactattttttctaaaggggtactgactagatgaacgtttattaaacacctgtaacataaaatctatattgctctccctagttattttcagacctaatcccgttgcattgtagttgtcattaaagctcaatttttagagattttatggagttagaaattggctctatttagctcctgtttagaaaagagttaacatagcaggagtgaggctccttttcttataaaggcatgtttgcaaggctggcccttgactggaacttgggagcttgaagagtaaacagtttctatattgatacaaaattttccccaattgataagagtagttcacagtgcctaaatgtttgtgcaaataatatgctttatgttgaatacctattttcctacctgacttatgtatgtgctcagcagagggtgattacatgattagctcccaatagaaactttggacttctgtgctcagccaagattccctggtgataacatttcacacgtgtcgtcacaatttgttgctggaggaattaaacatgtcctgtatgactccactgggagatgacctctggaagcttgagactggattcttctaatctttgtcactttcatcttttccctttgctgagtttgctttgtgtctctttgctataataaatcatagccgtgtgtacaactatatgctgagtcctgtgagtcctccttgcaaatcatcaaacctaggagcagtcttagggactcctgacacagctaatgttcagttttattctttaaaaaaaaaagaaaaagaatattcagttaaaaatctcatttgtttgaagactgaattaattatgtgttcatgattttttcactttctgtctctagattccatatatatacacatatatatacatatatatttatacatatatatatatattatccttcaattgtattcttgattatacaagtaaataataatggtaatttatgggggggagaaaaacataaggaaggattttctgagatgtctatttttctcagaaaattcaagctatctcttttatagattcatctgtaagctcaaattttaagaggaatcattagatccagataacagtcagaaagtacaagctgaggttctaaagagttggttcctttaaatagtcatcatcctcagcaggagataatgttttgaaagagttataatatttatttttccaggaaaagaaatgcacatctgtgtttttgtaccaggaggctgagagaatgaaatgtaacagggacagtgtgagcagctagaaaagtatttatcgatcaagttcctgtgatacaaaatgccaaggaagttttttcagctttcacatttacatttcattttctaatttgaatggattagatgatactcctctcatactattcataagggtaatttgaactatttcaaagcaataaaatggaaaattagttgggaaaaaggtcattctaatatagtaacgtaaaatgctcaatgatgaactatcaaataaatagctatttgattataagagtgctttagggaaataaagaagcaaaagagagaagggaaatttaaaaagcattaaatactgaagttagagcatgatataaataataatgtctaagcacatagtatttactgtgtgccagatattggtgtttgtgtgtgtgtgtgtgtgtgtgtgtgtgtgtatatatactcatttaataatggcaaaaatcctaagaggtagttgatatttctatcagtgccatataacaatgaggaaattgaggtttagagagataaataagagtctttaaagatcacacattgagtggcagaaccaaatccaagctttaatcactgtactatgttgtacacttaaagacgaggcatattgtagaaagatttctcaaaattgtgctaaaaattgttttggcttacttaccaaagttttattttataaggaacgaaagtgggtgaagggacccaaattgactattgtaacttttctcacaggaccaaacactgtgccaggattccatacgcagatatactcaatggaaggctaagactttcctgagaccacattctctataaatatagatggaaatatattcatcaatatagagggaaatatatccatctatatttatagagaatgtggcatatatgtgtgtgtgtgtgtgtgtgtgtgtgtgtgtgtgtgtgtgtatacatatatacacaatgtggtatgtgtatataaacatacatatatatattcggcaagtattttgtacaatcatagcttcttcgagtttatagataaacatttcaggaaattgagagagacatctatgttgatagaaaccaaaccagtaaaacacaggtaaatggatgagaggtgactgcaaaacacagagaataggatgaaagctaatcaaaatgacaaacgctaatcaatgtaggcagaaagggcaaaaagataattctcatgaatacttacaaagtatattctgaccttggaagtcttaggttggtgtttatcaatgatgaggccaaaagtttgtacctgtgtaacccagtttctctgagttttgggtgcgcactgtgaaaaattacctacttgttaactgttgtacctggagctcctgcttcaaaaaaagttcagcctcagaaataccaaaactgcttggatccagagatacctgagatgatgaattttggtgaactcccctcactactgtactaaaatctctgcacagggaggaccttattctccattttctacataagtgacgtatgttgaagcatgattggtgactgtgccagcacggcctttactccaacctcagctaaccaacccagtaaaagccctgtttccaccattgttcaaggagggactactttgggaactatccctggtgtcctcttcgtttgttgcaagtaataaaatatccttgttaaatcctccttgattgtggtcattggactgttacctgacaagcaactgaacccacccgttgtgtgggtaacacctgtacttggaaaactaatgtctaactaaattgagtaattagaccagtgtctattagctcaaaactattttccctcactatgagtgagatctctgggtctattttccaaaataaaaatttttaaaatacaaaattcagagttaaaaagttatcttccccaggcctgtttcttcctcagaaagttgaattagaaaaaaagcttgagtttttatatcatctgataagctttctcgcattttttaataagagctatataacttctttaatccactttgactcgggctatcaataaactcattttcaggagtttcccttagtctaggttttctattagtgtgatctcaccactcttgcttgcttggttctagcctcagtatgcttaatttagttattttattgtatttggagttctcatgataagccactgcaacttctcttttgaagtatattaaatataatatgtttatgaaatgaagcgcttaaactgaggataaaaaaggcaggtctcatcggcaaaaatgtaagagaatagacctagagattttattggacagtaagttcaatgtggttaagcagtgtgctgtgactgctaagaagtcaactccattttactcaagctgcatccaaagatgtatattacctacaataaagaaggatatgtccctggcaaagtagttagaccagagcataccatttagcaagtatgtcttgtaaatttaattggacaattttgtttagaccacacatggaatattgtgttcagtgagcaaaagcacactgctaaaaagatatatctgaccatactcagtgttggcaagtaggtaaagcacctgagactctgatacactgctggtgtagatacaaaatggtacatctgtaccttcgggagtggtttggcagttactcaaaaagttaaacatacagtagttccccttatctgaggttttactttccaaagattcagttactcaaggtcaacagtattctgaaaatctcaagtgaaaaatgaacaattcataagttttaaattgtgtgatgatatctcgtgccattctggtctgtcccactcaggacatgagtcattcctttgcccagcatttccacactgtatatgctaccaatccaatagttacttagcagccattttgattatcagatccattatcacagtgtctcagtgcttgtgttccaataatccttattttacttaatggccatcaaaatttggaatgacttattcgcttactggtcatttaaaattatgaaaaaatccaatgataaatataatcaaaactttaaaatgaatcttcaagtgtatatttaaattagtagaagatgttgctttattgaaaccaaattatttcttgcagcatgaatgttataccttgggctgttacagcagatggttgtcagcattggttacctccacgactatgtattatatgaagactctcagtgtcgttatcattttcttgttggaacttgcataacccttctttcttaaagcttgctgacatcatttggaaattctcaaacacttgttctctatatgaactttaaaattgttgtattatgtggtatgtgtgattgtgtttaaacaaaagcaggcaatttgactggaattattaaatacatacatctatctggcaagaaatgacatcattatgatattaagtcttcttatctaggaacatagcatttatttccagttacttaatttttattttatctattaaataatttttaaaatatcggtttacatcatttttactaaaagtattcctaggtattctatatttttattgctaatatgaacggattttttccattactaactttttactttaacgtatttttcttggatctgggatcctcacaaaatattcatttttgttcttttaacagatttgaattgtttagatttaccattgaatcacctttaagtaatggtgattaattcctttttccaatatttgcacagcttattccatttacttaagtgattcactagaaatgctgaatgatatagaatagtcacgctgatagaaagcatccttgatttgtgtcttatattaaaggatcaatcttcagtatttcttaatattatatgatggttttgattagttagacggtctttggcacatttaggaaaatgttttctattcccatttaatttatgtttttacctagaattgctgatttctttttttttttttttgagacaaagtctcgcccttgtcctccaggctggagtacaatggcatgatctcagctcactgcaacctccgcctcctgggttcaagagattctcctgactcagcctcatgagtagctgggattacaggcaactgctaccatgcccggctaatttttgtatttttagtagagacggggtttcaccatgttggccaggctggtctcaaacccctgaccccaggtgatccacctgcctcggcctctcaaagtgctgggattgaattgcagatttttagcaaatgtttttcatgtctctgtttctacaattataggattttgctctaaaattctcttttagtataatgaataatattgatacattattaattgtgaattacctatccatagaatatagcctattttaagcagaggagtgaaagttatagttccaacatctaaatataccaatatagtatgaagatgttctggcttagcagtagttctggcaagcacattagttcccccacatccctaaagccacttctttcccacattccctagctttctggaagatagcaccctccagccagctggaacactgaagtcatcttagatcactctttttctgtgaaccccacatccaatctgtccccacattctgctgattccacttcagaaacatctctcaatttcagatctcccatccattgacttattttaggttctcaatatctctatctctttgcccacagatttcttattgggtttgtggtttcccatgttgctcccacatcccctaaaataactccaacacttcagctagaaactgagtaaaatattttgttacttaaaatcttcaatgttttctcataagtaagatctgtgtaaccaatgaatgctgtagtaacagcaagtatgttagcatgccctccacattcatggtggtcttcaatgcccctctgtcattgcccatgacctccatcccatagctaatcagcctcctgcctatgtgtttctccccacaagcctcttcactagaacttgtgtccttctttccaagaaatctctcttgattcccactctcatagaatgagttactcttagactgttatattagtcatcttcctccctgtcttcatttcatctctacatcctaggtattaagcagagtatattgtaccatgtggagactcagttgggtttcagtgtatatagtggaactttagataaacgcaaattgaaattatcaatgtaggtgctgatttgcaagttaaaaactaaaggtcaaagtcaacagtaagttcacagtatactgtgcaagcactagtccatgtagtatacttgcactaaaatcaggatgtgcattttaaaagaaacagtgaaaaattagaatgattctagataaggcaaccagtgtggtgagggctctgacaacaagggcacataagattttcaagatgttccagatcctgggaggactagcaacacagctgcaggaacttagatgtttaggttagagaagagaaacaaaagagaacaattgtcttcaacacttagaggccagtggaagagaggaaaagaaatagaatcacagatcatggaatgaagagccaattctgaatctacgcaagaggaatttaaggaattttaatccatatggcagaatgcatagtaataaaatcactataattctttagcttcccctagtgggtttcgaaatggagtaaaggtagtttgaacggaagagttcttagctgtatagaattagtctggacatagcagaacatttagcgtctctggctcccactcacaaaaatccaatactagtcctaggtcattggaataaccaaaaaagccctcactcatttacaaacgctctcagttgagaaccactgaaatttataccatgtgctaggaattgtgcatgatcgctttaatacattttttaattctctcaataaccaagcaagatagaaactgtcattcccatgttaagatgaggaaattgaaactctgctactagcagacagaccttctgaatcagattgcctgtttatatctctgatagcagagcactttaagatttatcttagattaagataaccaagactctgtattaagtttctgagatactatcggtttcattcatgagtatgttcagtggccatactattcacatttgagctcctgcttcctgagatgaatttacctcttgtagcagctttactttattgagatgatctagttttatgtcccaggtgctcctggttttctttatctcactgtagtcagccttaccatgtaccaacatgggaaaattctctccttactaaaataaaacaagtagtttaagtggagaaatgaagtaacttgccaaggataataaggcaaatgaaaccggagtaaaatccatgccagtactaaattcaataatacattgaggataaagggagtcagattgtagttctgtgaaaggaaaatatctataaattatatataaacatatcttagaaagatgtcttacttttgattgctaaatagtgctcatagaaatctggtattttgttgacacaaatacaattacatggtattctgctatgacaataatgctaaatcctaattcattaagcaagagagagtgaaaggcaacataatacaatggttaaatatttatgaactggcttaggctgtataagtttgaattccagcttgacaatttattaatttcacgactttcggtatgttattcaaccttacatacctcagtttcctccttgtaaaatagagtaattgtagtatctacttcataaggtgagaattaaatacgttagtacataaaaagtgcttagaatatttttgggaacagtaaaaatattaagtattattattattaaggagcttatatttccaacttgctatctcaggaaagtccttttatttctctggcttgctttcttcatcactaacaatggtttgcatgaaaagccagtccagaaattctagatgtataactgcaaatttatcacaatttttttatctccacaatttttcactggatacatctcactgatgtaacaaaataaggatatcaatcatcagttgtacatatcctcttgaatattacataacttttgttttctctcactattttgttgaaacccaagcagcagttatttttgtctgttccttgaattagtaggttctgttaacaccttataattgttcatagttcagttttgtagctgctcacccaaagaacataaagtgcagactggctattacaaattttgtttgcttaatgagaaggggaaaggataaaatgtttgcaggtacatcatgttcagagttttggaatattcaatttgcttatcttctgagagacttgctcatgtaatatctatgttttatgtcttaatctaagacagccttctctgcaaaatccacactcaaattgctgcattttatcctgtcagctgcgtctttgggatcttgtctaataaaacatacaagtgtctttttctcctcctattcattatcactaaaagcatttcagtgtctcatttggtgaaaacaggcgtctactcaatttgtgaaatgatagggtatctatgttttaagtcatgcttgtcagccacctgattttccactagagttaggaaagtttaactcacaatgctgctttaataaatcagctcaatgaattattccattcagcataaaataatagctttgctgtaaagaagaaattcatatgtaattatttaataaattcaataaaatttttctggaaattactggtcattcgttaattaaaagttaattatgtttctattgtattccaaatactgtactgggaatgaatttttctagaaaattaataaaacatggctcctgcccttgaagggatcatagtctgatgagagagagtaaaagaattctaaaataaaaatcacctttttaaagattctaagtataaagtcggaaggggcagaatcagatttgccttagagaaagactatttgggggaagggcgtgtgtgtgtgtgagtgtgtgtgtgtgtgtgtgtgtgtgtttgaaaggagacagagacagagaaatgtgaaatgtagaggcaaaaaactcacacaagaagctctcatgtgaaatgaaggaagcctaaattacggcagtgacattggagacaaagatgtgtagtatagattgtagagctgctagaaaatatattcaataagactgaagacaaattagatggggaaaattctcaaggatgacttataaggttgctaaaccaagagactgagtggatgatggtgccattgaggcaactggatatatggggcaaaagctcaggaaaggtattggggcccggtatagaaacgtcagaggcagtaataatttagggaaagtgaaagcctctggggtgggtgacattattcccagaagaatgtttaaagtaaaggaggaaagaaaaaaaaaaaaaaaagaaacatcaatttttgagaaatttgcaagacagaggaaactagagactgagaatgaaagaatgaaaagttaataagaaccagaaatttcctttagcatttcatttaggggtcaagcctatgatgaagaatttatataaatatcattcatttaacaatattttaaaatgcaaaaagacgggctgggtgcagtggctcagctgggtgcagtggatcacacctgtaatcccagcactttgtgaggccaaggcaagcagatcacttgaggtcaaggagtttgagactagcctggccaatatggcaaaaccttgtctctactaaaaatacaaaaattagccaggcgtgctagcacgtgcacccgtactcccagttatttgaggggctgaggtgggagtattgcttgagcctgggaggcagaggttgcagtgagctgagatcgcaccactgtactccagcctagctgacagagagactctatctcaaattaaataaataaataaataaagcttaaagacaaatgaaaatctgaagcaaatatttgaacttttgtaacatataaaagttagcattcttttttttttttttttttgagatggagtctcgctctgtcacccaggctggagtgcagtggcacaatcttggctcactgcaacctccacctcctgggttcaagcgattctcttgcctcagcctcccgaggagttgggactacaggcgcctgccaccacgcctggctaatttttgtatttttagtagagacggggtttcaccgtattcgccaacattttttaaactttcacccaaattaatattttatatacaaaaatgaaatgatgaaaatctttaaaatggtagaataagaacctccaagaatcttctcataaaacacagcaaaatcgtcataattaactttttcaaaactctagaaattaatcaaagacttgcatcaaaatctggggagtgtgtgttctagaaaaacggttgaatttcagtaagaacagcaaattttatggtatatgaacttttcctattcccatcccctcccttcatccccagttctgtggcggccttgaaaacaaacaattcacttcgctggtgagaatcagtagcctggcagccaccaaaggggaaggatggggctaaagttccctcaaagccccattcctcaagaactattattgtttgacttgtctggtggttcttgggaagacttatctttcatattctctttatttgacacgatttgaaatattcgaatctttcatattcaaatattctccttatttgacatgatttgaaatgtcagcccacgtgaacagtgtcttcccctaggtataccatctttgttgattgaggtggtaaataagttagggcaaaaaaaaggcaatccaaaaagcttgtaaataaaagtttggaaataatatatttaaactgctaaaattaatttaaaaactgccacataatcgaaacgtggcaaaactatccttcaaaaaatgaagcagaaatgacattctcaggaaaagaaaaagtgagacaattggttgctagccctacagcaaataccaaggggcaatttccaggctgaaataaaaggacataagacagtaacttgaattcagatgaagaaataaagagcaccagtaaaagttaactacataagtaaatataatacacagtatagctatatttttgtttgtaactaattttctttgtgttttaaaacaagtacataaagtgataactaccaattcgtgttgacgggcatgcacaaaggactgggggaaaatgaatctatagaggagcaaagttttgtgctctactataattaagttgctattaatttgaattaaatttccataatttaatgtgttaattgtaatttccaaggcaaccactataaacataactctgaaaatatagtaaaagaaaattataacagtacactagaaaatacatatttaatacaaaaaagcaaagtaaaatggaggaatggaggagcacaaaatatgtaagacatagaaaacaaatatcaaattggtagacgtatattctgccttatcagtattcacatgaaatgtaaatgggttaaacactccaattaaaaggcaaaaatcgactaatggatttttaaaaataatacaacatgctgtttataaaagagacatatacattcaaagataccaatagaatgaaagtaaaaggatagaaaaagaaataccatgcaaacagagccccagaacacatgaggaaaaactgacagtattgaaagaacaaatagaaatttcaacaataccagttggaggctttaatacctcatgtctaataaataatagaacaactaaacagaagagaaacaaggaaatagaagacttgaacaacactataagccaactacacctaatagatatttatagaacactccatctaaaaattgcagattgtacattcttcccaaattcacatgaaacattctccagaataaaccatatgttaggcagtgaaaaagcctcaattaacttaaaaggatttaaataatataaagtacgtcctccatctatgatggaattaaattagaaatcaataacagaagaaacattgggaaattcacaaatatgtggaaatttaaaacaatcgtaaattgccagttggacaagaataaatatcaagagacattagaaaatattttgagatatattaaagcaaaaatacaacataccagaatttatgggatgcacctaaagcagttcttaaagggacagccataactgtaaatgcttatgttagaaaacaaatgagatctcatatcaataacagaagattttatcttagggtacagtgtatactgctcaggtgatggatgtaccaaaatctcagaaatcaccacgaaagaacttattcatgtaaccaaacaccacctgtttcccaaaaatctactgaaataaaataaaacaaaaaacacatccaaattttttaaaaaacaagttagcaaaagaagagcaaactaaacccaaatcaagaaaataataataattaaactagaaataaatgataaaagaggataaaaaacctacagataaaagtcaacaaaaccaaaaattagtcctttgaaaagataacaaaattgacaaatttctagttagactggccaacaacaaaaaagagagaattctcaaattaccaaaatcaggaatgaaagcatggacattactattgacttaacagaaaatgtttaaatattataaggaatagtatgaacaactacatgccaacaaattaggtaacctatacgaaacagacaattcctagaaactagctacactcagggagcaacaggcaaatgaataaagctataacaagtgaagagactgaattaataaataattactgacaaagaaaatctcaggatcagataaatttactgctcaattctgccaaatattcaaaaaattaatactaattcttcacaaaagaattccaaaaaagaaaagaggacaaaaaacttccaacttatttcttgaggtcagcattacattgacactaaaactaaagacaccatgaaaaaagaaaactacagataaacatcctttaaaatataagtacaaaaaccatcaacaaaatattagcaaactgtttccagaaacacacaaaaagcttatactatgaccaagtgggatttcattccaggaaggcaagaccgtttcaacatatgaaactcaatcgatcccataaactatatgaatagaataatgaaccaaaaccacatgatcatcataataggcacagaaaataatccaacgctcttttattattaaccaaaaaaaaaaaaagcagtctaggaatagaagactactttctcaatctgataaatggtatctacaaaaacctcacaactgagaacatacttaatggtgaacactgaaagtctttccctaagatcaggaacctgacaagaatgtctactctcatcactttgacttaacattgtgctggaattctaactggggtaattagacaagaaaaataaataaaagtagtctttggaaaataactgaagttatctttactttaaaatgaaataattttgcatataggaaatcctaaggaatacagacaaactatttatgataataaattctgcaaggttgcaggatgtaagatcaatatgtgaaaatcatctctatatctatacacttgaacagtctgaatatgaaattaaaattccacgtacaatggcataaaaagtaaaatagaaacaaatttaacaaaggaagttcaagacttgcatactgcctacaaaacatcactgaaataacctgaagaagttttaaataaatggaaagacattctggggaatggattggaagaattaatattctcatgatgtcaacaatatccaaattggtcacaaatttaatgcagtccctttcaaaattccagctgtgttttgtgggtttttttcagaaattggcaagttgatcataatattcatatggaaaagcaagggactcggaatactcaagacaatcatagaaaaaagttaggctcaccatcgtaatcccagcactttgggaggccaaggtaggcggatcacttgaggccaggagtttgagaccagcctggccaacatggcgaaaccccatctctactaaaaacacaaaaattagcagggcatggtagtgcgtgcctgtaatcccagctactcaggaggctgaggcatgagactctcttgagccacggaggcagaggttgcaatgagctgagatcgcaccatcgcactccagagcctgggcaacagagggaaactcttgtcttaaaaaaaaaaaaaaaaaaaaaaaggttggagtagtattggcataatggatcaaatagatcaatagaatagactggagagtccaaaaataaacccatacatctttggtcaattgatatttagaagagtaccaagataattcaaatgtgaaaaatattattttcaacaaatgggtctgggacaactggatatccacatgcaaaagaatgatgttggatctctatcttaccccatatacaaaatctaacttaaaacgaatcaaagatctaaaggtaactagtgaaattataaaatatttataagaaaacattaagtataaatttcttggctttggattagtcaatagtttcttaggtatgacatcaaaagtacgagcagcgaaaaataaataggtatactggacttcatcaaaatgaagcacttttcaaaatgtgcttcaaagaacccaatcaagaaattgaaaaaaacacacaaaatggaagaaaaaatatttgcatgtcatatatctgataagggtctagtatacaaaatatataaagcaatattacaactcaactatttaaaagaataacccaattaaaatacaggcaaaggatttgactaaacatttttctagacatacaaatggtcaatacaaacagatactcagtatcaattgtcattagagaaacacaaatgaaaaccacaatgacatatcatttcacaaccactaatatgactataatttaaaacacagaaataaaaagggttggccaggatgtggaaaatgggaaaccttgcacatcactgatgggaatgtaaaattgtgcagccactggggaaaacagtctggcaattcctcaaaatgttattcatatagttaccagctcatccagcaattctattcctaggtatgtaccaaagagaactgaaaatgagttcacacaaaaacttgtacataaatgttcagagcagcattagtgataatagcaaaaaaaaaaaaaagtggaaacaacccaaatgtctttaattgatgagtgaattaaaaattacagcatattcatacaatataatattattccatcataaaaatggaatgaaataatgatttctgctacacatcatggataaactttgaaaacattacgctaaatgaaagaagctggtcacaaaagctatgttttctatttacagaaatgcccagaataggcaaacctataaagtacagaaagtggattagtggctgctgggggtgagggtaagaaattgaagtgactggtaacgattaaagggtttttttttgaggtgacgaaaatatactagtattagataatgatcatagctgcacaattttgtgaatatattaaaaactactgaattatacaatttaatgtgatgaattttatggtatatgaattacagctcaagtaaaaataaatgacaagcatgtacacatacacagatatatacatatgtcatggacattatgaggtgcttaataaatatttgctgaatggctgaaaagactgagagaaaagtatatggtaacatactccaaaaaggaagtgaaagtaaaaaaaaaaaaaaaaaattgtccatgttagttgtatattggtgacgggatcatgagtggtttctactttctatggtatggtttcctatttcaaattttttaattacttctacaatcagaaaaaatcataatctgtggttaaaatttataaaactagtttataacttctgattatgaccaaaataaggttaatttatatacaaaaagtcttctagaaataataagtcttaaaaataaaaatgcaaatattggacaaaagctccctctggtatatacaaaagtgttagtcttccttacaaaacacccctttatattttgcctcagttccatcatcattaacttattagtcagtctccatccactacaacatgttttaaaatattatcagcatacgtgatttcttagagagatttaattatggatatacctgaagcaaatttaaacctgtgtacatatgtgtactcatatccatagacaacaatacacaaacatctaagtctattcatgcacatagtttccttgtaaattttgtgattatgacgtatttgaaaaaaattgtaattagatatgcttgacattttaaagcaaagaaagatatagatttgacagtttaaccaatttgaaaacccagaagcccatacaaggtatggtatgtcaaattatttccaaatgtataatgctttgccagcaggtcccttgtctttatgggcatattctggctataaatatctcagtgagtataacagtttggacaacggagatcaatataaaacaagcagtggaatttaataggagttgatgtgaaaaaagtggtaggaaagatataaactgaggaatccaggtattcaagaattcaccacagctgaaaattcacaggggaatcaatttgcaataatagaaaaccagcagcaacctaacccactgatctttattacatacaaaagagcactatccattttcaacagggttgttttgagtcataagagcaaatgattcctaaatgtttagcattatttctagagacaggaatgacaccatgttgtcacctctttgaagattcctcatgaacttatacagggttaattgcttcttcttttctgtgaacactcagtctgctagtatgcgcttttatcatcgtatttattaagtctttgcaacggtttccacaccatttgctctagtcaaccaaagcaccttcaagacagacacaagaatttatttagctctagatccacagcactggagcacacagaagttgctaaacaagttgtggctgaacaaataaatgagcagagtatttgtttctgtaatttaaattttgtcctgaatattttttgaagcacactgtttaaattttccatactatgtaattaacaacatcattattaatatattattgtttacattatataaagtatataattatgttatataaaattacatatattatatgtaaaatttatgcataaatattacgtttatatttatgtcaatatataatatataaagtatgtaatatgtttatattatatattttagcaatataaataattatagcatcatgctttggcctagcataaatggtgattctacggatgacaaatatttaatatataagatgtcatttccttgttccatgaccacggcaagcattgttaatcgatcatggcattcttaactggagttagaacgggccttcagaatcctcatcacagtgtcccagggagccgctactgatcaatcaggattggcacaagagttgtgactaaccactattcctgattttctggatactttcagaggaatattttctttggaaacccattaattttcaatatttacaagtacaattaatgaagcacacccattctcctatacatattatcagctttctaaaactctgttataccacttatgtgtcctagaattctgcaatgccatgtgaaataaagttctggcgacacttccagtaacctgtaattaaacactttcaatagtagactattatcagtcttcactatttttaacgaaagggcacagatcctattaaagaaagttactgcttttacttcttatggagagaaagggaaagagaacaaacaaatacttgtggataaggattcttgaactatccctctgctagtaagacctgccaggaatgaaactgctactttggctgggcagagcaggtgctgctgattgattcagtaagtaaggaacctttacatttttttaggtgtaagattatcttcttcctgctgctctgaaacatctgatccacaggccagcacaaagaaagctatgttttttaattgaggaagtaacagacagaacaagaaaggctctatggtacggcatactgagaagacaactacaattaccaccctgcaaagctgggatttgtgagtcctggcagggggcctgcaacaattctggtagtagcacagtcccagaccagtctctcagagcctccaactaatgcagaactgtgtttaggagtctggaaaatccatatattaacagcttgtccacattcctagctggtggtgagaactgagcagtgactctgagagaatgccaatggtagacattaactcaagctggtttctttagaaagtaaaacaaaacctgaaattctttaaaattttatttgttcataaattccatgtcatcaccaagacaaaattctgaatgcaaaatccttttgttattaatttcctaactcaaacagatgttttatgtgaattaaaaaaaaatttcttaaacaattatttcctatttactaactgtggaagcagccattcttcttctacaaggaggatgaatgtagagttgtgatgggctagtggtcaggcagctggaggctggagcagggagacactgagcataggaatgtctgagcaggatgcaaggcagtgaggagagtcggaaacatcagctgctgttattagaatcatggccaatgcatccagttttttcttaattagtttatcatactaagtattaaaaataacaataataacaatagttaatgtttattgagtgagttttgtgctagacactgcgctggacactttatatgctttatcccaattgattctcaaattgaatttaggaagtagatattattacctaaatttatggatcaaaatagcaaggcttaggacaggctaactgacagactcaatgacacactgctaataaccagaggggccagaatcaaacctaagcatacaccatccacgggtaaaatattggagagttaccatattccctccaagggtcttaaagctcagattgaattcaaatttatgtaacagatagaaagggaaaagaaaggaaaaaatgtgaatgttctttcatttgtctcaaagaaagaagaaccctataaatatgccatactcttttttttttttcctagagagtgggccagagtccatttcttaatggttaagaaatgtcatgttaaagaaactatgtatggggttctattcagcatgtctttgctcaactttaggtgtttcaattcatgagagggtttgagagtatataagaaaatggcacagtggcctgtgtcggctaagactgtactttgtcattccagtgcactaatctgtgatatagcagctagaaacttataaaacattcaagcaaagccatgtgctgattcaagtcacggactaggatacagctaagcattttagcctctgttattgaagcaataagtacacaggtgactgaatgatggctatctcagaaggatttcctggaattggtcattcaaatctctactcatttaaaagaaagcacttctttacaggaaaccctggtaggctgaaatggttaagtatgatacccaaaatgaataggtaaggaaataggtaccttgaacatgatttgaggggaatatgaggcttactgttcagaaaagattaaagatctatataatccaagcataaaattaataaaatgaccttttcttttaaattgtggatggaacttccatttgtttcttcaaaagcagacagtatgtgggaaacatcagacaaacccaaattgaaagacgttctataaaatacctaaccagtactcttcaaaaccatcaaggtcatcaaaaacaaggacagcctgagaagtcatcgccgtctaaagaacctaaggagacgtggtgactaaatcccataacgggatcctgggacagaaaaggggcattaggtaaagactaagaaaatccaaatgaagtgtggagtttggttaacattaatgtgctaatgccagtttcttaattttgacaaatttaccatagttatatcagatgttaacaataggggaaactgggtgaaatgtatacaagaactctttgtaagattcctgcaacttttctgtaaatctaaattttcaaaaaaaaaaaattatttagaaaaacaaattacacacacactcacacacaggccagagtgtgcccttacaaatggccacatattaaaagcacattcataagcacttagaacaatgcttgacatatagtgtaaaatagcatatattttttaaaaatacatatatattttaagatatatatatttatataaatgacaatatatattatataaataaaaatgtatatatacatatatatatatattttttttttgagatggagtcgtgctctgtcgcccaggctggagtgtggtggtgcaatctcagctcactgcaacctcctccttccgggttcaagcaattctcctgcctcagcctcccaagtagctgggattatagctgtgcgccaccacacccggctaattttggtatttttagtagagatggagttttgctttatgttggccaggctggtctcgaactcctgacctcaagtgatctacccgcctcagcctcccaaagtgctgagactataggcatgaaccaccgcacctagccttttgaatgaatgaataaatgaatgaattaaatcactttccgtagttaaaaacaaaagtcttcaattgttcctttttatcttaaacctacactcagcctcatttaagatcttccacaagctagccaaacttttttttctacaggtcatcagaacactgcctctgttcgggtcaaagaagtcatctcactgtcccaggattgtggagccctcatttctggcttcgctttgtcatcccttaccccaaagccaaaatgctctcccaaatcattctgcctgttccagattgaattcaagctccccaggccctaagaattgtttcaaaacactcctgtattctcctgaaatcttccttctctgaattcctactgtctacttttttagttcaacatgtatatataaaattgcttatagtggtcaacctaattccttcttatccaagtgtcatttagaatggatttttaggggaggagtgaaaggaactttcatttgctccttcaaaaggaaggggttacaaaagggcactaggaaaatttaggggtgttcagtatgtttcttgatggtgttgtcagttctttttgatagacatatgtcaatcttacgaaaattgtacccatttagtatgtgcaatttaccctgtgtcaatggtagagcaataaacctgctaaacatgtctatgtaattgaatgtttggtttgtttgtgtttttttatttgtttacgacatggtcttgccctgtcgcccaggctagagtgcagtggtaggatcacagttcactgcagcctcaacctcccaagctcaagtgatcctttcacttcagcctcctgagtagctgggactacaggctcacaccatcacgtctggctaatttgtgtattttaatagggatgggggtttgccatgttgcccagcctagaatgtttgttttctaatttattatttatttacacatttatttattataattactgtaagataatagagatttgtgttattttctgaggtttaagccaaaagtaagctccaaacaaatttaatgtttgaactattacatgagtacttgagaaatagtatgagtattctctgattttaagtagtttgagatatatattttagctcattaatctactaaaaactgaaaaactgtctctcactgtgattgtatcctggtaacttcaaagtgattgcagttttagaaaatgaacacattagatcactgcttacggtataatgccaattatatgtcatggagtagtcattttatctggcttttcacagaaacctaaataaacttaacctaaacccttcaaccactttccaattactgtcccactcccagcctccagcctggctctttcatctggagacagtgacatgacttgtgtggctgtactgtaccaagttacttatgattttccaaaaattgactatatctttactgaacatttctccttgaccagcacctgcagcatcaaccttggctatggagaactggtgcataagagaccacaacctcagaatgaaggtggcacaggctccagctgcaggctatctactagtctcagtctccttggccagctttctatccacgtccatcccgcattcagaagccccctttcttttcctccactgctgacttgtgttcttttgcaatttttactccttttgttttaacttgtcctgctggctatgatgctgcttcatcaaacaccaaatcagctccaccttcttgccctcctttaccatacttacctcccatattagacatgtttattaatttgcttgctttctctcatgccctgcacaatctcttccactcaaatcattaacaatgatactttcaatttctgattttgccttaccaaacactctacttcttcatattcagcttccctttatacccagcacatagtaatattgtcctgctatgcaatatagtggaaaaagtctcgtaattggaaaccagagtctgtttgagtcatggttctgtcactgactcaaccatgactagttatattatctggaataactcactaaacctcactaagatccagtttcctcatatttcaaatggcattgtgagagttacataaaaatgatgcaggtaaaatacaaactacaaaatgctacatggatgcaagatattgcaaacaggcaatgtgtatttattcccaatacaggtgtatgtctttgagctctttgaaaaattaagtaaagtattccatttctgaaagtaaaagctataaaacctttctaaaagtctcacagtaacttggtagacataaaagtggagaaagaaattgcctttctgaatactagagctttgtaagagatgaaaccgagatgatataaaacacaggctgacttcaaaatggagaagtgggtaaaattgaggtactaatcaaaatgtttgaagcctgtcatccttataagaataatgccatgcttaagagccatgtgttcaacatctgcaaagcaaaagcaaatgaaaaattctattagcttgtaccagaaatgtgaacactcagctgaaactaacactattgtgaggggtataattcaaaggaatatcaagatggaaatgatgagtgaggagaaaaggtaaaaattattacataaacacaatttattttggaaaagcacgtgagcatatgcaaggcagcaaaatctagactatctcctggtaactgaatagcagactcagcatagggtttcagaagaaaaatcagaagccagactaaaccaaactagttttttctgtgaaatctttcctaattcccctaggccaacttaagtactttattctttatgctccaattgccccttgcacttacctccatggtaactattaccacaatgtattataaccatctgtgtacgtggcaatttcccttaaactgttctacttgaaaagcagaaaccattcttttttcctttgcttccccagtgcccagtatgttgcttgccacgtggttattaagaaattgttggtaaatgatgaaggaaccacattttggccaatggtatatctaatgatgaatatcagcttcttctgaggacagcaaataaagatacacttattttaaaacgcttaagtgttagtgtattgcttatggaaacagcttcatcattttattaaaacccaactattttttactgcactattccagacaaattattagggacctaccacttggagagtcatagtctgcccaagataattcacaagattgatttctgattctagtgaaaccagagttacagggtcagcccccatacaggtcagacagagcagccacagagggcttgccagattgcatactatgactgcacagctgtatggaggtgccattcacgtagagtaaatgtgaagaggcatgtaatgcaatacacacaacccacatgacagccaggtagcttgttgacaaaataaacctgcctattttgcatccaaagtatttatctgtgttccctcagtaattccacaaaggtgtgtctttgcttaaacaataaaggaaggatatccttgggccactccatgtcaatagctagaaaaaatgtctctggtacaacaccttgtaaactccctttatggaaagcaagttctaagggctgttaatagatactccagtaaaagtggttcagggccaaatgagtcagaggaacacaggaataaagtttaactctttctttcatgtaggatatcttagaatttgtaatatgcgaatacattaatctataaaagacattataggctgggtgcggtggctcatacctgtaatgccagcactttgggaggctgaggtgggcagatcactttaggtcaggagtgagaccagcctgaccaacatggcaaaaccccatctctctttactaaaagtacaaaaattagccggccatggtggcacacacctgtaatcccagctactgtggaggctgaggcacaagaattgcttaaacccgggaggcagaggttgcagggagccaaggtcacaccactgcacttcagcctgggtgatggagtgagactctgtctcaaaaaaaaaaaagacattatattatacagtgtttctcaaatatattttacctctaaacactttttcaattaacattttggaaaaaaaaaaaaaaggactagtgcaatttcatgaaccacactttgggaaacactgccttagactacagcacccattcctattagccttacaccaccacctactgatcagaaactatgaggataggccagggaggtgtatttttaacaagctccccaggggatttgttgttgttgttgttgttgttgttgttgagacggagtctagctctgtcccccaggctggagtgcagtggtgcgatctcggctccctgcaagctccgcctcccgggttcacgccattctcctgcctcagcctccagagtagctgggaccacaggcgccctcccacaggggatttttatgtgaccaaatgggcactactagtggacccaagtttggaaaccactctatgtgttaacctcatgtctcaccactaaagatttccattctcaaaggttaagtttctctggcttatatttcacagacctcaaaatctctcatgtctataagcaggtatgcaagatagaaaaacagcctgatttctaataccagattaatacttttgtagtttctgatttacgatactgttagcaaagcttctcacttgttgaatctagaatttaaatatgtgtaccaataaggattaaaacagtattaagatatttaaaatgcaaacaaatacctgaaggtttttctttcctagagttttcttacaggagcactcatagaatcttagaagattagaattgaaagaagtaccgacagaggttaagttatttacctgtagtcccagagctcattactagcaaaactggggtttaaattcagagctcccactctgcttctactcgtgctccttcttcagcataaaccaatgcagcatggagaattctattctaaacacctcaacccctcacaactactaatttctctttttttttttgtttttcctttttgagacggagtctagctctgttgcccaggctggagtgcagtggtgcgatctcggctcaccgcaagctccgcctcctgggttcccgccattctcctgcctcagcctcccgagtagctgggactacaggcgcccgccatcacgcccggctaattttttgtatttttagtagagacagggtttcaccgtgttagccaggatggtctctatctcctgacctcgtgatccgcctgcctcggcctcccaaagtgctgggattacaggcgtgagccaccgcgcctggcctactaatttcttctttaagcaacctttatgtcctcaaaaagtcataaaaaagggaaaaaaaagaatttttgttttatatgtttttaaatgacagctttaaagacagttacctgaaaatgaaacaaagaatgattccaaagctttactcccatgaaatagcctcttcaatactcccctgatccaatgcatcaccatcatcctctttcacctggactactacaataatcaatcttatgtccttccaaataagtctctaatctgcaggaaaaacaatggtctttttaaaatgaaaacctgatcatgttattttatttctttaaactccccagtgattctctgatgctctttggatccataagcagtaaggcctttgtaagcttgtgatccttcaatcccatttctggcccatcttcccttgtgtgccaggcttcactcgttctgacttttcaaatttcttaattgtgctatgctttttcccatctcaagactttaccatacgcttgctctctgtctagaacatttcctatgcccaatccaagctttcactccactaacttttaatccacccttacctctcaggtttgaaatcttttctgggatgctttctctggctttcattactgagctgtctctctaccagttggcacttcaattgtttactggtttgattcctctcctagactataagcaccatgaaagcagcggatattttactagacagtaaatcctcagcctacctagcacacagtagcaattcaataaagagttgtgcagagaagaaacaaaaaaaaggggaaggagcatgagatgcaggaaagcagaggagagaggaaagggaaagagggaagaagggagagaagcatgaaaacaatccactatttttccagcacaatgtctttaatatgatgaattctcttttatctgatatcttcagggatgagatattctgattaattcattcaatttaagacatagttcaagctttcaaaaactaatgaggataaggcaagcagattaaagaagacaaggaattcaattgtatggaatatagagcaaatcctttatcaacaaatagcataaggaaaggaatgaatttggtcaggtgctctgaaacactgaacaaaatacctacgtacacagccactcatcctgaaaaacccagcacattctaacacccagaagcactgcaaaccactaagtaattcactgctcaattaaagttcatatcaaagacataatatttctataagttgggaagaaactacactcattttggcagaaaaaatgactctatagttttgatgataaattgttattcttacaaagagaggtctgagaccctgtatatatctataagcagtagacagggccttaatttttgaaagtctcatgtagatatctaagatcacgcactgtaaaagcacacacagctcaatttatctgtcttagaaggaaagtgagccagatggaccctgctgggatttgtacctgaaagttacgggaaaatttgaagttccggaaaaagttcttaaggcacaccagttaagaaaaataagttgaaaaatatattgtttttgaggaggccatttactaagccaacaaaattaaattaatgccacaatcactgagaaaataaaaagatatacacgttataattttagttctcaattattctcctgtaatcagtttgtcttcctactagttgtggatatatcaattttcaaaaaaaaaaaaggaagaagaaaaggtttttttatgacccaactcaaagtcacagattcttctagctagtagcaatccagaaataactcagcctaaacttctcattttaaaggtcagaaaaactgaagctaagagacattaaatgaccctagcaaggtgacaccgtgagacattggcagagtgaggaccagagctctaatcccctaactcagtagctagatttctgagcactagatcactggaggaagcagccatatttttctattcagaaattttttttcttcaaagcaaatgcatcacattctatttgagcttgtagacacctaaaaaccccagatggtctcatatcaacttcctccaaggcagttcacccccttcctgaatttgtgcgatagattatttttactctaaaagaagaattttatttatatccatgttatattttatcttggtgctttcagatcattgtttctgccttttaagatcaaattgaattttggatctgccattcatgttgctaggtagtcctctgaggtctgaatcattgaagaatctaaagagcatgacttgtgtgtcttcattcaggtcacagtgaggacactgaatagggagagcagagctgctgctagccagtctgccaggaggcttaatgcatgaatcaagacctacttcattgactgttcagtaggcattgaatccacctaaagattttttcatccaatccacatttttctatcttgtttatatctctataataagcataattgcactgactacgtgcaaatccttatagaataagcatttaaaaacaaaatattacatttctaggaggttttttagttgacaaagtattttatgcacattatttcatctgaaactcagagaaagtaaacaagtcagggtttattatttctgttttgtagattaggaaactaagtttcagagaagttcattgacttactcaccatcaacaagctaatacgtattgaagtagtgtgttcctagacacttgctccaacacttttatgttatttcatctggatagtgtaggtagctgtcaaatacatgactgagatgagtttcagtactgtactacaaaatctcaagtgaactacatatccaattttctgaacaccaagagagcccaacagggagagaaaggctcctcttccatgtgttttctcaagatggactaataggatttcacgaatcctgtttcaagtattgtaaacacacacacacaccagcttgctatttttctattttgaatacctaagaagcttttacccatcccgccctttgtcccagtaagtaggcctttactgtcaagaaaaagagcctagttgtcttgccaaaatgttattgggaaggtaccttatcaaagaccaacaatagggtgtattgttcccatgttctttcaatgacacactcagctccttggtatgtctccctggttcctagatagagaatgccaatacaggttttaagggctgcagccaatcccccacttttcctgccttctacagttgagctaatagccagcttttgtacctattatgtgtactcacatacaattgtcaggttagctattaagtagataatcagatgctgttttgagtgttggctttcacagatctataaaagacaccctgctacacacatacatgtgcaagatattacgtcctaagggtccactgtgtatcctgactgtgctgagtattacaaggggcattaacaataacacttcacagttacacaggattttagaattgacaaaatactttcatagatatcattgtgatcctcacaatagttatatgaaataaacagtacagatgccatcatttccattttatagatgagaaaagtgagatacagcaaattcagtgacctacccaaggttacacaactattgagtcactgagtggtcttaatctaaaatctctgcaatccaatttagcggagaacacaagttatttgaagatatgactttaagaaatgaaacagtcaacagcatgaaccactcatattcaaatgctgcattctaagcgttcatgaaaaaagttgtagatttcccgattgagctcaacaaggcatgcaaggcctgctagagctctcgtgaaaatcttttaaatcttttcaccctagaccacagttcaaaccactaaacactttaaactgtgcttttcatgcactagaaagagctcttattctgttgtggagagtacaataagacaaagatgcaactcaggtgcattaagttatcctattcaaagaaaataagtaaattctattcaaagaaaaggggaaacaccctgttcaacctggtgaattatctgatggcagttaaaggtatgaatcataaggccatagacactgcagtgaggaagcatctgagtttcatctgacacaatagcaaagtactaagcctgtaaaaacttagtaagacaaggaagacaaatgacaaagtgcagtatgactctgaataatttcttgacagtaaatggagggctcagcagtttcctgcacattaaaaatcatgccctatatgatgtgacctgtaccctccttaaagaaaaattacagtcaagataaatgtaataagagagaacaaaaagctgagaagctgaattcacaccaaagcagataattcaaaagatgttctagagcaatgtcttcaagggtggcgcctggaccagcagcatgatcatcacctgggaacttgtttagaaatgcaaattctcaggccccagtcagacccaaggaatgggaaactttaggcctggggcccagcaatcaatagtttagcaaaccctctaggggattctgactcttaggccagctaaaaatatagtagtcctgttatcatatttactgatatcacttgccctttggcagtgccttcagatgaagaaagttaatactggatgatgaatggtgtgtttccatctgctatgaaccctggaagtgatacttttgacacacccccaccaccacccactgtgggtgctataattagcaatctgtggaggaagtatctctgaaagcttaataagtacaatgggacaggtatgaggtaattaatcattcaattatggtcatgatacagttaattaaacatagtttctcctccctcaatcacctagctctttcttagagcagtgattatcatattttagcatacatcaaattcacctaggagggagggcttgttaaaggggaatcctgagacccaccccaagagggtgatttagtaggctagcgggtggggccagataatttgcatttctaacaagctcctaggtgatgctgatactgctgatctaaggaccacattttgacaacacctgtactagagaaaaaaaaaacaattaaattaattttttaggtactggaccactggtgtgctggtgaatgtttaataactggctttccaggaagaaaacaaaaagtagtcaatgatttgtagcatttgccaattctgtagcaaatatttcaaccatgatctatattaagctacaacatgatgtcactgagctgagagttaggtagaggtgtacacagtccatgtttgctagccagctccagtgcagctctgtagccactccacatttctctggacttgatacgtgcaaaacctgcagcatcacactgtttaaattccacagtcccctgaaagtaggaatttgctgagtcaaacagatgccccatcttaattctgcttccttgtttggtgagtcactgactctttagcaggagagtcatgtgaagatccatttctcacaataaaactcatagtaaatttccccaaatggagctccattatcctgagtatccaacactcagaacttgatttgggaatggtttcggcagcagactgtccactagaaaacgggataccataaaagtaaatggcaaaatataaaagctgtattaccaggcgagtcctgcagtggggctcctaaagtaaaatataagtgattccatctgaggaagagttcagatatcaaatgtgacaaacccactatgtggcatgtagcgaataacccagttcctttttaaatatggaatgcatgctcttagagtgaaacactcagaaattttaaataagttccaataagaaaagatgaaaggaaaaaaacagattcctctttcctttccatttgaacctctactaaactattctgcataaaattctatgtattctgtaaaaacttctgtgttgcctcggtgaaatcatgacatcttccttacccccacgtatcatttttttaatgcaattaatgctgccacaactggccaatcatccagtcttgtcagaaattctggtcagaatccttactcatacactggataactagcctttgaataatcaaaaggtgactgtaaaagtgaaatctgcttcaggtcttacttgctttgtgaaggtaaaaaaattcctgatcaatgtgcagagaaaaaaaaagtggatcagcaaaacagttgcctttaagacattctcttgccttaaatttacttatcaagagagtctccttaccttgaatcccagccagtattattatcgaataagcaacatcagaaagtttcaccactacgaacaacagaataaccatcacaagccttttggcaaaagataatgtgacactccatttgaacaacaattttctctacatactaattaaagtagttactgttgacccacattttcatctggtactaggggacaaagataacatgtccatgtatcgtttaccagcaccagatttcccaagctttcagccagccctttcaccaacttgccatcaccaagcagtgaccccttcctgaagagcttaacctacagagagttcacttggagtcattcagcacagctccgtaattccacacttgagaagtctctcttgttgttggaccacagccagaacaaaattaaagcatttcctattcaattttggcaactgcaaggacccactcacttaaagcttgataacagtgagttgattcaattgccattcaagaagaagcagttttgcaaaatgggtttcctgtcagcagcccacattaagcttccatttgttctgcctctctctttctctccttttccaaagatttaggaaaaggtatgtcccaagaacttagcttttttggtggtcccactgaggacatatagtaaccgaattccaagatatatattattatatgccatgtacataccattgcacagtcatcaaggactataaatatccctaattctctgccgccacttgtccatgtctctgtctacagattcttccatattcatagctttcaaacccacctgagttcctcctttctctcatttcaaaccccagtgacggtacaggtctaaatctgaagagtcttcattattcgtcttctccctcattcactgcatcacctagggcaataaggcatttttcaaaagaaactatcaagcaaataaggcctgagtggtttgtttatgattctaggataaaactcaaaagttgcagtcttttgtgatgcatgatttaatagaataggaagcaggccaagaaccacagactagggagagggagtgagaccattaatcaattacagaggagcactcacaacagtggatatcatagaaagccatgttttccacagttcagaacacactgaggtaatgttagatgattcatgtataaacaattttgcttcagtaattatgtgtttagaacctacaacaataataaatgttatctattattagtactactgttacattattttgtcttctagaagctaattctttaagaaaactattagtgctttgatgataaataggttttaatgtacttgacaattctgaaagataaatagtggatgcctgaagagctatgttggggaagatggtgaagccacgtctaaattcagcaaataaataaataaataaaatgccttcatcagttagagataactatcataggcttggacagcatatgtataatacatttgcccacctgcccccaggactagcctttacggttctctaggagaggaaatgtgctgagctgctgtgttttacactgctgtattatcaattcctggtgcatagaacctacttaatacatttttgttacattgaatgcattgatgtagaagcactaagacttcgctgaataaacactgagcaaaatgcaagtctgtattctggaaccagcaggaaaaagtaactaatctattacctcagactaatcactgaactatttcaggctggtgcttataagaagttggacaggatgatctctaagtccttgggtagccccaaagcctatcactatttcattctcccttctgtttctctttggcgaagacttttgtaccctatgttatcgatgtatgccaatacattcatacttataaaaaaaaaaacagaatcaagagtaagttctgaaagaacagagaagtttgatatttaaaatagttgaaagttgtgaaagtatcaaatagaatggtctgtgataatgccaaagggccacagaaggttttaaatgagtggctgaaccttggtttgctttttagagctgagcctttcaaatctgattctctttattctgtgacatttgtcagtgaccactgctgattacctacttgatgatgtttgagctatgggtttatactggtgattggaaaggagagaaggggtagctgtcagaaatgtgaccaaagaaagatcataacctagaaaatgaaaaacaggatggcaaaaattctagttcttagctgacatatgacatgaatatgagtaccttacagagaaggcataaaagtatacagaattactaaccatgcaacctagtgaaatacaatccaataaatctcttatcaaagcaaaaagacacaaaaacttcataataataaaaatttttatctgttctatctagtctggaatccaaaatagtacttaatgtccccagaaaattatacatagacaactcttccatgatattcacacagcaaaaagtgtgaaatgtgaaagcacttaggatgaatattcagatgtcaatctcctaatatcctcaaacatctcagaaaagaacattcggaaaaacacaaactggaaaatcaaaataaagagacatatggacagaaaaagagaacaaattataacaggcagatataatccacatataaataaacacaagatcatgtttttctgtcttaataatttatacactttactccttagtgaaatccaggacttttgatgatatcagctctaaccaggaatctacactgcccattcatagttgtctgtgaaatttagatgtttgaagtatctgatttggggtggtaggtcttcacccattaattagctctggtaatgaaaatccctcaagttatctgaatttgaaagattttatgtggcttcaaaaactaatcccgaataggccaggtgatgcccacttgagaagctaaggagaattacttaaaacacattctggctgcaatattattgttcatgctgaaatgcaagaagccctcactgcccaacaaggggcaaatgatcccagatcagagtagactgactgaattagatggaatattttttcaactgttatttccttcacattatggataatgtcaggcagactctggcttacccttaacttaaggacttagatcctgcatttcttcttccaagaagccatctctctctctctctctctctctctctctctctctctctctctctctctcacacacacacacacacacacacacacacacacacacacccctcggtataggttggaagtccttcctcagtactgcatttacaccctttgcaaacctgtatcatatcacctatattttatttgctttgtattctcagcacctgatgtacctgaaactttgtaaaatcagagaaacaaaatgaaacctagtcaaggttggatgagtgaaagaagtcttgaaagtgatgtgtcatatcttttgcagaataacagtaccctattttcattcaatacatgaattcgaaattctaatttatttgctttcaatgtagaatttcccaaggtctgtatatcaaaataatagtcaaggctgttctcttttttaaaacttaagatacatcttcaatttcatatttgttctctctctctctctgtcctattttgttgcttgtttgtttccacaaaggacagaattaagacttatgaatagccaaagagaagcatggcttagcccgtgactaaccataggaactatagagtaaatcaatttcttcctcatctgtaaaatgagatgattagaataactgatctgaaaggaaggtttctttctaattttgtcattctacaatcatgtatgttacctgttctatgatatatattcaggaaaccacattaatttgaactatactgatttggaatgggtcagaatgttgactgagataatcaaacttatgttagattgctttttttccttgttttccctattaaaagaagagaagcatgaataaataaattaaccacataatgaaaaaggttgagggcacctctactctcctaagaatgcaaactggtctttaagtgctttagaagtgtctatttacttacaaacggtgtaactgcagtatatgtagggttgatactgtttaaagtattttgatgagctaattagagatcatccttatctattaattaaaactccactacacagtgtctgaggagttataatagttgcagtttttatatattcttaaagggattaaaactaaaacaagtattcatcaatttaattagctttccttccaattcattcaaatggatgattgacaatgcttatgttaaatgaacttattttggaaaaagtagctgcattaaataaattataagaatgttgatatattggtcattggtttcaaatgtcaagattacaataaaaatagcattaggtagtcaacccttatttcccagagtagagggatggctcagcaaaacagggggacttatgaattaagtctgtctatgcaaccattcatagaagtattttgttgaatcaaagcattctctatgtaatgagtgaataaagcatttcaaatcaataatcatgcactaagggctaacaagtgctaggttcataaatgggctagtataatgtatgggtaatacattttttgaaaacacaattaagcacttacacaaacaaatataaagtatactaacaactgccataaaatggatatgaaaaaatgatttatgagggtcaaaggtaggaaagactatacctctgtggcaggaaagaatttcccatgtgctactttttttcttttttcctgatacagggtctcactctgtcactaaggctggagtgcagaggctgctcactgcagcctcaacttcttggctcaagcaatcctcccaactcagtttcccaagtagttgggaccacagcacgcacaccaaacctggctaaattcgtttttctttttttctttttttttggagagatgcagtctctctatgttgcccaggctggtcttgaacctcagggctcaagcaatcctcctgcctcagcctcccaaagtgctgggattacaggtgtaagacatcatgcccagctgctactttcttaatctacacatcaacctttcaaataatatattagtattgtaatggaatatatagacacaatcagatgaaaagaattactacaaaaaggaaaaacaacgaaaggcaggaataagaaataggcatgaagaatcaggaagaaaccaatctgaaagattaactgcctcgtattgagaagtagaagagaacagaatcacatgatgaatcaatgccagtaacccaagaggaaagtaagatggggaaaattaaaattcgctgaaatctaaactggtcagtgtggttatgtagccacaaagcaagtagagaagaacttaattggttttgctgactaagggctgcaggtgggcatggtgatacataaatatatgaagtgatgtgtgattaatgaggaaggggtggtttgtaggcctaactggcagtttgaaatgtagtaggatcactgttgtgattttattctaagtataatttttgcattatagctaagggcatcagaaatttgggaaattgttatattcagggttaactcttcagaaacctagaagggaaagagaagatgacccttccatgaaagggatgaaaacactgaggttgaagagactgaattatggctccctgagcactgcctgccctaagagattttgatatggctgactcaaaccaggaagcgcttggctaaaataaggtgcaccaaaacaagacctcatgaaagaggggctagtcaaatccagagcaaagagtcacttagtgtacaggtacttctctcccagactaaacagaccaaaaggattttccagaactctctcccctagacagagacagaggttggaaaatcaataccctgtgtaagcaaaaggacgtggatgtagattggcagagaaacagaaagcaaggaatacaatacagtagctcatgaagggattgaaagagggtccaaaacctgacatcttcactttataaatgagaaaaccaagctcaggggggtttacgggctcacgatcacaggggatcagtagttcttaggattcaatcccagacccctgtcactccaaaggcaaactgcatatttctttaacaagcaggcaaagtttgagatgaacaactggaaagcatttgcatatgtgtaaaggcatccaggtataagaatcaggagcaaaagatgggacagaaaatgtgagatgtgcctgataaacaccaggggtgcactgtactttgtgaatcatcactcaaacagatgatgagattaagctatgaaatggatttctttgatgggaaagagcagacttctgaggatgtgcagaaagaatgtgaccataagggaatagaaagtcatctaggaaagagacaacagaggaacttgacagagtagggaaagcatcttgatgaggcagaatcacaaaaaccaaaggagaagagaatttgggcatgtttttcaaatgcctaacttcagaatcagaaattacttactaacagagaaggacatgacccttttatttctcattcttttcaaccatccgggtcttcaggcaatttttttcattcctttctcatttcatgaattgtttttggaacgttgatttggtgagaaagggagtgcagtatttatcagcattttcattcagaaacagaacctaaaatattctatattcactaacggaagatgaagagtaaccagtttcttttatttctttgtttgacaaataattgatgcccaatagggcatttattggagaacaataatatctctattatagctataaatgtctggatccagagagccctgttttgcctcttgtcggaaaataccaagcttgtatagctggctagtaatatttccaagtactactgtttgaatttaggcataaattcttctaattagattagatttcttctaaataagaatttactgtgtacccttagattgcactgtttaaaagaattaggcactttcttaaatccgaatgactactcttgttctttttgagtagtttatggtttttccaaataatattcattaggcagttcaattacagggtatgttctattccttggttattcttagtcaatacctgagtgaaagtagtgtatccttttcatgtttctgtttagcattagtcattatttgctaacagagtagcctattgattggtgagacttgtaaaattaatggctgggaaaacaacttaacctcatggcattctatgaaatccccagagttccttggaccttgcttgcaaattactgtctttatgtcactggtttttacatacatgtaatatttcttgtttaaatcttgggaatttggctcatgtaaaggctcttcttcactcagtgattagctagtcctttgtggaatcttcagaaagatttatattaaggagtcagtcagtaatctaagagttatgaaaaaatagtttcatgaatcaaaccatgtgtgtcagtgagaatattttcatgctgtttcttttcattacattacatgacagagttgatgatttacaatgcaatagccccctctctggtagtagaacagggactaaattgatattctctcacaaacacttgtttgcaatatttgtttaaagataaccccctactatggccctaactttttgaatggttaagtgtccttccttctaattgatatatttcatttataataaacctggtttcaaataggaagaacatgttgggtggtatagaaaggggtggaatgagaacaagtaaaggtataagataatatttacatttattttgtaggaccacaaaccatgcaagtctaaagatcacaaacaatttgtaaggaagaatacaaattataccaacaatagagaacacactttctttaggaaataagacatgaaagaggctttgagaaatgggtagactttgcactgacatggagaaataaaggatggcatactaggcaatgagaagaaagaaagaacaaaggtatgcactgaatataacctgaatcgacatttctccacagaagacataaacgtgaccaacaggtacatgaaaggggctgaacatcactagtcatcagggaaatgcacagcagatatcacctcacacctgttagaatggctattgtcaaaaaggcaaaagataccaagtgttggcaaagatatggtaatggactaaaactgatacataaaaatgtgatatataggctgggtgcggtggctcacgcccgtaatcccagcactttgggaggccgaggcaggtggatcacctgaggtcgggagttcgagaccagcctgaccaacatggagaaaccccatctctactaaaaatacaaaattagcctggcgtggtgacaggcgcctgtaatcccagctactcaggaggctgaggcaggagaatcgcttgaacccgggagggagaggttgcggtgagccgagatcgcgccattgcactccagcctgggtaacaacagcaaaactctgtctcaaaaaaaaaaaaaaaaaaaaaaaaaactaaaaaggtgagatatatatacatacacacacacacacacacacacacacatatatatgtatgtatataggtgtacacacacaataaaatattattcaaccttaggaaaggaaatcctggctgtaagcggtggctcacgtcagtaatcccagcactttgggaggccgaagctggcagattacttgagctcagaagtttgtgaccagcctggccaacatggtgaaaccctgtctctactaaaaatacacaaatttagccgggcatggtggcatgtgcctatagtcccagctactcgggaggtcaaggcaagagaatcgcttgaacccgggaggcggaggttgcagggagccgagattgtgccactgcactccagcctgggtgacagagcgagactctgtctcaaaaaaaagggaaatcctgccttttgcaacagagatgaacctggcggacattatgctaaatgaaataaaccagacccagaaacacaaatattgcatgatctcacttatacgtaaaatctaaaaagtcaaactcatagaagcagagtatagtgatggttgccaggggctaagggatgggggaaataaatgtacagttgcttatcaatgggcataaagtttcaattaagcaagataaataagttttggagatctaatgtatagcgtggtgactatagttaataataacatattgtatacttgaaatttgctaagagaacagattgtaaatgttctcaccacacacacacacacacacacacacacacaaaatgaggggatagatatgtttgattgtacaatcatttcacaatatatacatatatcaaaacatcacattatataccatatgtgtgtgtgtgtgtgtatatatatatacacaaatttcatttgtcagttatacctcagtatagctatgaaaaaaaagaaataaatttgttttcaagtgttaatactgtgactctctttttaggaatggatttctggaattttaccttgtagcttcctccaatccaaccttcagtagcctgtcagtctcaaatcaggtcatagccatttgtagtatctgtcctgaggtgataccaggaatattataaatccagttacagagccagggagtggctttgttgtagtcctggtctgaaatccctattggtaagttttcttctctcagagctagcagtttacaataagcagtagtccccactcagctttcaaaatcatgttttcccccattcacaaacaacagattcttacagcagcttttgactttgaatagtgagcttgaatctagtggtccatcttgcatgaaatattttaattccctacatccacaagggagccagtttctaggctgcttgcagaagtgtgccccactagttgatgactttggtcttgcctgacattttatgtttatgttctatttcaagtccatagagatgttatttcatttttgaaagcagcaatgagtttttgtgttttctttttatatgactctattttctatatttgaaacacagcattcttgtcatggtgtgaacttactctgccacattgtctggaagtcttttcagggctatatctatcattccaaattgacaggaagccagaaataaaattatacagaaaacatggtgaccaactatattttgaatatatagagagaatatcttaatttatgtcagtcaactaaatactcaatgaccatctactatcttgaggtatataaatgctaaaagtatagcctttgtagccaaaccgtttgcatttgaatggtagttttgttgtttgatcttttgagttcctttgaattgctttacccaagtgcttcaattcctcatcattaaaataatactcatctcagaagttggctgtgaagaatatattaggatatgtgaaatccttatagtaatgctgggtctaataacaaatatatttaaaattttcttatttatttaccttagtgcaaaatggtaccagattctgtaggagatataaaaagtgctcagtacatatgtcctgcatgtataaattttattttgagttggtaagggtataaatgtaaaacaattagagaataataaagccattatgtcacacttttccacatactattttatcaattctaaaatgtattaggaattaatagataatgtaatttattgaaaactgagatagctgagaataaatgtcttagagagagacttgaggtatgttataatagatgagatagatggagagaaaacccaggtaaggaggcaacacaagctgagattaggggaggaaacgagagtgatgtgtaggatgaacatgctatatgtggagaagaacatggcagaggatctggatggtaaaaatgagagaaacagcagcggattatcatggatgagattagggtagatatatttaaaagccaaatgaaagagtttagacttaggtgaatgattttcaatagggaactgtggttcttctttggggtaataacaaaatggaaatcatatataggcaagattttttgagatagttacacataatttaatgagccaaaaacctaattttatgcccaggcaagttcaagtttgcctataagcatcttttaatttgaaacaggaatgatctagtcaggctctgtacacggttttagtgatatgagacagagggcgctggatcctcccacttgtctgacagtgaagggcacattcccattgtttcttatgttcacttgtgaaaaatgagaaatacagaatcagagacatgacctaatttaaagtccactttgcattattaccaatggaaatatcccaaactctcccagtggcccttaaatattgttttaaaaatgctgctgtgaaaacaaacaccaaattcttgcagataaaatatatttcaccttatgagcttatacagaattcacatcaggctaataaaatagaacatgttgacattgttaaagttaatgtacagtaatttagtacttgctgaagatacatttgaaatttaacatatcagaacagtaggtaggttgaaacaccttggacaccaaatagatattttcgtgtgtccttgaggagtatctatgctgcaatattaattctggaaaaccaccaaatgtaactataatgacaacagtgctgttagagttccacagaattattttcaggttttctttcataattgaatcatattttattattaccctaagatacttagattgcacaactgtgcataaaatcccctgccagaaaattgaggaaagaatgaacgaattagaaggaaataatgaagccatccccagattccagatggatacaaaactaatttcatctttaaggtcctgccatctgttctttttatttattttagcattacacatttacataccttcaagtgaagaagtcaaaaagcagacgcatttgtaatggaacacctcatttaaggggagaaaaggtcaaaaaccgtaatttcttttgtaatgctttggtggagtctagttgtttgttcaagatatgcaaatttttccagtaactgagaaataatcaggctgacaagccatcaggaaatagtaaattaggaaaagcaataaaattgtagcaaatcctataatatggtagtcaaatcgttaatgtgcttttaaattttttcttgttgttcccttatgtttgtttcctttttggtaaatttgaataaggtgtcaaaaattttcaagctggtatagtagattgaatagtgtgccccaaaattcatgtcaacctggaacattagaatgtgactttattcagaaatagtgtgttgtagctttaatcaatcaaagtaagaatctagatgaggtcatactggattggagtgggtcctaaatccagtgactagtttactcataagcagaggagaggaaacagagagacatacagaaacagagaataaggccatgtaaagtcggaggcagagccggaagccaccagaagctagggagggtcaaggaagaattctttcctagaactgtcagaagaagcatggtcctacagataccttaatttcagacttccggcctccaaactcagaggaaaagatagctgttgtcttaagccaccaagcttgtagtactttgttactacagccctaggaaactaatatgactgctaagatttattgaatgtagattttgaaatcttttgaaagcttaaattttttactttcaacattcttacatagccatgagtaaaagctgtgtatggaaatttgaagatatgagagcatgtttttttgcactgagtaatataaatcaaaccagacacatggggaaagtcaatgtaaaaatttacacatgatccgcattcctaaactatgcaaaatgcatttagctactattctaactaaagagttaatcaagaaataaagaagaaaaacaacaatataggggaagaaatgttgtccaaagttatttttaaaagaataaataaaaacgaaaaatctggtaagatcctctcctgtttccctgttgttttaaatctttatcttatttcacagagtatcagttttgaatctgaaatttaatgaagataagcaatatctgatagcatgtttatacttgcattcctaactgctacgtgcctatgggacacataagattgtgaaggtggggagagacacgtatagaattaacagctttcattttactcttcaaatttaagagttggagagtttttcttttttaaaaaatctaaattttaatgaacccttttatagggcaaaaagctttgctattctatatgccttaatcatgctaggatgtgttttgttaaccaatgcatagtgttgtgtggcctcagatttaggagtatgcttgtgtgtggtagtgtatcctatatgatttttttatttgatcagtttcttaataccattgtattttgactactattcttaaataataagacaaccattttttttcaagctgggtagagtatgtgaaatataagaaagcacacttaattaaaataaaagctgaaaattaaaatcttatcaagcttgccttattttaaggagctcagaccattgcaaaaataaatcttgctttctcatttagtttcaggtgaccaagtctctgaatccaacagttctatcttctgcctccaaatgtagcatgatatttccttcagattaatgaacagaaatacattgccattgtagcaacaatcaatcagttaaatcacactttctaaggccatttcagggattttaaattatttttctaaactattataccctgttttcatcatcaccctctctaccaaaaactttgcatgacatttaatgccctgtgaaagaaagtccagactcctctcaccctggcaaagacaaccttcactgataacctggcttggaagatcctttctgatttcctctcctactattattgcctatctgagccctcctctctgtgaagttaggctcatccattcactgttccccaaacactttatgagcatcctttcttctgagattttcttcactcatctcaccagaaatgcccatcactctttgaatgcatccatatccacctaccttgaagccttccttctgcttcctttgaaatcacagctgttactacttggcccagtaatctggcattcaaccacataggactcacaaacctgaaaaacgctgttttttaaaattgtcaagtgatatagatagatatttggatatttgtcccctcccaaatctcatgtcgaattataatctccagtatcggaggtggggcctggtgggatgtggttggatcaggggggtggtttctcctgaatggtttagcaccatccgcgtggtgctctactcatgatagtgagttctcatgagatctggctgtttaagtgtgtggcatccccacccacctctctctttctctcacatacacacacacacacacacacacacacacacacacacacgccatgtgatatgccagcttcccctttgccttctgtcatgattgtaatcttcccatggccttaccagaagctgagcagatgtccagtgccatgtttcccgtacagcctgcagaactatgagccagttaaacctcttttctttataaattacccagtctccgttattttttatagcagtgcaagaacgtactaatacaccaattaatgagtgcaatagatacatttactgactgctcaagtctcactccatgcttgaccatcaccccatgcttgatcaactgggcagttgaaatctgaatcaaagacaacaatgggatgaagtatggcttgacaactggctgaggaatgaggatgaggttccaagccaaggtggagcccaggaatacagtgtcacgataaaggtcaaatgattccttgcaaacttactcatttacattttgaatggttcaattgaacattatgataaaaaagctcaattcaaatggtcatgcaaaaagtatggtacttgattatattttattttatggtacaggtaccttctactatttcttgatatcatatgttattactgaaattcaatggctgacatggatatcaacttgaatataaacaatctgatggaaggacatttctctgacacccctcatatttctcaatatggtacaatctgtgattatacaaatatttgttattaggttagtgctagactattaggtctttgtgaagtacaaatctaaaagaaagcaatatatacttgtgttcagaaatatattcaagaataaaacataaatgccaagaactagtctttcaaaaggcaataggtacaggaacaaaaatttgaatattctcaaaaggataaatattgttattcatgaactgatagcaatatttaaatggtatcatctcctttgcagtgacataatataagctaaacactggggagacgcatgaagaatgttaaaatgtattaatcttgcagaatatactgtggcatattttctaacacatatactcaatagtgaaattgatcatttcaatttaccaatacttgtagtagtactgtaaaacataagtttacataaaaatctcatttttaaaataaaagacactcctgctattggtaaaatttgtttttatgaattaaaaaaaacttcacactgggtttttgaagcattgcattagcagtaatgtttttgttaatttaactcctcatcccttgtaacatttcaaaaattcaccactagtcataattctcttaagaaaataaaaagcagctttgagagctatagttagagtttaagacagaggtcagccaattatgtttgaccatgtctggctgaccatatggccaaatctggcctgccacctgtttttgtatggttcatgagctagaaatggtttcacatttttaaagagttgaataaaacttaaaaatatactattttatgatacaggagcactatatgcaacgcaaattttattgtccataaataaagttttattgaaccatggccatgctctttcatttatctattgtctatggctggtttcatgccatgcagtacttgcagcagagagtatatggctcacaaaggctaaaatatttattatccggcccgttagagaaaaagaaagttcttatctataatttctgagaaggaaatacaaattaattaagctttgcaaaatgaaaaattaattccagataactctcttttatgtgcaattagtcaattggaacattctacgttcaagttatatatattcccagaacatgcaagcacatactcaacttaaaagtcataaattcaataacactaacttaaaacaaattttccaccacaatatttagtgttataattttaacacaaaccaatgagcaagatactacatgccagatgtgacctgaaagtaacaacccgttggtcagaaaaaactcactggactgtgtaatctctaataagtacgaagtggtgatatctaaagcaaacagaataaaatcactctttgtggtaatcagaatgactttctaaacaaatgttaagacaaaaaaattctgccgaaccaccaaggacatcccaagcaatcattttatttttctctctgctttgctattagaggctatctgagcattgtttcttctagatattgagaaaagtacataatttctactaagtatgctacatgcattagtgttcccttaatgattacaagttgtagatctgctaagtgcatcctgaatgcactgaatgtgcaattgttttgcataaacgtgaaaagcagagattctaaataaaaagccgctatttaaccatttgcgattatgctatcatcccacaccatcgcatgtaaatgcacttttctattctctttccagttgctaaagtaaatgaccaggaacagagaaatgccctcatttcttatttattggtcacttacttccttggcttgcatataaaatcaaaccatccataaaatccctttaaaaagttgacacatttagggatcaaattatttcacacaaaattgagatatttccaaaaataggcatgttttgaagaatatctcacattacatgtgcaattgagttcttttcctgtcccaggtacagatttgttaggtgatcttaatcaaattgttgctttcttcattcactgcatactattcctttggcaaatatgtttctgccttgataatgaactaggtactatgtgaagtgttatacagaataaaaagatgaatcagacataactatgatctctaggattcgacaaacaagtaaaagtattaatcatatatatatatgtacaaataacggtgaggtaaaaaatgctgagtgcacctaagagaggtgcagataagatattttggaaagtcagagggagaagccattacctccaactgggaagatccaggaggaatttattggtgaggctgcatttgagctgtaccttaaaaaatggttaagaagagtaaattaaattgactgacaagggcatttcacaaactgacaggtatgcaaatgacaggtaagaatgtggtagatgtgtgtgggtaaagaagaaaatgtcattttttttttttgtccataggcttggatgtgtaaagtggagcaagttatagttaaatctagagacatagcatgagaacacgaagatagtgcggtctggaaggaagcattggactcagacagatataagttagaattatggccctggatactggctgagtataccagagtactttacttaacctctaagtctcttctaatgtctagaaatattacataacttgcaaggtccttgtaaagataaaaaatatatatatgcacattttataacacaatgtctggcacattatagatgtctaataaataatagctattattgtgtcaatattatattgaataacaggctaaaagttttagatagtgctgtaagaagttatcacactcactatggaaagtaccacaaggttagcagtttctgaaactaggaactatttggaaactaaagcagttggagagttagctagtgttttcaactgggactgcccattaaaattatctagcgatctttgtaaatcgtggcataactaggctttaccacagaacaattaaatcaagatctctatccgtggagcctgggcatagtactttataaaagattcccaaggatttctcaagcatacccaaagctgagagctactattgctctagatacaagttgttacaattaatatgataagtgtaataagtccagcaaaatatattttatgatcataacttgagttattttcactctgctacactagtgaatgtcacttttctagatggcctttctctgtcatagtctcctgtttgtccaaagacccatttagcaccaaacaggacccaacacaatcaaggccaaatccatgtttattgaatggtgaataatatcactgactcatattattaccattccccattagatcaaagtgacaagatgaaaaacaatataagataggtaccatgtagcaataattaaaatatttatattttgatccttgttttctttttcaaaagctatcttgcattaaaagagctaaaggttcacatcatgttcttaagggttatagtaagtaatcagctatgcctaaaaattaacatcatgaaccaacacatgcaagggtaagtgcaagactagtaacacatgtcttcagccttatcaataatattatcaataatatcaaagtagtggtcaaccacctgttttcatttttttaacttttattttgagttcagtggtacacatgcaggtttgttatgtgaataaattgcatgcttcaggggtttggtgtacagatcattttgtcacccagataataagcatagtaccagataggtaggttctaaatcctcaccctccaccctagagtacaccctggtgtctgttgtctccttcattctgtccgtatgtctgtaatgtttagttcccacctgtaagtgagaacgtgtggtatttggttttctgttcctgtgttagtttgtttagaataatggtctctagctccaaccatgttgtggcaaaggacatgatattttcttttatgactgcatagtattccatgttgtatatgtaccacattttctttatccagtctgccactgatgggcgtttaggttgattccacgtctttgctattgtgaatagtgctgcaatgtgtgcatgtgtctttatggtagaacaatttatattcccttgggtatataaccaataatgagattgttggattaaatggtaattctgtttttagtttcttgagaaatcaccaaactacttcccacagtgactcaactaaattctcatcagcagtgtataagtattcccttttccctacagcctcaccagtaactgttatttttttactttttaaataatagccattctgactggtatgagatggtaagacattgtggttttgatttgcaattctctaatgattaataatgtcgagcatttcttcatatgcttgttggctgcatgtatgtcttcttttgaaaagtgtctgttcatgtcctttgcccatgttttatggggttgttttctgcttataaatttgtttaagttccttatagattctgaatattagacttttgtcagatgcaaagcctgaaaatattttctcctatcctgcaggttgtctgtttactctttcaatagtttcttttgctgtgcagaagctctttagtttaattaggtcccatttgtcaattttttattttgttgcaattgcttttggcatttttgtcatgaaaatttttgccagggactatgttcagaatggcatttcctaggtaatcagccagggtttttgtagttttaagttttccatttaagtcttaatccgtcttgagttgctttttgtaaatggtataaggaaagggtccagtttcaatcttctgcatatggctagccagttattctagcacaatttattaagggagtccttacctcattgcttgtttttgttcattttgtcaaagatcaaatggttgtaggtgtgcagccttatttctgggctctctattctgtttcattagtctatgtgaccgtttttgtaccagtaccatgctgtttaggttactgcagccttgtggtataatttgaaatcaggtaatgtgatgcctccagctttgttctttatgcttagtactgccttggctatttggactaattttttttttttgttccacatgaactttaaaatagttttttgtaattctgtgaagaatgtttttggtagtttgataggaatagcattaaatccgtaaattgctttgggaagtatgaccattttaacaatattgattcttcctattcatgagcataggatgtttttccatttgcttatgtcatctttgatttctttaataagtgttttttaattcttattgtagatatctttcgcctctgtggttttctgtattcctaggtattttattgttttgtggctactaattcaaaatttcattcttgatttgcctctcagcttggctcttgttggcgtatagtaatgttagtgatttttgtacgttgattttgtatcctgaaactgctgaagttgtttatcagatcaagaagcttctgggaagacactgtgggattttctagatatagaatcatattgtctgcaaacagggatagttggacttcctctctttctatttggatgtctttaatttcttgctcttgcctgactggtctggctagaactttcagtactatgttgagtatgagtggtgagacagggcatccttgtcttgttctagttttcaagggaaatgcttctagcttttacccattcagtatgacgttggctgtagattttttttgggctgttattattttgaagtatgttcctccaatgcctagtttattgaggatttttaacatgaaaagatgttaaattgtatcaaaagccttttctgcatctactgagatgattttgtggtatttgtctttatctctgtttatgtgatgaatcacatttattgatttgcatatgttgaaccaaccttgcatcccagggataatgcctgcttgatcatggtcgaatagctttttgatttgttgttgggtttggtttcctagtattttgttgaagatttttgcatctatgttcatcaaggatattggctttaagtttttttgttgttgtgtctctgccaggttttggtaccaggatgaggctggtctcatagaatgaattagagaggattctcctctcctcaatattttggaacagttttagtaggaatagtacccgcttttttatacatacagtgggtacaattccgctgtgaattcatctggtcctgggctttttctggttggtaggctttttgttaatgattcaattttggaggtcattattgatctgttcagggattcagtttctccctggttcaatcttaggagtttctatgtttccaaaaatttatccgtttcttctaggttttctagcttgtgttcatagaggtatttgcagtttttgtacttctgtggggtcagcggtaatgtccctttgtcagttctgcttgtgtttagttggatatcctctcttttttctttattagtatagctagtggcctatgttatctattctttcgagtaacaaactcctggatttgttgatcttttgtatggtttttcacgcctcaatttctttcagttcagctctgattttgcttatttcttatgctctgctttgagttcaaccattttgaaaaactgcattccagattgtattttatctagaccccatatatagagatcttttaaaaagttatttcatgtttcaatagtcctacaataacattttgtggggtgatgcatcaatcattgttatgatgttaaatttaataataattttacagaaaaacacttttgtattcaaatgtataatagggaatgttgaagtatgctgaggaatatggagactgaggagtgtgtattaagaaaatcccaaaggacccatagcttcttagaatttgaaggcactttcgaaaaggcaacctacaaaataggagaaaattttcacaacctactcatctgacaaaaggctaatatcgagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgcttaccatcactggccatcagagaaatgcaaatcaaaaccacaatgagatatcatctcataccagttagaatggcaatcattaaaatgtcaggaaacaacaggtgctggagaggatgtggagaaataggaacacttttacactgttggtgggactgtaaactagttcaaccattgtggaagtcagtgtggagattcctcagggatctagaactggaaataccatgtgacccagccatcccattactgggtatatacccaaacgactataaatcatgctgctataaagacacatgcacacgtatgtttactgcggcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccacatgttctcactcataggtgggaactgaacaatgagaacacatggacacaggaaagggaacatcacactctggggactgttgtggggtggggggaggggggagggatagcattaggagatatacctaatgctaaatgatgagttaatgggtgcagcataccagcatggcacatgtatacatatgtaactaacctgcacattgtgcacatgtaccctaaaactttaagtataataataataaaataaaataaaaagaatttgaaggcactttagagataatctaaaagaattgacttcttacaatttgaatggactttagaaataatctggcagaatttcttgccaaaatcaagaaatgccatttctcttgaaatctaatagcgaagaagaaaaattacttgcttctttgtaaaaacatcgaaaaacctacaaaaatatcaaagtttatttccaacatggaggcctggattttgggacttccttattaaatcttaatatattgacagcacttgtaaggaccaacctcattcaaaaatataacaaacagatggcaaattctacagtcggcagaagtaatgggggtattaaaatgctagcagcagtctccctcatggctcttgttttgacaggtgtctactcaggtgcttgtgttttctaagcaatgtttctctgttcctgtgtataagcggccctcacctttttatgagtatctatgccattgcagtatttgctatacataagacaatcacaaccattaaactgtctctaatcctttcctgttgtggttatataaattatttgtttacactgagagtacatgaaatttttataggcacaatctaggattgcatctatccagctttcctctccaataaattttttgtaaatattcaaactcatatatgcctcaatgtaaccacattgtaaaccctatctgttgctttcacagaaaccattcaagctggataaatggcccacctcatagcccagggaagaactcaatgatcagattctaattatctttcttggttcacttaatagccttctcctctctcatgggggaggccagggataccctgaaaatgtggtctcagggaattcattgcagtcatgtcttcttaaacattcatatacaaatgattcctttaaagttattcatacaataaaatgtcctagacactgtgttaggatactatgatgaatactgagggtgctatgatgaataaaggcagtcactgccctaaaagaacttgcattaaaaacaacaataaacaaataggaattacagtagaaccttgaataatattgttcttggtcaacattgttttgttacaacattgataaggaacttcccactggggccactgtctgtgtggagtttgcacgttctgcccatgtctgcatgtgttttctctgggtacaccagtttcccccacatcccaaagctgtgcacattcggttcactgacatattaaaactgtccccgtatgaatgagcatgggtgtgtgtgagtgagccctgcatgtaatggaatggggtcctgtcctgggctgcttcctgccttgtgcctgagctgctgggtgacactccagccatctcagaccctgaactagaataagcaggttgaaaaatgagtaaatgaatgaatggatagatggatacatattgtaaaaattcataaattatgtgataatcatacaaccctacaataataaatgatgtggcacaaaagtgcttactgagcccatcatatttgttgtttgtttttgagctgtgtggtggtaggaggtgcttcttacaattttcacttttcagacaattattccttgatttaacccaccactatgaccaccatcactcactgattcaccaaaatttgggtaaataattatcttacttgtttctttaatatttcttaaatgtatgtatatctcacattcatttcaatgtttaatattagaagtggtgtgggttatttctttagaagtttggtgatgttagccagccactgtgggtcacacctgtaatcccagcactttgggaggccaaggaaggcttatgacctgaggtcaggagttcaagatcagccagactgatatggtgaaaaaccgtcactattaaaaatacaaaaattagccaggtgtggtggcacatgctgtagtcccagctgctcgggaggctgaggcaggagaatcacttgaagccaggatgtggaggttgcagtgagctgagatcacgccactgcactccaacctgggcaacagagcgagacactgtctcaaaaagaaaaaaacaaaaagaagtttggtgatgtttttgtgaccagaaatatgcttaaaatcttaactcctgtttatatcaattagctttgtgataaaattggctttcattatatgtatgctgcctaaagttacagtttctaagaacttatcagtgatgttaagtgaggatttactgtatgtcagataaaaatatgaggtatgaataaaaataacatacattaatagatacagagagtgactagggcaggggatactactctagaatgatggtcaacaaaggcctgtttgtggaggggatatggaacagagacttgaaggtagcaagaaggtcattatcaaagagaagactattctagagagagaaaaaagctaacaaagtttgaagaccaaagtgtgctgggaaaaaatgagaagcaagaaagacagaattactggagcagaaaaggagtggaggacagtagtaaaagatgaaattcgagaagtttggagctgacatggttaattttacgtgttaatgtgactagaacaatggttcccagctgtttgatcaaatatcattctgagcatttctgtgaaggtgggttactggccgagattaatatttgaattggtagattgcataaagcagattgacttccctaaggtgggtgggccatatccaatcagttgaaggcttaaataacaaaagtctgccctttcccaaagtaaggaaaacttttgcctcctgactacctgtgaattgagacagtagctttctcctgcctttgaactcaaactgaaacatcagctctgcttgagctgcaagccagccatccttgagactgcaatgacacatccatttttcttgttcttaaacctttggactcagactggaaggacatcattgactttcttgggactccatcttgctgactcacctgcagttcttgtaaattagcctccataatcacatgagccaattctttacacacacacacacacacacacacacacacgcacacacatatatatatataatacaatatataatatatgtattcatcctattagttctgtttctctgaagaaccctgactaatacagaagcttaggagtagtatgttctacttactatttaaaaaatcatccgctatatggcatggtcagactgcagtgggatgggacagggataaaatcagggagagtagctaagaagctttgcaataatccaggcaagagacaaatttgtggcttttactagggaggtagtggtagatgtagtgaaaattagtgaaagtccatatatatttgaagattgagccaacaggatttgctgatgaggagctggagaagatgaaataagttgaaaattatctcacaggccttttgtccttgggccaaaactggaggaatagagttttcagtttctgagatgggaatggcttgagctgatttgcagggctaatttgaagttcagctttagagcattttattttgagaaatgtactggaaaagcaagtagggaggttgaataagcaatcaggcatgttagtcagaagttgagagtgaaatttagcaacagggtgtctaattgtgtcactaggaggagacctcctagtgatctggtgtggacatagaagatttcttcagaaacgggggtcatctcacatagttggtaagaaatatttcataattcatatagcacctaacaaaatatagtttatcacagaattcagtcatatgtagaaatggcattgaggtaattaacagcttttctgtttattttgtgtcaatttctaccaaaatcctaccaaatcataagctgctttacttatttcatgagtcatattaaggttattcaagtatgtgattaatgtgtatgattttctatgccattattgtttttagattatatagatctaataggcagatagctcatatgctatggttggaatatgtttcccaaagatcatgtgttggaaacttaatgtccaatgcaacagtgttgggaggtggggcctaataaaatgggattaggtcaggagagctctgaacaaaggattaatgttgttatcacaggagttggttagttaccatgggaattagttagttatcatgagagtgagtttgttatcaatgtaaattttgccccctcttgctcaccttctcttgtactctcctccccttccaccttcccatgtaatgacatagtaagaaggccctcatcagaggacagcaccttgatattagttctcccatcctccagaactatcagaagtaaatttcttttctgtataaattacctggtctgtgggcttctgttatagcaaaacaaaatgagctaggacatcatattaacatacactaaagaaattattctgataattatattttgtaggctaaccttaacttgaaatttgactctagctagtcatccctattttctatcttgatctgaaataatttattttggtttcattatctataaaaaaaaagtttctattttgcaacattgcaaacactgcaatagaacgtctcatactcaaattctgttatagagtgctcattaacatagatgtagcttttagatattttatgtagacttagataaattaaatagcttcccaatatacatagaaaacctaaaatacatatatattctttttatgcccatgaaaatgcaatataaaatgtctgttataaaaatgattgttatattaaaatacggaattgtatacatttagatattttataggataatgaaattgttttgctttttctcctcagcagttagagtggcatattttagagaaaaaccataaaatattggaaagagaaaaggattgagggtcccaattatgcaactgttgggatgacaccaaaaaaatcatttaacctcttaagacatcatttttccatacttataaaatacagatattgaagtagattgttaatgttctttatgagtctaacatttatgaatgctatcatttaacaggcatggggtgtgtgtgtgtgcgtgtgtgtgtgtgtgtgtgtgtgtgtgtaaatgcagttccaaaaggaagtatcattttactccaggcaaattttcattgaccatattttatgcaagctacatagtagaaatacggtcagagtacgtatttctatcatcatgttaaaaagacataaatataaaggtgccagcattttgtcagtaaataatcagagaatcagtcctgaacagtaaattcgagtatgtgtgcttttatcacaaccacaatgtttcattaatgtgttttttcttgctgaatattctcgattccttgaaataaattttaattagccactttatgcatataattttcatattttcataattatacttaattatgctcttggcacaatttatgtaatcaaataattgccatatgcaattatattatataaaatatgtaaacgtaatggaaaaaatcacagaagatgtattcacacaagatatttcctttttcattttcagctatccacattatttagtattgattttaacaatatttatttttagctcaaatcactagatatcaaagagaagattatattcttaaggggaaaatttgacagtgattctgcatagagatggtatattattaaaatacaccataagttgaacatttgaataaaagtaatatgtaatatgcattttttcaggtggttttaggaaaaataaaatttacgttttgcttttacccttaatattattgatttgtaatgtgttaattttatttatagctttatacattcttatctatactcttaattgcctatacctaaatatggaatcacagaaatgcaaaaaaatcaaagaaattaaaataaatataaaggttatctaggtcatatccacctaacactacaccttgagaaaatgatgtcctgggaatttgactgacttcacatagtcacaaagctagttcagttacttcacatagtcacaaagctagttaacagcaggacacagcctaacctcaggactcctgcctgtcagtacagggccttgtccttctataccaagaggatactcagttcagcacttataggactgtgttttcaatgatctgcttttgttttttatcttcttcccttgattgtgagatctctgaagaaagagattaggtcttcacctttgcatcctccactagagcttagaatgttgcctacgcatcatcataattgctcaacatctagctttttggaggcttttattttgtgcaacttttgtgaccattttacaaaaataagtaattgtctcctcatctattttgtggatacacaatgaatgttgacctaatgacaactggttgaataccttattgcaaaattgagacttaatatttgaaacacgtattttatttgactctacaaaatataaaatgtgttatgtacacatctaccaagaactcacactgaatggtaattgtagggtattgggtaggagccacgaggtattataaattttctggcactcccatggcagaactgtttaaatgatgaaatttcatttatagcaaaattatcctaactcaaacactagtgaaaaggaaaaataaaaaaagaaaaagaatagctgatagacagaaaactaacatgactgatatggtttggctgtgtcctctcccatactcatcttaaattgtagctcccataattcccagatattgtgggaggaacctgatgagagataattgaatcatagaggtggtttcctccatactgctctcatggtggtgaataagtctcatgagatctgatggttttataaggggtttctcctttcccttggctctcattttctctcttgtctgctgccatgtaagatgtgcctttcaccttctcacatgattgtgaagcctccctggccacgtggaactgtgggtccattaaacatctttttctttataaattacccagtctcaggtatgtcttcatcagcagtgtgaaaacagaataatacaataactatatacattttcattatcttcagcatgcaagttttctctctgaaacaactcaaaaactccatgtgtattagcattttgttattaagtaaatgctcctctgggtttctgtcctgaggttccacagggtggacatgcttttattttgtttctattgaataattcacagaaagttattaattgactaacaccaaaccaatgacaaggttgaagctcttaattgcatattgtcctcacatttgcaaatgggaaataaggcactgcccaggacattccagggggagatacaaagaaggataaactgaggctctattagctctcacattctgtgttatttttatggagtgtaactttggcttcagaggatgagggtacagagaggaagaacataaagcacctgactcctcgcctctattttctgaggtagattgctcttctagccgagactgaaataaaaaatagctctcacgtctaagttcaagcctcaccatgtcgttattgggaacaaaaagcaagtatcaatgaacaaaataaacaaaatactctgaacatgcaatatgagtctactatatctcttaaaatcaatatttttcaatgtacagatacacatttacatttaaaaagaatagttccaattgtcattctcttcacgtgtctgccacacaaaaactttttaccattacagattaagccaaggcactaccaaaaaaaaaaaaaattaacttagtaggaagaattgcaaaatgccaaatatttttctgctttaaatttgaatgtttttaatattagcatgtactttcattaaggagtgggcctactagatacactgaaggtatttgagtatttatgataataataatgattgctatataaaactataattagccaggcatggtggctcatgcctgtaatcccagcactttgggaggctgagacaggtggatcacctgaggtcaggagttcaagaccaccctgaccaacatggtaaaaccccatctctactaaaaatacaaaacatagccgggcatgggggtgtggtagctagcacctataatcccagttactccggaggctgaggctggagaattgctgaaacccaggaggcagaggttgcagtgaaccgagatcgcgccattgcactccagcctgtgcaacaagagcaaaactctgtcgcaaaaattaaaaaaaaaataaaaaaaactgtaattaatagacaaacactggcagagcagagctgcactgtcctgggctctgtgtgttgacataaagagtcaaacaaggccaggcacagttggtcacgcctgtaatcccagcactttgggagtccgaggcaggtggatcacttgaggttgagttcgagaccagcatggccaacatggtgaaaccccatctctactaaaaatacaaaaattagccaggcataggggtgggtgcctgtaatcccagctactcaggaggctgaggcaggagaatcgcctgaacccagaaggcagaggttgcagtgagccagtatcaaaccattgcactccagcttgggcaacagaatgagactccgtctcaaaaaaaaaaaaaaaaatcagacaaagtgcctaccttcaaaaaacttactgtgagcatagaggagacaaaatggcacacaaaatgcacttgacactatgaagcattagtgctaaaagctaaataaaagttagagatgatgagctcataggagttttaaaatgctagaagaaacagaaaaacttttctggagaaaatgaaacaccatgggccttaaataagagacaaaatgtaaattcacaggttgcaaactcaaatgcctatcaaagtcagctgaatattgctgggtaggaaggtacctacagtgttaccaaatttttcaagagaatctagaattctagtttgacatgtaacaaatactgactttttaaatagtgtcaattaactcaaacaattaagtgctgtataagccaataaaaacactatataattatggtctgcctgatttatattttttgtcatgtcctcaaatattagaacagggatgagatggcaagagaaactgcatgagctacatggctgtgatgagaccggatatagttaatttaaaagaacaatcagggctgggtgtggtggtcacacctgcaactcagcactttgggaggccgaggctcttgtttttcaagaccagcctgaacaacatggtgaaacctcatctgtattaaaatacaaaaattagcccagtgtggtggtgcacacctgtaatcccagctactcaggaggctgagacatgagaatcacttgaacccgggaggcggaggttgcagtgagccaagatcatgccactgcactgcagcctgggtaatagagtgagactttgtctcaatacattaaattaaattaataaataaaataaaagaacaatcagaaggctggtgcaggaggtaagtagtagaggagacaaactggggtcaggttggagattatttggggcatgaataaaagcatttatattgattctggaggcagattagagaacaagtacatacagaggtgtgagaggctaagtgtatcatcttgaataaagtcaaacttctctttgtgttggcattcatcctgtctgccaagtataatagctgagtgtaacccaaggcattttagaaatgttagaagtgtcaggaaccatgtaccacacatagacctcaaagcaatgttgctatattagtcttttttctttaacttacctgtaatcataaaatattgatttaaaaaccaagactactaatatttcacaacactatattcacttctaacatactactgtcaggttaacatttgataattccaattaaaagggtttaaaatttttataggatttaccatggcagtatcccaaggaaacatcgtaccacccagcttggccaagcacctaggccatgtttcagctgagaatttttttttaaacttcattatatgaacatttggtgtctcctataaactgacaatccagtttgttagagatacaatatgcaaattaggaaattagcaacaatttctgatgctagtcattactatcctattctccacttcagatttgcaaaaacgcaatgatgcagtaaactataccaacggatgttttgctacggctattaatggacaatattttattgtaatgttaaatttactgcaaaacttgggaatttacaatagcatacattatcctacacaatctaatataattcaatttcctttgtcctatgagaaaaacaaataaaggcaaaatatattgcaaacatactcacttgtgtgctaactttaccatcttattaactattcagtcaaattcagtatcaccccaaatgctgtgaacaaatttcatattcttcaatgggaaattgaagaatttttggacttcataatattggtgaacattctaagctttagccatgtttttctgcttaatctaatttcaccatctctcctctgttcattgattattcctattgttactccacacactgatgcctaactcccactcaagaggtactaagtgtatcagaagccattattgtaaatgtgcagttcaaattttttcctttgctgcacatttgtttatgattttctttgtagggccctttgaccatagattctcatacctaaattcaacaacaaagtcagaagtgcttttgtttggaacaccctcaccattgtcctgaggagtctacacagagctaaaaaaccactatgcaaaagttcaagggaaaccagttgatgcactgtggactgaaggcagaagctgctgacttctacatttcaataaaactattatgaattgcattttagaaaaagggctttgttgctggtttgttttgctctgctggttttgttcatgtgtttgtttgtttgtttgcttgattgcttgtttagagagctaaattacttctgtaaaactcattggcagaaagcagagggcgaataaagctgaccatcttaggttgaagaaaatcatataaacaccaggagagcatcatcaggtaatttgtattctctgatttaagctatcactctgctttatacaaagaaatttaggctgggcgcggtggctcatgcctgtaatcccagcactttgggaggctaaggctggaggatcacctgaggttgggagttcgagaccagcctgaccaacctggagaaaccctgtctctactaaaaacacacaaaaaattagatgggcatggtggtgggtgcctgtaatcccagctactcgggaggctgacgcaggagaatctcttgcacctgggaggcggaggttgcggtgagctgagatcgcaccactgcactccagcctgggcaacaagagtgaaactctgtctcaaaaaaaaaaaaaaaaaaaaaaaagtactcaacaatatgtttttctaatattaagtacatatggacaaagaattcccatcaaaatttggagataaaagcgacaaacttacaaaatgaagtgctgttgaagtacatgtactgttctggaatctttacattgaacaaccacagaaagataaatgtcagagaggagaactcatcaataactggcatctattagggattttgaaataatcataaatgccagagtttaaaaggataattttctttgactatgctactatctcataattttatacgataaatttcatgcaagtatttctgactcagtcaaatcaatcttcatctttactggacaaaaatattctgaccaataaattttgcacacaactatagtattatctatattagcactgcacaaggtataaattctgagactatattctctattgaaacactatcagccaaattcattttatagcccaatgaaaataggtgattttataacaaaaccctccgtaacatacttttaaaatgtctatccacctgggaactaaacatccattaaaatgcccaaatcctaatcttcatgatctttgcttatttggagaagcaatttattttttgtttttgctctttgcataaataatcttattttatccatgctgcaggtgttgttaaccacattttatgtatgaggaagcaagactcacagaggttaaaaactttcttaatttcacacagctattaattataaacatcaggacacaaattgagatttttctgattctagagtttatgttatttttcaaaaaaataattttcgctgggttcagtggctcacacctgtaatactagtattttgggaggccgaggcaggtggattgtctgagctcaggagttcaaaaccagcctggccatcatggtgaaaccccatctctactaaaaatacaaaaattagctgggcatggtggcgggtgcctgtaatcccagctactcaggaggctgaggcaggagaatcacttaaaccccaaaggtggaggttacagtgagccgagattgtgccactgcactctagcctgggtgacagaacgagaccccgtctcaaaaataataataataataataataatttcaacttttatttttgattcaggtggtacacgtgaaggtttgttacatgggtagattgtgtgatgctgacatctagggtgtggatattcctgtcactgaggcagtgagcatagtccccataggtagtttttcagcccatactcccctccttcccttccctgtctagcagtcctcagtgtctactgttgccatctttatgtccatgtacactcagtgtttagctcccacttgtaagtgagaacatctgatatttggttttctgttcctgtgttaattcacttaagataatggcctccagctgcatccgtaatgctgcaaagggcataatttcattgtttcttatagctacatagtatttcacgatgtatattaccacattttctttatcccaattcaccatggatgcacacctaggttgatttcatgtttttgctattgtgaatagtgctgtgatgaacagaggagtgcacgtatgtttttggtagaatgatacctttgggtatatatacccagtcatgaaattgctggttcaaatggtagttctgctttaagttctttaagaaatctccaaactgctttccacagtggctgaactaatttatattgccaccaacagtgtataagcatttccttttctctgcagcctcaacagcatctggtttttttgtttgtttgttttttgttttttttttactttttaataatagccattctgactggtgtgagatggtgtctcattgtggttttgatttgcatttctctgatgtttagtgacaatgaactttttttttcatgtttgttggcatcttgtaagtcctcttttgagaagtgtctgttcttgccctctgtccattttttaatggagtaatttggtttttgcttgtttcaaagaacccagaaataaagccacataactacaaccatctgatcctcaacaaattcaacaaaaataagcaaaggagaaaggacgcccccattcaacaaatggtgctgggataactggctagccataggcagtataatgaaactggacccctacttttcaccacacacaaaaattaactcaagatggattaaagagttaaacgtaagacttcaggctattaaaaatctagaagaaaacctaggaaatatctttcttgacatggatcttagcaaagaacttatgtctaagttgttatttatttccttctcttctcaggggcttcttgatgaaaggatgagttagtctggattctccaagaatcagatgccaacacaggattaaacatgtaagcattttgagcagggtaggaaaggtaccagagctaccagattcaagtctgatgcagagacagtgagggacgtttgggtgggagcctcctagaattcacattctaaagaaggttaataaagccatttgggagtcctcaagtcacagtcattcaatgagaggggtccatgagtctcaggaacaagtgtaccttagaactcctgctgtgctcagtcattgtctgtgaacagccctcagagagcatggccagggtacaaacatagtgatgaatatcagagctcagcagctggaaactctggccaactaccgcctccataattggaggaccattaggtgtattcacagggctgcaaaaaggaacaattcccaattgaacctcttacaagttttgtcatatttggaatattattaatctctctgagtcatattgaaagaaaagaactgttatagaaataaatgtaataaaatatgtgacagtacctactgcagtacctatgcaaagatattagctatttgttttccctctaacatccagttgattgcctgtgtacagtaggtggttaagtaaaggtattatatttaaacatgtatacataaatatacgtaagaaaaaactatacccacatgcagtatgaatataacttcgtttcaatttctctgtttagaatttaaagaatatttctactgaatttcatgttttctctttaaactgaattcatcctggtatataccaatctatataattttcttttctaccaaaagaggtatttgaccaagtgaagtactagactgacaaggttctgtctcttaaaaacaaacaaaaattacacatttctttacctgctgtgtttattcgttcatttatgttattcattcaacaaatatgtaaaactctgtgctggaatccatgctagggaaccagaaacagacactattcctacttctgcctccatttggcttacagtctagtaggaagaaatactttagccaaggttcacgcaaacaaacctgaaactgcagctgccacagtgctatgaaggacaagtgcagtctgtaatgagatcctatcataggtggattagatgcagccagggagatcagcaatcgattgctagacaagtggtgctgatgacgaatttggaaggtaataaggataggaaagaatgtccaaagcagaagaaacaaattacacaaagtccagtggtgggaagaaagatgtgggagaagtttcgtgtggagaacaaataggagaggagcaggttgagaagctgcagacatgaggaagggccaggaacatagtggttacataactgtcccaaaaggctacagctgaaaaataaacctgggtcctattcatggattctcatcacactgaatgaattaccagtgtccattttgtcacttttgcttttaatcactgttatttaaaaaaaaaaaaaaatagaagaaagtaaatagcagaaaacagggaaaatatcagtcaaccagttccaaatcattcaatagtatttaaatggcataagaaaagtgatcaaaactaccaaaacaggttaagcctcacttgctttaagcctcttgctgattcaatctatcaatccaacatcttaattattattggaccatatggaaggtagttattcaataatacgacaacataataaaaagctttaaaataaaaaaaatagtaaatctgctaatccaatctcacagagcaaaacatttaaatgtcatttgagatattattctcagttaagtatcctattcctgtgcttatggcatgacaatccgattcatgcaattattgtggagaaagagtagtaaaaagaagcaatcatccactggctcagagaccactatcatagctaagacaccctatggattaaaagagtccttaaagcataagagcacattcagagttttatgtacagtataaatgcttagctgtttttcagtgtcaggtgcctacagatttgtggtgtgtggctcattggctgacgtgttaaatccccaaaggttacatcaagcaggcccaagacttgtttaagaaaaattgagaccatgccctcagtctcttaagggagtgatattactaagcagaatacataataaatatctgccttcttccagaagaaacaggaaatattttcctattttccttactgttatttcttcagggaaagatctgatagttggtaaaatgggccatagggtagcttcactaagcatttctaagaattccgctctgaaaacttgtcggaaaagaaaagcaacaacaacaaactagttaaacagaaaactgagcatatattaggataaacaacgaaacagaaagtgctaggcaaatcactaactctcctaggaaattaaatgaaattgagataaagaacatttgaaagaaagcctttgtattaattttgtttggaaaaccaggtattgttgaagagtcaccagatacttctaaaagtcactatttcattttaaaatgcatctgcctacacaatatgcaatccttatttgacctaattctttcaataattcattagaatgacttttgtcaagaatgtaatgtggatatatccttatacacatttatatccatgcaaatcaaattttagaatatgttatagtcttcaactcacctgcagccatgattgaaatctgggccttattagaatttttttttaaattagagaaattctaaattcggccctaacaatgtttaaccttagcaggatcaagaaagagtatggttgctgccaggtgtaaagaaatgcaaagatgggcaagcaagcaggagcaagggaacagaaataggaacaagaggaaaaagacaagaaagagaagtccccaggcacagataaggaggaaaaaggtaacttataaacagttgttctgtgacatgcaaactctggagattcttattaggttctctgcataaacctttgctttcctcaagaacagttttgtttattttgttcttttaaagactagagtgagttacctgggaagccctgagtcacataattcaaaaagcagtattgctctctgcctttctctgaagacgctcaggacagagaaatggactgagctgcctgactttcttacctctgcatcacctggcacctgtctttccctcctctcactcctacttcatggttggccagcttgttttgataagaaatcctgcctgtgttccttttgtgaccccatcctggacctcagtatggtaagggtttgggcactgtgttctggcctattcttagcaattcctaaccaatagattggccaagccccaaaacgtaatgccaacctcagagtttctaaatagatggatcagggtatggcgagggtttaatagggaagacctaggaagcatctcttgaaactgttcttttgcacagcaggcacattgcttctcacctgaattatattttcttgaagtggactggggccagggattaactccagctctgatgctggctccagcgtctctttcaccaatgcctgctgccttttattactatctcatgaactgtcacctatcaatgcttgcactggagccaggaaaagtgacaagttagaagcctgataagattctctcaccatttatctgtgagatggccatttacattgctcctagggaagcaatgaggaagtctttctaagaaaataaatccagctttcctgcttcgggcctcatgaccattctcaattactgacttttgaactcagtttagaatcacccctttttattccatatcctctattcttgtcttgatttagaaaaataggaaactccaaccttaggagagtaattttagatcctatgcaaaatgcaagaaaatggattctatttttgtacccagatctaacccagagacaaggaaagtttgtttataatccagatttatagagatttataatgttcaaaacttagaaatattaagtttgaaagtctaaactgttaaagtcgctaaggcactagtgctttgtataatttacccactacagaaatgatttgtttctatggtgggtaaggaaaatgtagtttcaataaatcgttggcagttcttgccaggcactcggttttcggaagtcaggaaaggaaagcaatagcttggatacattaaaggaagaaagtatcaccactcaccacttccattgtcccttcatttttttccatgaatgggcattttggacttgatatcaaatcctatcttccacatttttctctgtatacttgttgaagttttttgtccgttaaaactcagataaatctgttaaatgttttagaatacaatagagttctaaatccggctcacggcagcctcaacccccactatttgcagcctcaactcccactattgaaacgaggcatcacacccatgaaaacatatgaaacagagcagtgcatacaatttcacaagcttcacggtaattcaaaacgtttgtaaattccatttttccccagcacgctgccagtattcacaacaaattaaattctcattcagctgatctgctaggaagcataacaaacaagagtgggcatgaaccaaagtgtcttccttttattactttttcttaccatttattttgatgttctaaatggagctgccctctgcctgtccatagccattataaccctacctgattctaggagcaactgtggtcaaggtcgtcacatcacagtctcctcccacaataaaccatctctctcataattcaggctggccctgcagtcaccacagggaacaggtccaacaccctactggaccagtagaggtggctttttcatacctgtacagtggccctagcatgtgagttttggtgggacacctactgccaaaattattttggatagagccccctttgtgaatagattcatccacctgcctgttttgcaaagaaactacagaaagataaatgtgactttgtacaaaccaataaagtgatatttatattttcttaaataatgtgagtggtaaattaactatttttgagcaataactgtcaggcactgtgattagtgtcttgtagactttgtcatttcatcatctcaacaattctgtgatagaggtagttattcttaccattttacagaaacacattcaagacagccaagtccccaaagccacagagccactagttgcaggttctaggatttgaacccacaactgtctggctccaaaggcttgtgctgttacctgtgtagccccttcctaatcatggtattaagacattgatttaaagcataatacagcaccaacatttactactatgaaccatgaacttgcctgggccattaatgaaaagactttaaaactctgcttataaaaaccaagcaaagatagtatcactaggaatcacaatattcatcttaagacttctaagccacagacctcacactcgaaataaaagtataaatcccatcataatgttaacattaactttataaggaaccaaagtctatggatcgtataaagcaaattaagaatacctagtcaatcattcaggcatctattctcaataaatcttaccacacactactgtgtatttagcatcttccagagatctttgggatgtacaagagtatatatagcacctgttctgcaagtgacctagtagaagagataagacaaatacccatgaagagttaagtaatgataagagtcaggaatgccagctgaatgacacaaataatagatagaatgagcatacaacagagatagagcaattatcttggactcttgtactgggaacactcaggaatagatagagacagaaggcagagtgaaaattatgatgcagaggtagacctgggcaacgcatgtttagaaaagcatgagtttaatgctggaattgggaattgaagttgagtgttcatgttggagatagatgcatagggataagcttagaaatgtagcctggagccaaacaataaagtcttacctgacacatactgggaaatgtagagagtatacataatcaatgctggaggaaggaaggttgaagatgttgcagcaaagaactgatataaaccagtgtttaaagaagattgttctggcagcaacgttcagaatgtactatagatgtcagagaacaaaaccaggaagacagtatggagacaactgcaggtaattgaacatgaagtgatgaagtccagggaaggaaagtgaagagaatgaactgaaagtatggttgtgataatgctctgtgtttatcaggtcccctttcatcctcatctacctggacacacattccctagttagctctggactatgagctataagaaaaaagtaggtacaagctctttaggtctctttcttttccatgtcatagggaactaaaagccacatttaagagtaaagagccacaagatggtatcagagtgtattccccaagtcactgcataaagagagctaccctggagagctgatggacaggcagctgactttgcacgagcaaaaactagacttgtgtatgttcagctattaatgtttcagggtctgttactcaaacatagcctaatctcttcctactaatacaaagataactgtgtcagaatttatagctgtgctcagggactttgatgaccctagtcttggaaataaaactaaaaatagacagcagctagaatttgccagtgacttaaaaaatggcactaacacatcacatttagagaatacctgctaggcaatgaaagcaatgacactttttttctccatttgtgtttcattagattaactgtgggttttttaatcataatattaattaagtctttgacaaaattcagaatttcttttgctcatagcaaatggcagccgtttgcataatagcagttttcctaaaatgctaaattggaagctaagtagaactacacgtaaccctgaagttacagccttacaactcttaggaagttctttcagttttctaactatataataatagaattaaagtagataagaaggaaaatgctataagacattcatctgcatgtgtcagcacagggctagccatggagaatgttgaattaagcaagcagagtttcatcctgccactcagttcacactctacgtcagctgtcagacactatcaggcagcatcctgggtgacctactggcaggtttttccaaatcattctaattgcccaattccagtacccatggatgtttctactcttggagtctctaaaaggaaggaaacaggatgaaaacaacataagaaacagtttatatgaactcagttccaacattactcaagataatgcactggtgttcacacacaaagccaaataatctgagttaaatggtcttccaacatagaaaatgcagaacaaacaagcaattatatacaatctataaagtctatgagtaattgagtgcaatttatttaggcaaaagctagcagagctgtgtcctctgtcatgatgtagctgaataccctgtgtgctggattattcttatcacagtggacaacctcacaaaaattcagcctacaaaggccttggcttcagtgatcaattgaggactcacaccatataacatgattctactagaagctaagagcacttcatctgtacccagaaacatattcaaataaataataactttagatttgtggtgcttgtcatctaatgtgctgttgtcattcttgggtgtgggcccttgggtataggctttacaatattctagtaaggtggctgcaatgacactgatcagcaactctctttttcaaaagagaagatgctcacaaagcctccagcaggattaaaagagcaatctgtgataatgcaatagaataaagctaaataactcacatggaaactaaattcataatcttggaaactaaattcatgatacactaggactgagcttttctttaactaatagagctaattctgagaacaataaccaggtaatgtacgatgacaaacttcaaactgcaaactaaattttatactatatctttattttagaccaggacctagcctgaaatagttcagaaagccttaacaaatgaccttctcgagttgtggaggagtgccaaatacacatgctgattctatgctacattaggtcactggcattttccaagaggacacctacagattctctacataggacatggacatgaaaatgccctatacatatcaaaatatttagcagcaacatgccactttggatagcattttaaatcaggttcttaggggtctttggtgggggataacgaaagggtggagacttcattacactaatcctgatcaggcaaacccaaaatgtacctcatgtggtcatggaaactatttgttttaattcaaaattaattaaatttgagttagagcagaaagggaacagtcccatagctttaattgcagacactcaatacaacacaaagactggcatcccagtgcttttggccttgaatttcggccatcaaaaccattagtcaattcagagacagagcttgaacacttgactgcctacactcaaccccatctgctatgtgcaccattgccaatacacagtccagtgtgccaatggcaccatgcattgacggttcttacagagcatgaaagatgcttacatacttccaccaaagcaacatggtatcatttctcctactggaagaatattctacttaaaagcaacactgtgaatctgtacttgcttattcctttcttattgcttcaaaaagtagaatatataacagcacaaaggagagtttggggtttgagcaaagcaagaataataaaattagaagctacagaacaaatgagtcaaatatatattgagagaagtgaaataatttatcaaggggaaaaagatgaaagcacaaaagcatggaaacataggatgtaaataattgtatttagactattttaactttggcctaattgctttcacaactgttataggagataaaattattaatctaataagcagttcttaacatattaggaatacctaggaggtttttaaaaaccccagatgtgtgggcaccatctggcccctagatcaattaaatcagaatctctggggtgggaccaggcctcaggaattttttaagagctcctggagattgcaacgtacagccatgttttagaactactgccttgaacaaaagaatgaagtatcagttgtagagacaatgttgattcactgtactgcaagaaagaaataagtattcctaaatatatgtatgagaaaagatgacttacaaagcttggaaagtttgcctaaggccaccagctcataggtggtacagcgagtgctcagatccaggaccttacgtggactgacattttcactaagatgtactgaagcctcagggcagagatcatggaaggacaggctgagtgggggaagaaagcaagtctttggactgaggagagctctgataaaaatgtcacttcacatccatctgccacagtgattcctaccatttagaaagttatgccaaggtcaccagaagtcccagatataatgcaaagcctacagtaataattaagtgttattgttattacaactacaaattatcacacacctgttgcacctaaaatgctgtcttcagtgccttacatgtatgacctctgctctgcattacatcctgcaaggtagataccaaaatgcccatattatggttgattaaagtgagtgttataaaagttaaataattttcccaaagtccttaattattaaatggcagagctaggatataaaatggctgcctgctcttttttcatttttatactatgttgcccaaaggagttaaatattttaacacaactactcctaattattttagtttagttagcagttatatcatcagctgaggtcagaagatgtgagagagatgaattgaaggcaagggtggagtatgtaagatatggtggtgtcttagttcattatgtgttgctaaaaaggagtatctgaggctgagtaatttatttttttaaaaaaagtttatttgactcatgattctgaaggcttgaaagttcaagactgggcatctgcatctggtgaaggcctcaggttgcttccacttatggcagaaggtgaaggggagcttgcataggcagaaatcacatggtgaaagaggaagcatgagagagggggaggtgccaggctctttttaacaactagctctaatggaaactaatagagtgaggaagggcattaatctattcatgagagatctgcctccatgatccaaatacttcctattaggtcccacctccaacactaaggatcaaatttcatatgaagtttaaaggggaaaaaacaccgaaaccatagcaggtggttttaaaatatgcacatcaattatttgatgcacctcccttcaagagtggagcttaattttcttccgtgtgtgtgtgagctgtatttagtcacttgctaccaatgaagagaatatggaggaattgtatgattttcaagcctaggtgataaaaggtatcactcactctgggaaaagccagctggcctatcaaaaggatatttcacaaaccccatggggagacccatgtgacaaaggactggggcctcctgccaacaaccatgtgaatgagccatcttggaagcagatcttccagtcccagtcaacacttcacataaacacagccccagtcaatgtcttgacagcaacttcctgagagatcctgacccagaaccagagctaagttgcttcagaattcctatctcacagaaactgtgagataataaatatgttatttgaagttactaagtttcagtgcaatctgttacattgcaatagataaccaatacagaggggcaagaaacagagggaggaagataacaaaaggtcaagattatgtgattcaatgatgcattagagtttgggcaatcctgaacacccaggggatacccgtgtggtagtaggcaagtcataagatatgagaaggggttggggtaaagtaagagcaaggagggtcataagttatttacaatagctcttttgcaaaggaaagaaatactgatttgagggtaaattcattttcccaggttattacatagcttgacagcactgtatgtgatgtatcaaagggcacccaagaacctgaagcaataatgcatcatccaaagtcaagtaatttacaatttactcactggcaagatgagactactgtatcagagagaatcaaaagacatccctcatcgtgtggaaagataagtcaggaaagtcaaaatcatttgcagcaaagcttgtttctgtaatagttgtggattcagaagtagtcttatttggacatatgatattcagcaggacttttaaagtccttttgctattttacatagttcaataaggttttttgtgagagtatgatgttattaatatggactgtattaatgtgaggctaagagttatatgtaatatccctttgcctatttatcttacatcaaaatggtatttatatcttaatgagcaaccatatcctcctgcagatatagatctttgagattccattattcgctcttccttatttagggtttcagttagggaatgtccagattcagaactcaagtccccactgaattccatataccatgctctaatgagtctgttagagaaacactgggaagataataggatatactacctttattcttaccagtaaatcacctccccaggtaactgttcttacaataaaactaccagctgggtggcaagtctctagaccaagataaggttgtattttagccctcttgtgcattcagtacatatcttaaaaatcataagaaagatgaaaaataaaataaactcctgctgaataaaggataatagaaagaaaaataagaaaataatttgagaaaattctttgtaacacacctctggcattgcagttaatgctataaaaggcctttgtttctttaagaaaatgaatttatcacaccagttactgataatccaatctctgcccaactggataactgcccaaccaactttcttcatttgataattatttgtaaaatatcccctttcaaaaatgtatagaaatgtctatgtcaggacttcccaaaatggttccctttgttgcaatattttccttactgccgccataacctcatagcctctaagtccttttgccaagaaccaaaggagagaagagaaagggataaaaatgggtttaaaagtaggattagagtggcaaatgagagaaaaattagtaaaataaataaataggagtgccataaattttggagaatgctctggaatcatttttcaataaccctgtgactggggtcctgagcccacttataagctcaacagacctggtctcttattgcgagaaacccatttgtgacctcaggcaggatagactaaagaagctctggctccatgatctgtgactgagcatgaaatcaacctaatggtcctgtggttttgtattcaggtatcttcactctgtctccaatcccaatgtctgccttcatcacatccctgatactgggacccttatgttgaactgcatgctttagaccctcagaaacagggtactccctcattctgcctacatgcttacctccaaggactcataaagttctgcttttcactgttatctgctcatagattttccatcgacatgttatgaattctacctccaggaccatctaattcactgttctgccaacatcctcagccaatcaatagccttaacaagtgctagttgacaggagctagatttttccagaaaggctggaattctgtctcatgtctaatcccattccatacctgcatcccgtttcctgaattccagttcttaccccatttcagactggcccatttcattgttattacgtcagaacatgtcctgagatacaccattttccttactcagtgtgaagcaacagaattaaatgcaaggcttacatttctcagaatataaatggagaaaagcttttttttcttcagtccatcaaactccaaatcaatcctgaggccaatttgtttgtctttattagaaaaatggtactgttttaaagggagagattttgattgactgattgatttaccagtctcaaactaatgttgagttgtaaatagcaatggcatttctaagaactgtgctgtatcttcaaacatgaggtgatggatgtctgtggagtttcatcacaccaggagagctgtcacaccacttgcttcattctatatgctctactggtttgctagttaacagttatacaatatatatttgctcactctccatgcaaacagataaagactaacaattaggagctcattattatttgggaaaaaatccttagcaactcagcaatatacactttaaaacaaactggtatccaaaagatgaatgatgctctcactctttctcagtagtaatgccctctttctttgagtatgtgattcagtttcaaaatatcactagcctactaactctttatgctaaaagaaaaagtctagtattagagaagaaaaacaatgaaaaaatgaagtttcatgattacttttgttaaactcttacgtaattattttcttatctgcaaagcaagagtgaatgtcagttgcaggaaaaaaaaaatgtgtccaaaactttctccaaccttaacaattcatcagggccaatgtacccgagaactagagaccaacagcccaaacagataggagtgagtaaagttattactatcatacttgtcagactgaatcttttgtctatagcttctgtcatccccaaatctttgtaacttcaactccctgaatccctatgggtttaatctgacttacttttagaaccatccctaactaagtcagctgtcatgcacagaaccagaggaaaagatcctaggaggaaggcccaggaaatgcaaattctctgaggtagtggagtgctttgcagatttgaggacaggaaggaggttactctccctggaggctggagttcaaggttacgtgagatgtgtgctaggcagaataacagccctccagagatgctcatgtctgcaggaatctttaaattcataccaaaaggactgtgcagatgtgactaatggtatagacacaaagagagaaaattaccctgggttatatagagggcccattttgatcatgggagttcttaaaagtggagacgcttcccaggctgtggtcagagaaagatgtgactatagaagagtggtcagagaggcaacagcctgaagtgtataagatggcttattgctggttctgagctgtagtggcccatgtgcaaggactagataaaggcctcaagaagctgagagtggcctggatgtcacccagcaaggaaataaagacatcagtcccacaaccacttggaactgaattctgtaaacactttaagagtaaggaaacagattctcccctggaacctccagaaaggaagccagccctcctgacacattgattctagcctagtgatgtccatgctgaacttctgacataccgaactatgagaaaataaatgtgtgttgttttaagccactaggttgtggtaatttgttatagcaacaagatacacctagatgactaagctatacaggtaccagatcatgcaggcctttcaggtcatggtagtttttcattttttttttttaagcaatggggaaaaaataacaaatattaaggaggaaaatgattttcctaaaagattactgtggaaaagatgcttcacaacctcatagagaaatgcaaattaaaacaagataccactacacacctattagaatggttaaaatccaaaacactataacaccaaatgctggcaaggatatgaaacaacaggaactctcattcattgctgctggggatacaaaatggtacagccactttggagaacagtttgacactttaacgaaattatacatactctcaccatacaatccagctactgcgatccttggtatttgccccaaaggagttgaaaacttatgtctacactaaaacctacacacggatgtgtatagcaacttcatttatacttgccaaaatctggaagcaaccaagctgtccttcacttagcaaatagataaataaactggggtatatccagacaatggaatattattcagtgctaaatgaaatgagctatccagccatgaaaagacatggaagaaacttaaatgcatattactaagtgaaagaaggcaacctgaaaaggcttcatactgtatgattccaactataacgttcttggaaatacaaaattatgaaggcagtaaaactataaatacatccagcagatgccagagcttgggtaggagagagggatgaataggtgggacacagaagattcttagagcagtaacactactcggtatgatactgtaatggtagatacatgtcattgtaaatttgtccaaacccacagagtgtacaacaccaggagttactactaatgtaaactgtgggctctgggtgatatgtcaatataggttcagcaattgtaacaagtgtaccactctggtagggatgttggcaatgggggaggctgtgcctatgtgagtgcagtgtgtatgtggtaaatctatcttccattcgattttgctgtgaacttataattaatctaaaaaataaagtctattaaaaaaagaaaaaaagatgaccgtggctcctaagtggattgtatgtgtagggtagcaggtacttgcaagaataagaaacagcaagattggagctgaattttagaggcagaactataagattttatgatgcataaggtatgaaataagtgaacgagagggagaaatcaaaaagggcttttgtgtttttggcttgagaagaagaaaagctgagagagatggggaagatcaggggaaccacagaccttttttttttttttttttgagacagagtcttgctctgtccccaaggctggagtgcagtggtgcaatattggctcactgcagcccctgcctccggggttccagcgattctcctgcctcagcctcccaagtagttgggattacaggctcacgccaccacgcccagctaatttttgtatttttagtagaaatggggtttcaccatgttggctaggctggtcttgaactcctgacctcaagtgatccacccgccttggcttcccaaagtgctgggattacaggcatgagccaccgcacccggccggaaccacagatttaagtgataatttggaaagcaaaatttccattttggacatgtaaggtttgaaacaacctttagacatctcagtggagatgcagaatagatagataaatgaataaatctggagctcagggttgaaggcttggcagttaatataaacttgagaatcatcaacctacaggtggtttcaggctcatggaacggaataatattacctaagtagagaagtatgcaagtgaacgtaggaaaagaggagaggctctgaggcattcaaagatttcagaatcaaaaaaaaaaaaatagtagcaaagaaggaggagaacatgaaaacatttcttttaagtgcatgatggctaggagggcaagaaaggagagtggttcaacagagaaagtaggcaattgtattgatactggtgagagatggggtaagattaaggcaaagcaggacagtagatttggtagcatggagatcttcaacaagaacaatttgaagggtgcaatgggagtaaaaagagattgaagtgggttgaagagtgaatggtgtatgaggaattagcattgatggataccgacaaaacatcaaaaaggttagtatagaaagaacggagatgagcagttgtggtttaaggaaggtccaagagaaggctttagattattctctttttaagaagaaagattttgaaaaatcttggtgaactattaggaatgatttagtagggagagagagaatggtgatgcagggacgatgccaccactgaaggactgaagtaaagccctttgaaggagtcaaggtgtgaaattcagagcacagagagaaggagcaggggcaggataagagccatttgtgtgccccacccacctcaattctagaagagacctctggccagtccccaggctcatctccaacctaaggtatagttcatattaaaactccaacccttcccctcccatcttttcctcatggacttgtgagtggaagtattaccatatctccaatccaaatcttaggaccagataagaataattctggtaagctatttaccccactgtaatcagtatttctatttgagcttttatttcaattgtgcatcaaagatgttaatatagagaccattatgtagaaacaaatatattttactttatttttacatattaaggtgaatcatacagcttggaagacattgaaaagatgaagggaaattgaaagaaatgcaggttaggcatttccgtagaaatcagtctaagtcaatttaagttcatgatgagggtctgatagctctcataaagcaactctcactatggaaggcctcattcaaagaaagtcaaacttttacacaaatttctaaaacagaattttgaaggatattttgattatatcattcatcatttttaatcacattctgaaaaacttcaaactttgtcttcactgtaaggataatcagtcaatttgttttatcctaaaaaaactagccatttcccttgtagatgtcataagctgcttctgtaccttttccatgatttcattttattttcttgtatgtagatttcagagaaagttctcactttctgaaacagtgaaagcaagaaagaaagagagggaaagataagttggaaacgagagaatgagagagactttttaaaactacggaatgttttacaaatgtagagtgtgattgtatgtatataaagcttagcctaagtcaccactcaaataaagaagttaccattcctgtaccattcctgtctgggctagaaatctcttaatgcctattttctgaaatttaacaaatcaaggaatcacaaggcaccataagttcagataagggaaaaaacactagactggatatctagaagccgcattttagtctgccattgccaaacatgtaaccttgtgcaaatcactttacctgtcttatttatactgatctatggttttgcctattgtataataatcactaaataaaaaaccaaaacaaaaatgttaaaattattaaaattttagacacttattctgaaaacagaaataaccataattcctttacatcttttatttaaaagctgagaacccctatataagaaaggagaaggaaagctttaagtacaatggcaactaaaatggcggcacaaacaaaacgaaattgcctccaaaacactgaacttttaattacggacgatgtcaaaatgcaatgtgttcctttagcttcattattttgaatctgtttcttgtttcccaataaactgaataaataaacagtgatttttaaaattaattatgtagtgcaatttccctcccggaaaaccaatatagcttaattttcattaactatattgtaaatcgcattactcttttggaaaacgttcaaggatgcttttatttataaaccaatagatgagaactataatgcatttatagtaagtctggacacttttacagggggcttcctatttgaaataaccaagaagtagaattcaacaatgatatttttccttctaaactttttaaagtgaaaaaatccaatatattcttgaagtcagaaatagtggcatccagggttaaacttcagcattcatgatgctaattagctagccatgactgtatgtataatgaagatattaagctttctctaagaacactgcaacttgaaattcaaataactaacgttatggaataattgtgaaatatgatcaactgatttaaacactacgaaaatgtagcacaattccctttcaagaggaagaacaagtatattctatagacaaatgccaaaatcagaattagcacatagtcaagaaagaaggtgactaagagtacactggtaaccattttgaataaatcactttaaaactagtcacagtgtgaatgagcataattatatggctctcaactctgctcatgtttttctctttcacttgcaaatcccctcaactgtcatgtttagttgtctctttgagatgttactatacatggtaacagatgaatctgctcttctgtgagttttatatttataaatgatcttagctcacgaagccatggcattaaatttacattagaaaaggtttgacccttgggtccgtgcatgcagttctctgttgcagaaaagcattacaaagctctctatagggagatctgaaaagacatcaaaaatattttgaaatgcagaaagcagccaagatgccctataccttttcattgcttgcactgattaaccgcttacataaaagaataactaaataaactaacaagtgatccccagagagaagctgtcttaacaagaatgtttaattttggccctctgagttcttctagaaggatctaaataattatgtgtaatgtctctaacaaccagagaattgccaataaaagaaattcaataaactcagtctaaagcatagattaaggtacaaactttctaggggagacaggccaagagaatattgtaaacaacagaatttcaaaaaaaaaaaaacccatttaattacagtgacttgcacttactagctacttatgagtgttgatgacaaagactaagaaaagtaagatttacaagataagattagagaattgtttactctgtccagcaaatcaatggggggaaaatatgagggaaacctaatgtactcaaattcaatgcaagatgaatcttttcagtactgaatgaaatactcaaattattctggctacatactaagtccttttgatttgtcgtggatactacctaaaagaacacagataatcaagactgagtccaaggaagtccttctgccagaggtcagcagaaaaagtttacaagttctttgcaatagcagcacaatttttctcatccttatgttttttgtatctaatgctgtaagaaaagcaataggtgtttaatatatgtatttttaaaattctctgaatcaactggtatcatctacaaatttatttttggagaataaatcataacagaaagaaaaaagttattgcatgttaccttaaatcatgtgtctaacaaaatatatacaaataaaacaaaaatattaattaggtgtttatccatgaatttattagatggtgtcacatgttctcaaaacaacttcagaagtaatttatacacgttaatttttataattaaaaaaaagaaagctgagttgcagagatggttaataacttgagcagagttttacaggtaaaggagtttgaacagaactcatgacagggaacaataccggaaaccatattctatccactttatcactctaaagtctatccagaaccctgattttctgtttctttaagttgcttgttcttatgtcttcttatataagcctttattttacaagcttccctctctcttcctttctcttaaatatgtcaaaatgttacaaaatatctgactcaagcttgtttcttcattgagaagattttaaaagttatctaaaagacaaaagaaagaacttaaagatataaaataagggcaacttaatatagtataaacaaaatatttttgtaaccggatgttaaaaaaataataaaacattttagtataggagtctatatacttactgaaaaattaattttcttattcctcatatttgtgtgaatgtatattttaattaagacatttgcaattatatttctgataatacgtatcactgattacattgtagattttttcaaagcacaacaagctcaacaaagaaaggaaagacatagaactatgcagtttgggctttatttatgcataattaaaaccaattagctgtggcaccaaatcaaaaaatcttgtttcccttgaagcaagtctttgtagatactaatactgtaatttatgtgtatatatagtaggcgtttcatttgcaagaagtttagaaaatgatcagagcattttcaatattgaaaaatgaagaaattcacaataaattatatatatttatatataattgtgccattggcgagagctatagagaaaaagtgaaacaaataaacaaaaaaaaaaaaaaaaaagaaagtgtcctacttggaaatgtagcccctgaagaagatgcatcctcaattccatctttcacttctctagagcatagaagggtctagaactaaatataatcctttcggagtgacctctggttacattgggtctcaaagtcccaaaagctatgccccaattctcacactttattgtgtgagacaggaggcatgaattgcagtctttttgttacaaaccagctgtgtcactatatcttgcaagactgcaggtacctcatccgtcaaacattgggtatcaatggatcttcaaccaatgcctttaagagtactcaaacttttatgaagtagatcaaaaatggattatcagtaaaatcaagaaagatttgttcattaagcgggaaaatgttaatattaaaaatttcttaatataaaatgttctttcacatattatcttcacctttattatctttcagcttctttctttcttttatattccaggagagagacatggtatgctattacaattaacagcacccaccctggagtcagactgcctacatgtgaatccctaccattcaccacctataattgatacagtccatttctttatgcctcagttttcctcgtttataaaatgaggataatacaagtgcttctttataaagaagccaggaggattaatggaagtaatacacataaagcactagaacagtacagacctaagcatcacataaacaatagttgggccaggcatggtggctcacgcctataatcccagcactttgggaggccaaggtgggaggataacctgaggtcagaagttcgagaccagcctgaccaacatggagaaaacctgtctctacaaaaaaaaaaaaaaaaaaaaagaacacacagaattagctgggcatggtggcacatgcctgtaatccaagctacttgggaggctaaggcaggagaattgcttgaacccaggaggtggaggttgtggtgagccgagattgcgccattgcactccagcctgggcaacaagagttaaacttcatctcaaaaaaatataaaataaaataaaataaaatagttgccataaacaatgcatacaataggaacaagtttagcacaagatctgatatttattctaaaattcaaaggtaaatactgcatggtgctccacaaagagtgccatgactttcttgtgccttacaactgaatatatccttccttctaggcctaaatagctataactctgttatttaagtaggctaatggactctataaaacagaattcatattttgtttctttcatatttctagattacataacaagtttagggggtgtggttagccagatgatggataattgggccacagctttgtttgtttttgtttatttacactaataatgatattttattaaaggctgcaaattttatggtgtatccaacaggctgtgttctgatatttaagaacctgactgacagtaacatggactacagatcatttcttaaataatgctggtaaataactgaatgaagagtggtttttataaaacctaactcctgcctaaaaggttcctttttttccctttctgggccagtgagaatcttccaggccacacccatagtacaaggacttcaccagtcacggccttcctcatctgtttctctagcctcctcttgctagcgtccatgctctcatttcatcatccatgggacttcttgtatgcctttccctcttcctgaaccttcctgtttctacctttaacctggttaacttctgaccattctgtaggagtcggctcaaggcctctcagtcttgagttttgtgttccttgttgcgctcctgcagtagcaccccatgctcacctccattagtccttaccattgaggagcaatccttgctttaagtgaattctctgctactgcatctgaagctccattctgacagaagctgtggtgtattaatcttagtatccaagaacatcacccctacttttattgagttctcagcaaaagtttattgaatgaatgaatgagattacccatcctgaatcctgataggtctcatgcttaaaatgtctgctttgtgtgaaaaaaatgagaaatattactaaatattgttataatatattattcctatgaaaataagcaaagtgtttaagcatatacagtatgctaccttttatatatataggaaaatataaagatgtgtgtgtgtatgtgtgtacatatatatattttaaaccaaaaattaataaaagtggggatatccatgggaagaaaagggacaaagtaaagcaaacaagataagttacacttctccaaatgtgctttactttgaggttttgactttggaaacatgaaaatgtttcaaataattattaaacaaaattaattcaaagtaaaacagtaattcataaaaattaaaagaaaatttaaaaagggaatataactgtgtatggattggtagtttaaccaacaacaaattattttaaaaggcaaaaaccaataacttgattgtatactcctggtgggtattttctaaggacaatgaaaaatgcaaggaaatcttaaatcatttttattcatcaaattgttaataatatgagttactcttagaatactattaaattgttgcatatatagaatcatataaaactaacacttttagtttaagagaaaagagataaacatatgaattaaaattgaaaacaaaaacctataaactcaaacttaaattagaagtataaaaatatcaacataaacatgcaaaatatttctctttcaaaacttctcttcagaaaagacctagaaacagtgactaagtgagaaatgaacatttccagtacctggactgtggatacaaaaggaaccaaggtgccttattgatatggttatgtcctggtcaggtcagaaaatataagagaagaggctaatttgtcctaccagaaagtgaaaatgtgctaatgactagtggaatcatatcaaaaggactcaggagcaaaagtgaaagaattcctattggcaaatgagataaactgaacatcataaggaacaataactgcaatggattgaaaaataccaaatatcacaaaatctatgcagtcataatgacatttaaaaacaactcaatggtcatatctacggaattttagagaaccaatcacttatcattagagagagtagcttgcattatttctgccttctctgtacaaaatgtgactcaatataaatacacacataatatagtaaggttgttctttgtagaatcagggatttcagaataaaaatcctaaaattcatatggaactacaaagtatctgtaaagctaaagcaattttgagagagaagaacaaagattgaggcatcatatttcctgacttcaaaatatactacaaagctacaatagtcaaaacagtatggtgctggcaacaaacaagcaaacaaacaaaaaacagacagaccaatggaacagaatagagcatccagaaataataccacacacatatacttaacatgagtgccaaaaaatacacaatgaggaaagatagcatcttcaacaaataatgttgaggaaactggatatccacatgcaaagaacaaaactggatccttacctcacactaacttaccacacactagacacaaaaatcaactcaaaatagattacagatttacatgtaaaatctggcaatgtaaaactcctagaagaaaatataatgggaaagtttcatgacactgagcttggcaatggggcaatgatctcttggatatgataccagaagctcatgcaacaaaagcaaaattagatgactgggactacatcaggcttaaaagcttctgcactgcaaagaaaacaataaacagaatgaaaaggtaatctatggaatgagagaaaatatttacaaatcacatatctgataagagattaatatccaaaatatatgaggaacccctacaattcaacagcagaaaactaaattatccaattaaaaatgggcaaaggacttcaatagacatttcttcaaagaacacataaacatggcaaacaggttatatcaaacagtaacttcactaactataagggaaatgcaaatcaaaattatgagttatcgccacacacctgctaggatggctattatagaaaaatacaacaacaactcaaatgtcagcaaagatatggagaacctggaacctttgtccactgttaatgagaatgtaaaatgacacagcttttgtggaaaacagtatggagtttcctcaaaaaataaaaacagaattaccacatgaccaagcaatcccacttctgggaatatattcaaaagaactgaaatcaagatggtcgtttccaagatggccaaataggaacagctccggtcggaagctcctagcaagatcgacgcagacctgcatttccaactgaggtacctagttcatctcattgggactggttggacagtgggtgcagcccacggagggtgagccaaagtagggcggggcattgcctcacccaggaagtgcaagggttcggaggatttcccttttctagacaagggaagccatgacagactgtaccgggaaaaacggtacacttccccccaaatactgtgcttttcaatggtcttagcaaccggcagaccaggcgattccctcccatgtctggctcagcaggtaccacgcccatagagccttgctcactgctagcacagcagtctgagatcaacctgccaggctgcagcctggcagggggagaagcatctgccactgctgaggcttgagtaggtaaacaaagcagccaggaagctcaaactgagcggagcccaccgcagctcaacaaggcctactgcctctatagactccacctttgtgggcagggcatagctcaacaaaaggcagcagacaacttcagacttaaaggcccctgtgtgacagctctgaagagagcaggggttctcccagcacagtgtttgagctctgagaacaaacagacggccccctcaagtggatccctgactctgtgtagcctgactgggaggcacctcccagtaggggccgacagacaactcatgcaagtggctgcccctctgggacaaagcttccagaggaaggatcaggcagtaatattttctgttctgcaatacttgctgttctgcagcctccactggtgaaacccaggcaaaaggggctggagtggacctccagcaaactccaacagacctgcagctgaggggcctgactgttacaaggaaaactaacaaacagaaaggaatagcatcaacatcaacaaaaaggacatccccaataaaaccccatctgcaggtcaccaatgtcaaagaccaaaggtagataaaaccacaaagatggggagaaaccagaacagaaaagcagaaaatttcaaaaaaacagagtgcctcttctcccccagaggatcacagctcctcgccagcaatggaagaaagctggacggagaatgactttgacaagttgacagaagtaggcttcagaaagtcggtaataacaaacttctctgagctaaaagagcatgttctaacccatgggaaggattagaaaaaaaaccttgaaaaaaggttagatgaatggctaactagaataaacagtgtagagaagaccttcaatggcctgatggagctgaaaaccatggcatgagaacttcatgacacaggcacaagcttcagtagccaattcgatcaagtggaagaagggatatcagtgattgaagatcaaattaatgaaataaagcaagaagacaagattagagaaaaaagagtaaaaagaaatgaacaaagtctccaagaaatatgggactatgtgaaaagaccaaatctacatctgattggtgtacctgaaagtgacacggagaatggaaccaaattagaaaacactcttcaggatattatgcaggagaacttccccagtctagcaaagcaggccaacattcacattcaggaaatacagagaacaccacaaagatactcctcgagaagagcaactgcaagacacatacttgtcagattcaccaaggttgaaataaaagaaaaaatgttaagggcagccagagagaaaggtcgggttacccacaaaaggaagcccatcaaactaacagcggatctctcagcagaaactctacaagccagaagagagtgggggccaatattcaacatttaaagaaaagaattttcaacacagaatttcatatcaagacaaactaccattcataagtgaaggggaaataaaatcgtttacagataagcaaatgctgagagattttgtcaccaccaggtctgccttacaagagctcctgaaggaagcactaaacatggaaaggaacaactggtaccagccactgcaaaaacatgccaaattctaaagaccatagatgctatgaagaaaccacatcaattaacaggtaaaataaccagctaacatcataatgacaggatcaaattcacacataacaaaattaaccttaaatgtaaatgggttaaatgccctaattaaaagacacagactggcaaattggataaagagtcaagacccatcagtgtgctgtattcaggagacccacctcatgtgcagagacacacataggctcaaaataaagggatggaggaagatctaccaagcaaatggaaagccaaaaaaaagcaggggttgcaatcctagtctctgataaaacagactttaaaccaacaaagatcaaaagagacaaagaaggccattacataatggtaaagggatcaattcaacaagaagagctaactatgctaaatatgtatgcacccaatacaggagcacccagattcataaagcaagtctgtagagacctacaaagagacttagactcccacacaataataatgagagactttaacacaccactgtcaatattagacagatcaatgagacagaaggctaacaaggatattcatggtttgaactcagctctgtacccccaagcggacctattagacatctacagaactctccaccccaaatcaacacaatatacattcttctcagcaccacattgcacttattataaaactgaccacatgattggaagtaaaacactcctcagcaaatgtaaaagaacagaaatcacaacaaactgtctctcagaccacagtgcaatcaaattagaactcagggttaagaaactcactcaaaaccacacagctacatggaaactgagcaacctgctcctgaatgactactgggtaaataacgaaatgaaggcagaaataaagatgttctttaaaaccagtgagaacaaagacacaatgtaccagaattttgggacatatttaaagcagtatgtagatggaaatttatagcactaaatgcccacaagagaaagcaagaaagatacaaaatcgacaccctaacatcacaattaaaagaaccagagaagcaagagcaaacaaattcaaaagctagcagaaggctaaaaataactaagatcagagcagaactgaaggagatagagacacaaaaaaacacttcaaaaaatcaatgaatccaggagctggttttttgaaaagatcaacaaaattgatagaccactagcaagacaaataaagaagaaaagagagaagaatcaaatagatgcaatacaaaacgataaaatggatatcaccaccgatcccacagaaatacaaactaccagagaatactataacacctctatgcaaataaactagaaaatctagaagaaatggataaattgctggacacatacaccctcccaagactaaactaggaagaagttaaatctctgaatagaccaataagaggttctgaaattgtggcaataattaatagcataccaacgaaaaaagtccaggaccagacagattcacagatgaattctacccgaagtacaaagaggagctgataccattccttctgaaactattccaatcaatagaaaaagagggaatcctccctaacccattttatgaggccagcatcatactgataccaaagcctggcagacacacaacaaaaaaagagaattttagaccaatatccctgaagaacaccgatgcaaaaatcctcaataaaatactggcaaaccgaatccagcagcacatcaaaaagcttatccaccatgatcaagtcagcttcatccctgagattcaaggctggttcaacatacacaaatcagtaaacataatccatcacataaacagaaccaacgacaaaaaacatacaattatctgaatagatgcagaaaaggccttcgacaaaattcaatagcccttcctgctaaaaactctcaataaactaggtattgatggaatgtatctcagaataataggagctatttatgacaaacccacagccaatatcataccgaatggacaaaaactggaagcattccctttgaaaaccggcataagaaaaggatgccctctctcaccactcctattcaacatagtgttggaagttctggccaggacaattaggcaagagaacgaaataaagggtattcagttaggaaaagaggaagtcaaattgtccctgtttgcagatgacatgattatatatttagaaaacccccttgtctcagcccaaaatatccttaagctgataagcaacttcagcaaagtctcaggatacaaaatcaatgtgcaaaaatcacaagcattcccatacaccaataacagaccaacagagagccaaatcatgagtgaactctcattcacaattgctacaaagagaataaaatacctaggaatccaacttacaagggatgtgaaggacctcttcaaggagaactacaaaccactgctcaattaaataaaacaggacacaaacaaatggaagaacattccatgctcatggataggaagaatttacatcatgaaaatggccgtactgcccaaggtaatttatagattcaaagtcgtcctcaccaagctaccaatgactttcttcacagaattggaaaaaactactgtaaagttcatatagaaccaaaaaggagcctgcatagccaagataatcctaagcaaaaagaacaaggtatcacactacctgacttcaaactatactacaaggcaacagtaaccaaaacagcatggtactggtaccaaaacagatatatagaccaatggaacagaacagaggcctgagaaataacacatccacagccatctgatctttgacaaacctaacaaaaacaagaaatggggaaaggattccctatttaattaatggtgctgggaaaactggctagccatatgtagaaagctgaaactggatcccttccttacatcttatacaaaaattaattcaagatggattaaagacttaaatgtaagacctaaaaccccaaaaaccctagaagaaaacccaggcaataccattcaggacataggcatgggcaaagacttcatgactaaaacaccaaaaacaatggcaacaaaagccaaaatagacaaatgggatcaagttaaactaatgaccttctgcacagcaaaagaaaccatcatcagagcgaacagacaagctacagaatgggagaaaaattttacaatctacccatctgacaaagggcttatatccagaatctacaaagagctcaaacaaatttacaagaaaaaaacaaacaaccccatcaaaaagtgggcaaaggatatgaacagacacttctcaaaagaagacatttatgcagcagccaacacacacttgaaaagatgctcatcatcactggtcatcagataaatgcaaatcaaaaccacaatgagataccatctcatgccaattagaatggtgatcattaaaaagtcaggaaacaacagatgctggagaggatgtggagaaataggaacgcttttacaccgttgatgggagtgtaagttatttcaaccattatggacgacagtgtggcaattcctcaaggatctagaagtagaaatgccatttgacccagccatcccattactgggtatatacccaaaggattataaatcatgctactataaagacacatgcacacgtgtgtttattgtgacactattctcaatagcaaagacttggaaccaacccaaatgtccatcaataatagattggattaagaaaacgtggcacatatacaccatggaatactatgacgccataagaaagatgagtgcatgtcctttgcagggacatcgatgatgctggaaaccatcattctcagcaaactatcacaaggacagaaaaccaaacaccacatgttctcactcataggtgggaattgaacaataagaacacatggacacagggcagggaacatcacactctggggcctattgggggttggaggactggggaagggatagcattaggcgaaataccgaatgtaaatgacgagttgatgggtgcagcaagccaacatgccacatgtatgccaatgtaacaaacctacatgttgtacacatgtgccctagaacttaaagcataatttttaaaaaattgaaatcaagatcttgaagagatatctgccctcccatgttaattgcagcaatattcgtaatagtcaagatataacaagcacctaattgcccattgatcatgactagataaagaaaaacatggtatatacacataatggtggagtagtgtttggcctaaaaacagaaggaaattttgctacatgcattacgctaagtgaaataagccagtcatggaaggacaaatacataatttcacttacatgaggtatctaaaatagtcaaattcacagagagtaaatggtggttgccaggcattgggtgaggaggaaagagaaaattgctttttaatagctataaagattcatttataaaagataaataaatcctacagatctgtgtacaacattgtgcctatagttaataatactgttttgtgcacttaaaattttgttaagaagtagatctcatgttaagggttcttaccataataaaaatattttaataaaaactttagaattccagctaataaatgaaaaaggaataacagaatattactattttacaatctctgttgaacaaatagatctatgtaataatcatcagtgactactaaagcattagatgaatagttgacagggaacttgataatgggtgaatcaggccaaccacacttaaatctaaggatcaatcttaacaccataacgaagagatattagatattatgggcttcctgatagaatgcagtagaaggaactcagcatcttgaatgaagtattcttgccaaaacatcaaacctggatctgatcaaaactctatgcctagaaatagcttacaggaagcaaaggatcagaggaaaattttaagccatatcatggagatgcattcaacaacatccaaaagtgggaaattctacaggacaaataacccagtttctttaacaaatagaatacaagtggaaaatagaagagaaagtctatcttcaaaagtatcttcaaaggtccacttcagagtgtcttttggtagtctgcaccagtctttcaagtttaaaggaattgtagacttatattaatctacaattaatttttcgatacaatatgaggaactacttttgatcctgtttcaaaaattgacagtgtgtgtgtgtgtttgtgtttgtgtgtgcatattgaatttggtgttgactggtatttgattcgaagtcatcaaatttttgctaactttttaaagtagaatgatagcattatagcatttttttttagtgcgtctcttttagagttacactgagatgaattatatgatgtttgagatttgcttcaagatgatccatgagggtggggtataactgggagtataagtaaataaactctggctttatgctagtaactgctgacactgagcctgagcgacacatacagggaagtccattaattattctcttgacttttgtgtatgtttggaaatttacataacataatgctaaacaataaaaaacattaaaatatagaattagatacaaaaaaatcctactgaggttttgatcaggctgcattgaatttatacactgattaatttaagctattgattctttcaattcaaaaatgtatctctgttcattctgtccctcaataacatttctcttgtcattagcattgccactttcatttctattttctaggtataaactgtgcacatttcttaagcttactcagaggtaagttataatttgtgagatttttttcaatttcactaatttgtaagtctttttgtgttttagtaacaataagcagtttgaaaacaaatatgaagcaattgcttttgtatacttactttgtaattttcctagttgttatactctttttctggtactaataacttttcacttgagcctcttagatatttcaggtagacaatccataatctacaaataaatacttctttttctcctctctttgaaaaatatgtgctgacaactgtattgaaagggttgatatcctttcagttgcttcctgaaatccttattttgagaggatttccatcttaaagcaaagaaaaacttgtattatgttcctgccagacttctagctctcaatatcccatgttaggaactttcagatttatatacctgatgagtttgcgcaatgatttaagttttctattcactctaccatcaattatagttcagagaacatcatcaatatcaagtagttgggaatatctaccccaacagatatcaaaacatatgtgccactaccactggaagattagataagtgaaggcttccttgattcttattttcaagctgatgaaataaggtaattaaattaaaagaaacccagactgtcccttgtcataaagcaaatatggtgaaggctatcataggaactgaccaaaaaaattaaagccaatctcaaaacatccatatgaattttcttaacatgagggatgtattttgtagagaagttacattatgatttcagaagacattatcttggcttcactacacatagcacatctgggaattgtctacttgaaagtcttggctagaagttctatttgatggcctcaaattaattctgatattgaaaagtctaaaggaagttagtacatgccacatgccaggctacttggcataactgagtaagacacctaattttccagtgggaaaagaccaaaagagttggaccaggacttcacattgatcttgttatgagatgaaaactttgccctttagtatactgcttctcacagtgacatcaagtctttcacttctacctcaagcctctgggatgacaatgtgactccatgccagtttcttgtagcatacaggctgccagacacaattatttctgacaacaggctcacatttctttcagtcaagttagggtatttgtggacaaggatctcatcaaagctgtcaccattgcatttcacctgctttaccgaatgtttagaatgaaaggctggtgcagactaccaaagacactatgaagtggtttttcatcgtccaatatgttatggatgttctctaagaagtcctggtcatgctgaatactacttaggttaagtttcctaacttgtgtcaaccatctctatcgagcataaactgagaacttataaaatgaataagagtattctagctgctgctatggctagattaatcattgtttttttttaaaaaaattcatttttattatagtagttttgctttgctggcacttaattcaggtttttcccctgtaagttgagtctggatagtgccatttttatggagtcacaaagcaccctgtgcttttttcatgctagcactccctacacacattgtaacaagtgtttatgatatgccagattagattgtaaacgccacaagtgtggaaatgtatcttttctcttaattcttcagcacctagaatgggaagtagcacatggtagacatatgaggaccagattacaaacagtcatttaaatgaggcttcttcaagctggattttaaagccagccttcttgacacggtattgttggcaagtttttatttatttatttaggctacaggtatttccagtaaggtcctcattgaaagcccacttaagctaggagccacttgcgataatactagaggtaagaaacaggaagagtaaacagctccaaataaggaattgtccccaaattgcccctgtacatgttgacaaacaccccaaatcaggagtaaatacaagatcactaccagccgggcgcggtggctcattcctgtattccctgcaatttaggaggccaaggcagatggatcacctgaggctgggagttcgagaccagccaacacagagaaaccccatctctactaaaaatacaaaaattagcagggcatggtggcacatgcctgtaatcccatctactcaggaggttgatgcaggagaattgcttgaacccagaggtggaggttgtggtgagccaagattgcaccattacactccagcctgggcaacaagaccaaaactccatctcaaaataaataaataaataaataaataaataaatcactaccttcggacacaaatgaaatttccttcagaacaggaaatttcctccaaccaattactcagattggaagcaaataagagagcaataaaaatccatctgcaacacttgttagtcaaatagagaccaaatggtgaaaaatacaccagtactctggttaattggcccaaattttgagtgagtttcatgcttagtacatactttccgcttgcacttatcacatcttgggtaacagatttgtgaatcaactacaggtattcccagagaaccataattatgataatgatatagccattaggagtagctacttctgcatcatcttaatgttttcttttcaacacacatatattgagtatccattatctgttaaaagtagaattcagagatgaatgaaacaccacaatccctgaatttaaagaatattctatggggaaaagggcaaataaacaatttaatactatgcatttatatggcatatataaatggtttataaaagtgcttatgaggaagtcaccaaaatccctagaaaatgtttatgaagattataatgttttagatacatcttatagaagatttcaccagataaaaactaaaggaagactattccaataagagagagtagcataaacagtgatttaaagtcagctagaaaatggcttgttcggggaataataaataataaatacttacagtgtggctgtattgcaggtatgcatagcatcttggttagtaagtgcaagtaatgacaaaagggtagatttaagccagatggtaaataatctttgtatcaagttgaattctttgtccttcatggcctcgcttaaagcatctgccaagtcttatacaatatgactctaccaactttatcactacccttaaccatcacttctgctggaaacttagggtgatcaccttttcctagaatagccaactcataagccagatagcaacctataagatggcatggaaaaaaaatcagaattttattctctagaattttaaacagaaaactatcaaaagaatgaactgattttcagtacaactaagacagtcacaaggtagcatgtaggcattgaagataacatgtaaagccaactccatggcgagcaaaaaccatgaataagctagagctgtgaggcagaacagaggtgaacacaagacaggtgacgtggagaaaagcaaagtggcagagcactgaaatgaagctatggatgcctctccagtttggtttccgctcttcttgaaaaccaattgtttgcctttaacaaaaatataaacaaaatgacaaccttgtgcgtcatgacaatgagtcgctatttaaccagaggtcacagtgagctattcatgggatttaaagaagacagcaacgtaagcaattttagatagtatattgggaaagtagtaagaccattctgaagttgccctttgagccattccactgaggcctaaccaaatttcaaacaagaaggaagcaataattcttttgtttaccttgttacttgaaggggaataactttctacttaaaatattatgctagccatgtggaagatagattatgtgtgctagaatattagtaatttctttccttttcagagccaattatgcacgtttcagttacttaagggaaagtctgtataattcaacattaataaagaccgttctatacatttccaacagtaggaggaacttaaaagaattgttttgcccatggcaaagaatgccatgcattaaattcaagttaataaaaaatttgtatagttcccaatattagtaaggattacttttggatggcgagatcatggttcatgttttataataaatatatatcactattataatgcaaagaaaacaaacttagagaataattgaagacttgtttgtttcctttctatttaacaaaacagattttaagtcctagtggtctagttaaatctatatgaggttaggaaaaaagttatataaagtgtcaactactgtttttcacattgtacaaaaacattgatttgacttcaaagaagacagaatgattataagaaatagactaatctcaaaggatctaggctctactcaaagtcttgtatctgtgtcgtatattaattgaaccagttacttcatctctctggtctacatttttaaatctgtaaaatgtgaattggacaaaataatctcaaaatcccaattacgtgagtctcttaagcctttatgtcactactacttggtattactacaatattttccaagtttaacttgcaaagcttgtaagccacttgaaattatgtaaaacctctcaagtcgtttagaactacccacagaaaatatataaagcctaagaatcaggactaatggcctgaacatataatgacatgtttaactgttttggtttctctaggcagaagcctagagtatttcaaaaggaaaacacaatgattgaaaattgaatacactaaatcaaaaatattttcatgactttaactaaatagaaaaagtctggcctcaaatatagccaatgaagagaagaaattttacattactattaccagattttgcatacaggcccatactgcatcatcagaagattacagatttggattatacataagtggttgcctatttgaagtttaaatttacttgtaaacctctacttcctagagttgtaaacacacactcaccctcacacaccacaccaccaccagaaccatacacatatgtatcaaattcaggttttctagttttttactataaaataacaaatacaaatttgaaaatagcaaagtattccaaagcataaatgataataattaaaaacaaaatcttgatacaaaaaagtaggaaaatgaatacagataccaatagggtatagtttgtttcttttaaaagtttacataaaattctattctatttcattaaaaattaaaagttcttttttttagaagaaacattgggctcaggaaaattaaacacctgtaagatattgaaaacatttaagtttgcaaagttataataaatacaaagtataagatgccaaagcaaatttagtgtgcatgaacacaacaccaggaagagtcatcctatttccaccaaatacattccctcaatatctatagtaagatataacccccaagaacggtagtaaaaaatattttttcctagcatttttggaggctgctgggcttgctgatattagcaggttggtctaggctaaaaggaggatgtgggagaaacctcatcaaagtgatgattcaaaattcataaataaatgaacacacgggggaacattttaatcactcccacagtagagtaaatgaaataatggcagacacccttaacgaactatacagccaaggaagccacaagtaaatacaatatatccaagcttcttccaatttaaaagttgtattaagaaatgcgtacataggccgggcgcggtggctcatgcctgtaatcccagcactttgggaggccgaggcgggcggatcacgaggtcaggagatcgagaccatcttggttaacacggtgaaaccccgtctctactaaaaatacaaaaaattagccgggcgctgtggcaggcgcctgtagtcccagctactcgggaggctgaggcaggagaatggcgtgaacccgggaggcggagcttgcagtgagccgagatcgcgccactgcagtccggcctgggcgaaagagcgagactccgtctcaaaaaaaaaaaaaaaaaaaaaaaaaaagaaaaagaaaaaagaaatgagtacatagtaagagaccttaaaatgacactagtgcaaaatacattggaggatatggataacaaaggaggacagcatctcacttttacaaagatcttcagctcccattttcaaccttgggctacagtcttaattcatacggcatccttccagtatcatctgccatgcctgaaatctgtcatgagaaatccatatctgaaacacggcagattgatcgcatgcttttattgtctctttcacgtcaaaactcaagcaatgacaaatgaatacaaatgaggatagagaaaagaggaatgaatgaacaatttctacaaatttttggagaacagaatacatggtagagtcaaggcagctacagtctaagtgcttactgaagggggaccttatgtcgcgccataaaagtcatgagaagcaccagaagtaggggtcacaaaaaagatggggactgatcttcatagagcgagatcaactgccagatttcggtctttaccccaagcaatcaaaagactaccccatccctctaacagaaaagagtttattttctggcaaattcaaacctgaaaagctacactgaagtatactaggcatagcagtgagacttgggactgacaacctaagactaaaatgagaatgtacatgttgaacttggggcacccagcaccctttccctgccttgcccccagaacactggtagcaggtgtacatcttccatgtaggagcggttggcagtcttctctgggtgtgtggggagtggagtctaaatacatgtacctgaagcaagctctctgtctaatcttgctaacacaaaatccaccaccaaaaccttgcccactggcagggtgccttcttttttttttttttttttgagacagagtctcactctgtcccccaggctggagtgcagtggcacgatctcggctcactgcaaactctgcctcccaggttgacgccattctcctgcctcagcctccccagtagctgggactacaggcacctgctaccacggccggagaattttttgtatttttagtagagacagggtttcaccatgttacccaggatggtctcgatctcctgacctcatgatctgccctccggcagggtactttctatcagtttttagtgattcactcattaatatgaatgaacacagaagaatcttaaccgtagagaaacgcctccaacatgaaatgggccaacacgaactggctaaattacctcagaagaagtagtggcaccgcagcaagcagtataccaccaaaaaaaaaaaaaaaactgcaaataatatcctcacagtgagaaaaaatggcacatccatgagagtaacagtatgctatgaagaaggggcaaaaagataacttaaaaagagctcatggagctaaccaatatgatcacctaaattaggatgggagttgggggatcagcaaactgtttctgtaaaaggccacgtagtaaatattctaagttgcaggatttgccatctctcaactctgccattgtagcttgaagacaaccatagacaatgcataaaagaatgcacatgaatgtttctttatttacaaaaacttaattttatttatattgcttgacccagtggtatcattgctggatttgattgtgccataatcttctgacatctggccaaaatttgtaataaataaataaaagattggatcataaagcatagacattactctgtaggatggaaagagataaagagatggaaaataggaaagaaaaaccaaaggatcaatccaggaaatccaaaatttgtccaatagaagtttcagagaaagagaacaaagaaaaatgtggagagatcattttttgaaacatacaatacatttgtatagaactgaaggacacgtctccatatttaaaaagctcactgactgcccaaaaactaacgaaaaaaaaaaaaaagcacgaaccaaagtatatctgtaaacaatttccgaataccaggagggaagaaagtatcatacagaggaaaaaaatagatcatacacaaagaaataagaatcagaatattgtctgattctctacagtgacagtggtatgggaagacagtaattcaatgtctcaaagattctgagggaaaattatttaccacccagaattatattacagcaatctatcaatcagtaatactggactaaaaaacttagacatgaaatttttatttcacatgcaccctttcctaaaaatctattagtggaaggtgcttcaacaaaatgagtggtaaactaagaaaataaatacatggaatccaggaaatagggatcctgttctggaaaatggtgaagtactaggtacatagctagaattggatattggagccaagaaatggagtgctgcaggcaaataggattatctgaaatgcctgagtgtttggaaagcttcggcatttgacatatatatatatataatatatatatatacacacacacacatatatacatatatacattttttttttttttttagatggagcctcgctctgtagccaggctggagtgccgtggtgcaatcttagctcactgcaacctctgcctcccgagttcaagcgattctcctgcctcagcatcctgagtagctgggactacaggcgcctgccaccacgcccagataattgttgtatttttagtagagatgggatttcaccatgttggccaggatggtctcaatctcttgacctggtgatctgctcaccttggcctcccaaagtgggctgggattacaggtttgaactactgtgcccagtccttgacatatatttttaaatgttgggacaaacaacaagccctagatacagacaaaaaagcaaatgtaaaagaggtagagagagaaagaaaataggaacaatccttaaactgcaagaaaagcaaaacgctgaatgagaatggcaacacagtctagtacaccacttaattcatcagtgtctttgtttacacagtgattgtgagtcatatcgcctatttatttaatactgtaataataacatattaacatgggaagcagggagagtaaatgatactgaatcctcagttaaaatagcaagaaattaaaatatcaacaaaattcaaaaatattataagaattaaacagtagctaaaataaaatgattgcacctaaaaagagtaattggtaagaaattgagagggaagagcaaggatgaatgtttttaatacaggccttttctcctatttgctttttaagctacagtatgtgcataaaatgcagttctctgtgcttccttaatactttccatttctcagactcacctattaaatttcaagaatcctgagaaagctaatactataagccattatcagctaataccataggattcatttgttgataagtggaaaaatgtccaaaaagaactgggtcaccacaggcacctggagacaaagtggaaatgaaagaaaatcagtaaggaagaggtaaggaggtgctggggggaaattgaattgcaggacactcagttgatgtccagagagttggagaattggttggtatggaaaaactccacaccctggtgtcagaagtgtggagtatataaaaaaacaattttcttttcctttttaatggtggccaatgaaaacccaaaaggagattacatctaaggtgacaggattatgtgagttgctccctacttgctctccaacgtcaacaactcagaaagggatttttctggccacagtatcaaatggtcattgccctcatccttgttagtcttcttcacagcacttattactagttgacattgcagtgtgtagctatttttattttttaccatctcatcaacaagaatgcaagaagtcctccagtggaaggcactttgtcttattcactactgtatccccagcacgaagaacagtgtaagagtttaataaatactcattgaataaacaagttaattttatttttattaaggatctgtggcatttgctacccgggactaagtaaatttttgctcgagttacaatattggcacatgggggctctgctgttagttgcaagagtatcctaagcattccccaacattcttaagggaactgttcaactgggaatggccacagctacagctaccaagtactaacagtataaggaaggatcctctggtttgacatataggctgatatattttagagtaatataaggacccacagactcctgttctctgctacttcattgcaaactatgcagggattctcatttgtcagaagtttaatatctttcagatctgggccctaaaataaaaacgtttttaaatcagacattgtttcagaaacaaaaataaaaccaacctatggcatagctgtttctttatcaaaatcaagattgtctattatctttctcctcctggtgactggggaatttaattcctaatgctgatataattgccaggaagtcgaattttaaaacacaccagtgtatccagttgaaactattatatacagtgctttaaaaatacaatatgaaattttcttcaaaaactcttgtcacatcagaatacatgtgaagtggatatagcaaaatgttatgataccatttaaagaacactgactgactttacattcaaagcacagtcatagatgcaaagtaaaacatcaaatattaaggtataaatttggttaagaggtttttatagtccctctaaaagtcttttctccactgtgagaaaatacaggaaatttaggaatatatataaaactagacgttttacaatgtgactctggtgccacatgtttcttgatggaatttgttctgaaagaaaagctagaaaactgatttctctcagcttaagtgactacaaatgaattttgattgctatcctattaataagaattttttgtgcctcagttagatgaacacttcaatggcaatacaaaaattagcagatttatttagcaagtaccaacaacaaataattgctgttgctaagggtaaaaaggcaattgtgatgggatgtgaagaacagaaatcctggtgatatgaatgttaaccaataaagttctcaaacttgccatttagcgcattcctgaattctctgatggcataaataccacaaagtagaagtacaactttactctaagctctaagtcctgtattactcaaaagttcttcaaatcttaaactgctaccaagaatgaatagatgccccaaatatccactttggggctggatattctgctcaaattaatgaatagactcttgttaaacatatatgccatgaaaactgactatgtgcaagttaaagcctacaatgggaaaaccaccaaatgcagaacatggaaaaagctaaagtccaaatgacgtggcatccaacacatcaatggcattacaaaatgaaagagacttcaaatacatcaaaaacaaatgcaatgtgtgggctttttctaagatcttgatacgaacaaacctacttgaagaacttgttaattttattaggtataataatgctagatggttaaattaaaaggctgttaggaatgcatcctgaaatgtgcatgtgtgtagatagataaatagagagagagagagaggttataaagacatatgttggctgggtgcggtggctcatgcctgtaatcccagcactttgggaggctgaggcgggcagatcacaaggtcaggagattgagaccatcctggctaacacggtgaaaccctgtctctactaaaaatacaaaaaattagccgggcgtggtggcaggcacctgtagtcccagctacctgggaggctgaggcccaagaatcacttcaacccgggaggcagaggttgctgtgagccgggatcgtgccactgaactccagcctgggtgacagagcgagactctgtcttaaaaaaaaaaaaaaaaaaaaagacatatgttgaagatttgcttttaaaatactccagaaagaaaaaaatattgcacttatgtgggaagaggtgtgagtatcgacgaaataaaattagcaaaatagtaataatttttggagttgatatttattatactagcctctcaacttttgcgtatgctttacctttcctactgaaaggaagaaaaaaaagtatttccttgaagtcatatagtcttttcagccttcataagtctgccactgaagtttatagtgttggctagatttctgtattcccatatttaccttaggactacctttgcaggaagtgacagtgaggaatgcaataaaacctgagaatatggattgacgctgctgcataaatgtatcttcaggtgaatgggagggagacatgttggataaccttgcaatgtctcattcattaaatttgtcttttcccagaaagacactgagagaccattttaatggtcagacctggaatattctttattcatttatctaagtcagagatattcactcataaccatatgtgaccagacagggtttttaatggagcccttaaagcaagcagatggaaatcaaggatatttcagggaagtgttaatgctctgatgaagatctggatataattacaaatgtagacatgcatatgagtattctaactagaaatgaagaaaattattttcacagctgtaggaaactctatattggcattctgacaaccctgatatattgttgggtcacaaacattaaactctttacaaaagctaaatcaaatgcgtctattggtgaaagtactttataagcgaatacacagaatatcaatggtgtattctgtataataaatggttgtggtattaaaattagtagaaaagaaatactgaggaatgtttcctataatattagtaaattctggcatgtccttggtcatgttcatgacccttgataacccttaatatatgctcatggccacagaacctatacagaatcaagggaaaattaattttgtcatagatactctgattgcagaaatatctgtaacactttataaatattgtacaatgtacttactcataaatcatgaaaatggttcctaagtaaaaatccttaaaagtttataagtcaggttttataagtcccattttgcagatgagcaaactgagacccaaagaagtttgcacagaatcagttccaaattccaaatgtcaactgacatatgcaataaacagtacatgtgttgagtccaaatgtttccttacctagtctttatgcaatctcgcatttagattttcatcaaatcttttggctctactgccctccaaggccatatgcaaagatgttgcctctgtctagttcatttgaatggaaatccatttgctattgtttgggggctaattttgcaaatcatttcataactttctgttcaaaaactacctttaaaatatttaaaaatatatcatggtgctttgaggcttaagattaagaaatattttcaagaactaaagtctcataaaaatgaaggaaagcaagagccaaatccagatttaatccaaatgtgttaaactcttggtcttgctcacaaaatgtgacccacgaaaacagttatggcttcaccatccctagggttgcttagccaataaaaatgaaccatctttactttccctctttatttcatacctccacttctatttccttagaaaagttctgttgattttattgtaaatatatcccgaatctaaccaatgctcaccacttccactgctaacaccctggcccaaacaccatcatctatctcctggattgatatggtggcctcgttactgtgtcccctgctaagagtgatcatctcagtcagtctgtgcttctataaacaaaaatactatatcctgggtggtttaaacagtaagcatttatttctcacagttctaatggctgggaagtccaaaatgaaggtaacagaagacctgatgtcaaagacagcctgatttctggcttcttaatagctgccttctcttgtagcagagagagagaagaagcaagctctctcatttctgtctctttttatccttataatcccactgatctgtcatgagggctccaataccatgacctaattacctcacaaatgctctatctccaaataccatcacattgggaattggggtttcaatatatggcttttggggacggtaaatgagaacatccgatccacagcagtgatccttttaataggttatttgatcacatactaactctgcacaaaaatctccagttagctccccgttttctccataataaagccagtattcttagaatgtcatccaaagccctccatgacctccatctccaattattctatcacttggtctctccattctagactcattggcctccttgttgttcatggaacacatgatctgcttccacattaggcctttgcactggccactccccatatatacatttaagtctcacaagctcatatccttcaaggtttgctcaggccagtttcttaatggccctaaccatcctatttaaaactcagcccacctcataccttgcactcccaatcttccttatatttttcttttttttcatagtacatatgacctactaatatactgtatatgtttatttttaattgtctgtcttatccctttagaatgtaatcttcacaagggtacaggcctttattttgcacacagatgtattcccagtgtctggaacagtgtttagcacacaatggttattcaaattaaatatttgtaaaataaataaaatatctgaagtcaacaactgttaagatatcagtccattctctttcagttatgaatttctaagtttatatctggcaactcagtttcatattggactaaaatttggcagtattgccaaactgagatttgatttatttacccaatttaaacaaaatatgtttagctatttgaagtcctataagcacaataaaataaaaagtctttagatacatgacactatttttataattgtataaatcattaaggccctggatgcattggggatatttaactcgtcaggtagtttacggtttgttctgtatgcgatattaagtgcaaaagaagttgctagtttctaaatacataatgcaatataattttgcttctgctgaaaggcaaatcagaaataatcagctcgctatagtcgacaagtaaaaggagaaaaaacttttaaaaagtatacaggcaaattactaaaatcttttagaacacagtcttttctttttctcttgagggactactctatgtctttgcagtaacttctgcagcctcaagtattcagtgtggcttagaatcacattattttgttttggatttctcaactagcctcatggataatcttccctcttcaaacaatttattatcctgaaccagatcagacctggttgtgatgccgacttaaggggtcgtgccaaagtaggggccatacacagttcctggaggctgactcagtccaagagtggctactgattactgttgagaaagagattgatggtcagtatttttttccttaatattatttcattatgaacatttttccttgtcaatcaatacattgctaccaaagcaatttttgttgtagcacatcattcctgtcatatagttttgttttatttttattttattttttatttttgtgggtacatagtaagtgtgcatgtttatggggtacatgagatgttttgatataggcatgcaatgtgtaataatcacataagggtaagtgtggtatccatgcccttaagcatttacgctttgtataaaaaacaatccaattatacttttagttatttttaaatgcacaattaattcattattgactatagtcaccccattgtgctagccaatactaggtcttatttactcactctaatattttataccctcagttgttagtattaagactaaataaatattaatcataagatccaaagggtaggtgtaaagtcagaactatgcagtaagataagatcaggaaccaagataaaagaaaaatgtctgaaaactaagagcaatgtgtgtaacacagcagagaataatattcaccgtaaataattcaagaagatttatcccaggaaaagcaaagtgagagcccacattctcagtgggttcctctgttcttctgtcaatgggaagtaaagtatgatgagcaagaagcacaaagttaatgggtcctccagcctcctggagtggctctctgcagctcttgggcaaaacagatgtctcaatgactacgtgggagagtgaggggaaaactcagagcctttcaagcaacagaggtgtgagagagaagttatcaatataattctcattagtctgtttttgagagatacaagttgtcaagcccatttgggatattaaatgataagggttcagtattacccttctgtgctgtgcaaaggagaatagtcaaaagcatatttactgttctcatgaaatttgtagtttaactatgaagacaagatatctgtgaaaagtaaagatcactttctgatcaactaagttttctcactttctagtttttgtctttgtatatacctcctttaagaatactttctccaaaattgtttccagtctcactgactgaggaaattttcaggactcaatcccatgtacaaatgttgaacattacataatcagttatactatatccattgtacttgtgactgatataaaaacatatttttttcaatagctatttattgcatgtctgcaatgtgccaagtgctgttgtagatattaggaaaaatgaagtagacaaaacattgtctttgtccttgtggaacttacatctcagtattataagtgtgcaaaccctctcttcctactaggagaaaatattatttttaatcattccttcacagtgagtttcttaaacttatttcatcagagactattgaaaagcacacactcttccatccccctagaatgagaatcctgggggagggattgggcagtctatctttttaagaaactcactggatgtttcatgtgcattcacagcttaggtaactctgggggaaagcactgccctattaagaacatactgcccaaggaattggtaatatccattgtactatatctgtaggaccccttttgattgtcattactagcctttatcaaacatctcatccttggagaatgtgaaagctctccacggttttccacagacagttcacctaacaaaaaacaacaaggcaaactttttcaagaataccattatttttaaataaaatgcctctacatggcagatgttattatgttctactttggagatgaaaagaatcgaacattattagtcatgatccacagaaccagaagatttattttaaagataaagttcagatgatgaacataaaggaagttatctcatcaaagaaggcaagactgagtaaatctcagaaatccaccatgtacaatatttaaaaatgctcactaaagttgttctttgtgagttaatgaaggtcagtatagtcaatattcagtacgtaatcctagcaagtacaaataaagttaatattattcaaatatcttacacaggcttattgcatgcaacacactgttctaagtaacatacagatattaaaatgacttaattctcaaaacatgaagtgagtttttgtttttatgcccgttttgcagatgagaaaactgaggcatagggaaggtaagtaacgcgcttaaggttacatagctggtaaattgtagccaggagttggaatctaggtgccaaaatctatgctgttaatcactaaactacgctgccttagtttttatacttctttaggaacctcagaccaaaagaaatttaggcaattctaatagaacaagcaagaatttgctaatcacagcttccttgccccaatcctttaatcggcttcattttcactgacttcttttttaaatgaagataacaatgttgttgaacaggatcatctagtggttagtggttcggcataagaatgactcgcttctgaagctcagctctagcactcgcttgctgtatgaccttgagaaagttacctccccaagtctgtttcctcatctttaaaagagaggttataataggacccacatcatactattgtttaaagagaaaacaacgtagcccatttaaagcacttagaaagtgctccataaatattattagtgtaataaatagcagcaacatcaataaagtatgaaccaaatgatctcttgattcgtatcctaacactaaaaatggtttatttcccttctaattaaaagagaattacaacaaccaaaacaacaaacgaaactatagccataaaatcaattatatcgtctgtgagaaaaccggaaaggctattggacacattaattcacttgtcatcagtcatcccctctattccaaaatgtttgtgttctaacatcctgagacaccttgcataatataatcactgtgactccaagaggtcaaatgggcaggcagttaatgcttctctgtgaaaagctcaataattcattttataaatttcagtttaaagcctgcgttgaggttaagaaaaattgacgttcggtctgtgaacttaatgtcaagctccagaaaaactctgggcagcacatgtttagcaattaagtggacacagacaataaagacgttgccaaattgtaaaacaagacttggaaatcacagaaaatgttgctagttattgatcacggtgaccattcagttcctactgagccacccaaaagaatcattcattttccagcagagagcctgctcatttgcaagataaaagagagacatttctgcacatgcccataatgttcttcaccactgggggcagctttacataagactgcattcactgaaaccaaagcaacagtccgagcagctttcagaatgacagtctgcagaagtgagctgagcgtgtgcgcggtacggggctctcctgccttctgggctccaacgcagctctgtggctgaactgggtgctcatcacgggaactgctggggtatggaatacagatgtggcagctcaggtagccccaaattgcctggaagaatacatcatgtttttcgataagaagaaattgtaggatccagttttttttttaaccgccccctccccaccccccaaaaaactgtaaagatgcaaaaacgtaatatccatgaagatcctattacctaggaagattttgatgttttgctgcgaatgcggtgttgggatttatttgttcttggagtgttctgcgtggctggcaaagaataatgttccaaaatcggtccatctcccaaggggtccaatttttcttcctgggtgtcagcgagccctgactcactacagtgcagctgacaggggctgtcatgcaactggcccctaagccaaagcaaaagacctaaggacgacctttgaacaatacaaaggatgggtatgttttgtcatttttcttctttccttcttaaaaacaaaaaacaaaaaacctctagtgtgtgtaataattctgccttaattattttagagattaccttgctctgctctaagactatgaatttatttgcttagtggcatgtttccttgtttaactatttaaaaaaacaaaacactaaagacaattctctttaattacaaagagataatatgtgatgttaagtgttatttagatttaaatttttaaaaatgaaaaatatatgcctatttttgcttgattaaggattaattcttttttggggggataacttttctaagttgtttttatttccaggtttcaatgtaattaggctactgagcggatcagctgtagcactggttatagcccccactgtcttactgacaatgctttcttctgccgaacgaggatgccctaagggctgtaggtgtgaaggcaaaatggtatattgtgaatctcagaaattacaggagataccctcaagtatatctgctggttgcttaggtttgtcccttcgctataacagccttcaaaaacttaagtataatcaatttaaagggctcaaccagctcacctggctataccttgaccataaccatatcagcaatattgacgaaaatgcttttaatggaatacgcagactcaaagagctgattcttagttccaatagaatctcctattttcttaacaataccttcagacctgtgacaaatttacggaacttggatctgtcctataatcagctgcattctctgggatctgaacagtttcggggcttgcggaagctgctgagtttacatttacggtctaactccctgagaaccatccctgtgcgaatattccaagactgccgcaacctggaacttttggacctgggatataaccggatccgaagtttagccaggaatgtctttgctggcatgatcagactcaaagaacttcacctggagcacaatcaattttccaagctcaacctggccctttttccaaggttggtcagccttcagaacctttacttgcagtggaataaaatcagtgtcataggacagaccatgtcctggacctggagctccttacaaaggcttgatttatcaggcaatgagatcgaagctttcagtggacccagtgttttccagtgtgtcccgaatctgcagcgcctcaacctggattccaacaagctcacatttattggtcaagagattttggattcttggatatccctcaatgacatcagtcttgctgggaatatatgggaatgcagcagaaatatttgctcccttgtaaactggctgaaaagttttaaaggtctaagggagaatacaattatctgtgccagtcccaaagagctgcaaggagtaaatgtgatcgatgcagtgaagaactacagcatctgtggcaaaagtactacagagaggtttgatctggccagggctctcccaaagccgacgtttaagcccaagctccccaggccgaagcatgagagcaaaccccctttgcccccgacggtgggagccacagagcccggcccagagaccgatgctgacgccgagcacatctctttccataaaatcatcgcgggcagcgtggcgcttttcctgtccgtgctcgtcatcctgctggttatctacgtgtcatggaagcggtaccctgcgagcatgaagcagctgcagcagcgctccctcatgcgaaggcacaggaaaaagaaaagacagtccctaaagcaaatgactcccagcacccaggaattttatgtagattataaacccaccaacacggagaccagcgagatgctgctgaatgggacgggaccctgcacctataacaaatcgggctccagggagtgtgaggtatgaaccattgtgataaaaagagctcttaaaagctgggaaataagtggtgctttattgaactctggtgactatcaagggaacgcgatgccccccctccccttccctctccctctcactttgctggcaagatccttccttgtccgttttagtgcattcataatactggtcattttcctctcatacataatcaacccattgaaatttaaataccacaatcaatgtgaagcttgaactccggtttaatataatacctattgtataagaccctttactgattccattaatgtcgcatttgttttaagataaaacttctttcataagtaatcccccacattcgctgttagcctcctggtgggaccaaatctacagttatagaaggtttgcacctcactggcaaatcaaggaaagaggtgaatgattccaggtgctcggagcttgagctgattcttggagatgactcagttatgggaacattttacagacaggcagagcctttaaaccaatgcctgacttagaaaagaaaattgcaggaaactatcaaaagatggtgctaggttaaagcagcaccctgagcagtttccagaggtgtctgaattacagtaaggcaagcacagggacaaagtgatgaagggttaaaatactgcaagcagacaactgcaaaatgtgaggagatgacaaaaatgtaaagttttcgactcagccttgtctctgaaacccatctctgtaaaatcagactagaggtttcactgccaatttcttctagcctgtatgtttcataaataaataaatgaaacagcattgagaagccagatttctccaccacacctcacattagttagggagttttcagataaggttcgcgaatgggaaagcagcttgctacaggcatgtggttgagagcttaccagaatttctctttccagttttttcgaagaccctaatgtagttagtagaatccttagctctgtcctgttctgttcagaatttgtcaggctgccctgttgtgttccattacatgtcctgcacacaccagtcccctaatgacagacacttcattcagatgtgtaaagagaacacattccaagacgtgccttccacccacagcctcattgaaaaggacgactttgataacaccttaataaatgtataaaacgaatcttagaggaaaaaagaccaacactatgacagttctctgttgcttttctattgctgacattacaatgtccctgcgttcatctgtattgtgaactcatccatcagtacagttctgtacagaccctgttggcaatctgcaagctgcatgcatgtttttatgtcattggtgaaagtttattgactgcagcacgaatatcatagcttccatatttgagtaacttgaaccacagtcaattaaggtttttagaaagatatatttagtctgtattctccttcatcctccaaaatgaacagttctattatagaagcaaatatcaggaactgcaacattgaggctgtttcatttaatttggcttgccaacccctacatctttaaccatgtccctcttctctgaaaacagaatcactgcagcaacaaagaaaaagtgaatggctatttttactaatttttttttattgtttgggggtttttcatatgctgagaggaaaaatctaggcaagtcaccataaaataaaattttaaggatgccagatcattaaaatcatacttttataagcaataaagaaaaagaaatagttaaagtggatttctcaaggtactttgatattgattaaatcttacaatagatgccacttcagaaaaacatcttagttacaatgtttacccatgaataattgttgaatatacatgtattcatgacaaaaagtcacatatttccaatggattaataatgcagatacttcctcacagcttactggatgactgagcttattgtgatttttttactgaagttgtaactttacatttttcataaagcatcagtaaatacatattccatcttaaaaagaaattttctttggctagcctcatttttatctgtactaaagatgtttgtattaatgaaatgcagtcttaaagtgaagaaccccatttctattctttttcacttaaccttctgccttacttgtgatggataccaaatatatttaggcaaggaatacttatatttttgaattattgcaaattctcaatgccatggtgctactagtatatataaaatatgcttgctgtattgaaaagcattcctaaaattcaaagctacttggaatataaaatatgatataacactaaatgaatcaccaatattttgaaagctgtcactttttaatgcctaactttactaataaacataataatagataagaacgaaaataaaatcccttaggtggtaaaactcattttgatttgggacatgaaattatgggaaaaaagttctttctttctcctcactctttgagaatgaatcttctgtaattctcagtatcttctgagcacagatatataattcttgtagatttaataactagtttaccactgtaaattttaaaacgccaactgccagtctcctgctcaaaagttgttgcctcacctccatcccatggtactttctggactacatatcataaatctatttgtataagtatttcaagttcatgcagattagagaaatgtgattgatatttatttttctagtacgtatttacataaaatattggacttccctcaaaggtgacaacagttaaaaaaaaaaaaaaaaaaagcctgacctgttgaactatacaacagaacacagaatactttgctttaccaaaacagagaagaaatgggatttagtctctaaacttcatgtgagtttttttccatttttattaaccccagtacacatagtgctaccacagcatgtagttaaatagtcccagtgccacagtcttgtaagcaatacttatgcaagatatattgcattgaaatgagtttgtattttccaaggacgttgacattacatcttttcaaagaatttaaacaattttttacttgatttggtgagtgaactacctaagtagacaggcagtaaattgtctttctatggagcagcagtgacctctagtgtctggttagactaaccacagctattcacacattttagctttttatcctgaatccttatgtaaacgtggtttacaacatgttttttgactagtaaatcagatttgaattttatttaattcatttccttgggaaatataattataatgtaatttttgaatgttatacttttcattttgacttttatagtaatgctggaacagaggccatagaattggtactgaaggctagaaataagtgtccaagatgaaaagcgagtaataacgcaataagaatagataagaaatattttagagtgcttatactcatcgatgctggctaagcattttgatatttttattaaaggggttaatatttttcatcagcaagatacatgtaatttaggtaggaaaaacaaattttaatattatatcaaaagagtcagcatcagtcatttactggtcagggatatgtcaaaggtgtcaaaggaggggggcctccccttccggctttagaactctccagtttgctgattgtgccagtgacctgtgctttgcctcagcgctttctccctccctcccccttttcagccagctgaacactggttctattaggctctctgacaatgatgttacagtctaagaggtgatgattcatggataatgaaattatgctctccttctggggaaggataatgcagagtcagattcatggatttggcaagaggttttaggatgctgtaggtgcatgaaatatctcttcttcccttgacatttaccaaaatgagaactcaaatcgtttatttaaagtgtggattagactgcatcagaaacaagcatcaggtcatgaagcctgagataaagtgagttccagacatggcaagtaagaatcgagccatgagaaataaaaaattcagaatctgtgttgcttcatctattcctttttgctctggattctcattagaatccagatctgtagctaacccacggagttttgctattgttgtattctcctagctacctacactaaaaatcagaggcagttgggggaaacaatgagcacaacagaatatataggtaaatttgaatgacacaagttttaagagaaataaaatggatggatgttaaatagtttgtatcaaatagctctaattaaaaatgaattaaagaaataataataatacataggtgaaagtcactgctttcctaatcataatagcctacagaattggacccaaattcttttagcctccaaaagttggtgatgattttggatacttaatactaccaataaaatctaaataacaataatttatgattcttttgcatttgagggaaatatcacagccaggcatggtagaatacgggccttagaaattaagacctaaattcaagttcctttgacacttgctaatcaagtcatcacaggtacatttcctggcttttctgaatttgaagtttctcatatgtaacacagatgtgtactattgactgctcatggtaattgggaggacgaaatgtgaaaagtactttgtaaactctaaaatggcaactacctcttcttttcaaaaagcccttagtgagatactgagtggggtttgttgttctatgtttggcatgagccaaaaagaaatcagtaacctccatgttacagaaccccaagcccattttacatcattagaagtctagaacatcgtctttgactttctgttttcacataggcacagcttcttccacctcatgttatctaagtctatgatttttatactgattatcacaatgtacaacagacataaagacaccgaccagcgaacactaaaacaaataattatcaaacacattgaaaattctacttgtatttcagatcaggcaactatagcaagggctttcaatcaggacgtttacctgtccactccctttctagtatcattgtgttcaatccttgttgactttacactggatcaatataatgtttatatggcaacatgacatcattattgagcaaaaagtaattgcatataacatgttactgtaggattagcacgcattccaggtatcagtcacatgatatctgctctgatgtttctcccctggccactccagtggaagactgtgcccaagatctcctcttagtatagaaattactattgactttatcaattataattattgaaaaatcactggataaaaaggggtataaatgtacagggacttccttttatatgtcattgcttatgcaaaattacatcattaattcatcaaagaatgacaaaaggcttcctccgctggatgtagctgctcttaccaatatgaagtagcaggtgtattttcaaaatgtttgtcatttaagaagacacagactgttcctctttgacagctgagttcctatggcatatctaaagatcagagagaggatgatggtttttcaggtggggaagcagttgtgagttttctgacattttaacttcatagggtcatgaatggacgctcttgagttagggatcctgaacacgtgaggaaaattccaggaacacagagagaacaggaatatctgggacatgatataagaccaagcaagtacaatgtattttacaattatactttctaacaacagaacttctataagcaataataatccattttattgaaaaaaaagaaaaacagcttctatcttatcctttccagcaaatgttgtaatgataattaataactttattaacaattctccatgttttctttttatttttaagggctctcacttctcccaatcaggattctcatttatcctttctctcactcttaaattgttctccttatttgaaagagtctgtaattcctatatcaccaaaaaatgtcttcctttataaaccaacacaattcagtcatttggctcaaaagagcagcattatctccaaaagaaaagttacacacttgcattaaatattaggacataaaacaaatttaaagctggctgacacttctctttcctctacaatctataaaacacctctacagtatattatgatttgcaattgaaaaaacaggatatatagttgaattacagtcttacaaagtattaaagcttactgttttcctccttaattagctaattcctagaaaacaaagtataggactttatgtataggggtactcaactatatttcaccaatcagaaacactctttccaacaatcagaattttgtcttctcaagggtaaaatatagtttttttggcctggcatataaaatagtaaggcaaatactacatttagcaaaggcaatttttgttgacatttcatcacatcaattacatctatgcagggtggaaaatacattttgtcagtaaggaggcaatgacttcaattaaatgtaaatccttagtcagcattcttggtgctaaagcttattaatgaagtgggagcagaatgaaaatgtcatcagacagtgaagctacagtatcatgaggctatgctaccttgagtggtgttcatagcttcaactgggtggccctcatgtagctaaaaaagtgctccttgtcattaatattgatctatgtactttctaaaagaaagaatatgcttaccaacagagccctcatattgactgtcttcctataagtttccctcattaatatttgatgcagtcaaccagaatctcacaagagctttaaaggaaacttgtagaatgcatcatgttgatattgaaaaagtagagtagcttttaaaattctgataaatgtgtgacaagattacaacagtgaaacctctctaaggtacaacagtgaaaatagttataacggtgaaaactctaggaagtttaccatagtgaaaactctccaagaagtttaaaattcagcgctttgagattagtgttggcatgtacttgtcaatttatgaaagggattttgcctaatgtattcaaaattttaatgtgaaaggtataaatacttggtttgtgtactggcaccaatagagggttaggtaacatcactgaattatgattaaaatggaatatttaaagatctttctaatatggcagaggacatattacatacgtatttgtatttccaccaaggtacgtatgttgtacatgcctaaaaaaatatatatatattttcctattaggtgaatatttttcctataatgtgaagatattttggtataattgagtccttattatgtaccaggaatttgtatatattatctaatgatttgataaaaagtgttttatgcgtttcgtaaactcagatagttttccttaaaatataagaacagagccctttatattgagtctgtcttcctgtaagtttcactcattaatcctatacattttcacttctttataggactgctctaaaataatttataccccacccacaaaaggcttctcaaagccaaatcatgcatctccagatccctttaggaaataatttccgatgatttaccattagaacatccctctgctagttaaagtctaatctgccagtatagtgttccttccagcctgtggcacccactccagcctatctcatgtcattcattaaaaagcagtaagtgtttagtcttttggacttttacagggaggactaagtaataaaatgtaaaaatctacatatatttttatgggctttactctggtcacttttatggtctaacacacacagatgtgtggagtctttattagtttacactaaaatgcaagagcattaagctagatatagacgaaaagagaaagtcaaagtagatttcaaaatagccaaaagctcacattatacgtttcttaatgttaaaaaaaaaatcccaaatgatggagatcctgtaattcactttcttgaaagctaatttaccctcctctaagtttgccatcacattcttaaatttaagctgacattccttctattttcctatttctaataggttttcctggtgtttttttgtttgtttgttttttggttgttctgttttgtttctctgttgttttctgcctgcagatcttaattctttgagtgcactgccttgcctgtttttctagaattcccaatcaaatgttgatcctgtcagaaagtcacagggtcagtttcatggttggagtcatcggacagatggactagattgaactctacagcgcaatctagtcaactctgagatgtctgccttgtgtcttctcagcatcccatttccatgtattttctctatttggaagtagtatccatattgaaattcctccatccagtggtgcccagagctttcttggtttcttatgcgttatcaaatatctgctcccagagtgagagcaggattactgtcccttccaagggcactcacctttaaatagagatgaaagtcttcagctaaaggtaagaaagttatatattaagagcaggcatagccagcagggttggggaaagttcttcttaggcaaagacctttgtaaagcactctgaaatcatcctctatagattcctcagtatttttctcaaacatgagtttgggcctttccaaaggagccaaggcagggtaaataatccatgtttcattcaataaactatatttgagaatttttttttcagtgaatcgccattatacaaagtctttctccttaaatttttttcatggagagacaactttgtataccagaaagaacttggactatggatccagtttgaattctgtttctgggattttagtaactgtgaaaccttgagtctcaacatcgtcatcctaataaaaatgtgtaaaacaatgtagttatcatgggattgttgcaagaaggcaaagaatcagcatttgttaaatatttttcctggtacatttcatatataatctaatactcataaagatcctatgaagattcaatgagatgatgtagataaaatcatttaatacaaaggttggcacataatactttctccttcccttcattagttccaactgctaaaaatctcagtaccacaatgcgctttgaaagtcatattacactacctatttttattttgaataacagactcctggtggactttccggaaatagaatctaaatttccataagctcaagggcatctgggcacgtagttaatactgaagagtgatggtagtacataaaaccaatgtcctcagcctcccaacaaagcccagctacaaccacctttattgccctaccctttcccatgctctaccactggcaggttctcaaagtagcccatgcttcccaatctctgtgcttttgatcaagcaatttcctttgtgagaaatgcccttcctccctcccaagtcctccagtcaatttctgagcttttccagaatagatcaaattctgctcactccagatgtcttattaatcttttccttccctcttttctgttttttttccccctctcccagagactgcatcacagtctaccttatgttagagttattaaggggtttgtatcacgatttgaggaaatggataatctcttcttttccttcttcttccaatggtggctgatacagtcttttatgcatgatagatgttgttgaattgattttctggtcattattatgaagttattattgcaaacaatctacagtaaacatttcaactctatggaaacttaattgtatcaaccttatatttctttgtgtagtcataaaaactttttttagttttaatttaatatacactttttcactatgtacactcttctcatttaccatttaacgggcttcaaaaattatagctgaccactaaacaatgtgagggtcaagagaacaaaccctcccatacagtcaaaaatccatataatattttactcccccagaactactaatagcatattgttgaccagaagccttactgataatataaagagtcaacccatattttatatatgtatcttattctgtattttataataaagtaagctagaaaaatgaaaatattattaagaaaatcataaggaaaagaaaatatatttattattcattaagcgaaatggataatcctaaaggtcttcattcttggcatcttcatgttgagtaggctgaggaggagatagagaagcgatcggtcttgctgtctcagggtggcagagtcggaagataatccacgtgtgagtagactcatgcagctcaaacccatattgtccaaaggttaatcgtattcttaggaaaatacagttttaaaggatcatgttctgatttaaattgcttgtgtgttgtgaataatctaccaatcattttttcctgtgatagttaccaaagctatgaacatttggagggatatgttaaagggaataagagctacaaaaaattgagacaaagaaataatatttaagtctagctgcgaatacaccttcatttttgtagaggctaggtagtcaacgtttgtttaaaagccatacatttgtgatctctccccgtccacatcctcctgagaaaggtcctttgctctttagcttggatgtctccttatctcagccccagttctgcaaggattcagctttagatgcattctgaggcctctcctctcttacccacaccaagggaacaccctacgctatgacagaaactaggtcttggcctctgattttacgcgtttccaaagtaactactctactggaggcctccaacactcagaagctgacaagtagtaatgctcatcttttttacctcctaaaagctgatcatgcagaaggcatgttagatcatacagaactgaagcatcttcccttttctgagtctctcctttcctcccttctgttcattcctttattcctttgcactacatttctttttctctttctcatctccacttaaaatttctttcaatttttctttctatccaacttttaagtcaatccatacaacttggatatatgccttcaaactgagttaaaaggaaaatactaatagttttatctctcatgaaagcaataattaaaatgacaccatctaataatttaatgtaaaaggagggaaaaattctatttgtattcaactcttttgtttgggcctataaatgaagaactataattttgtaaattatagtttaattttagaaataaaaatgacctcttccctaatatattttaagttgcattttaattacaatttgtaaggtagggcagacttacagaccatccatatcccttttcatgtgaagtatctgtcagcctctggaccacagtaaactttgtcattcacagagtggattcttttttggaacatacgtgataaacaaattgaaataaaacttcactttagttataaaaacttgtagttataaggacttttgagaaccttgcagtccattttttttaccttctatttgaaattccaaactaatttcattgtacttgtaacaatcttccaagaactgcaatcctcaagttctctctttgttatccacttcatggtttcactgtggtcactgcatcattttttacccctatacgcatcttgcttaagataaacccagtggttacttaattttttttttaattcttctttgttttcattctttttaaagaggaacagtaaaataagtagttaggttttgtgtttgtttttgctttcagtactggaatctgcttggtccaacttaggtagagaatcttgggctccagagcgcatagtttgaaaagatggaaaacgttgttctgaaatttgcattaatctactttagattcaaaaattccacataggctgggtgtggtaggtggctcatgcctataggcccagcactttgggaggccgaggcaaggaggatcacttgagctctcaagaccagtctggaaacatagcaaggcctcatctctacaaaaaatgaaaaaaaattacctgggtgtgatggcacatgcttggaagctgaagtgggaggactgcttaagcccagggaggatacagtgagcaacgattgcaccactgcactccagcctgagcaacagagcaagatcatgtctcttaaaaaatatatgtatattttgcatagagtgtctcatgatgactgaataaaagaagtccagtggttaactaatctataattaatcatagaagcaagaggtttctgacaaaatgtattcagcagctttaaatatgaaacccacaaattatatttccagaggtcaaatttgcatataactccttgaactatgactatctcctcacattcaactcagttttaagatccagcagtgtgttgtacaaagtaatcaatggctaaattattcccattttgttagctcagttcacagtagcccactgactggtttaaacaaaaaaaaaaacttatctgatcttcagtttgtatttcaactgtacccaagtgcagatgccatctctggtaatatgacaaaacagatttaggtttctaaatgtttctgtatgctccaataacagtatgcagcctgcagtaactatatcgtagctcaaagtgttgtaaaaaaatgcaactgagtttgctgaagaatcattttagagttaattaaaccttctccacctgtaatttaataaaaaaaagaaagcccaacatactcttaaagacgatgggggaaaggcagtttaagaaataaaagtcctctgtttatccagggaggtactttacaaggcagacagctacaccacagtagagagacaatatttcctcagctgagtcggttaattaaaatgcacagttacaacagactttcttagagcctgcagctgaatgactgaagtctccattttactccagtgtcacacagaacatgaagaggcaaacatactgcctgaacacaatttgactcactaaaatccagcactataaacacaaaatacatttctcgagtgcattttaaaagacttattatcaagatttatgacataaggatagaaataatttgcaactaggcactgccaggagaatatcttaggttcctctcaaggtaattttaagtaaaatttacaaataaatcttaaggttagagtccactttgaacgcaggaatcttcacctctttcctttcaactgtatggaatttgaatctgacaaacaacctgtctgttgctagaatttataagtgatctgaaaaaaaatcaaaggccataaaagctatttgtcaaataaactgcagaacacgatatcagtctgcagggctcatttgcagaactcatgatgagcatgggaggaggggatgctaacagctgcagccttgaccgcactgcccgtgccagccagaattcaagccgcgtgagctgagtgtggctgaaagagggagcacacaaatgacatcttagaagacaaaagcaaaaaatgacaaaagaggttcttatatccaagtttttattatatcagtacatcagcatatacagaggatgacctaaaaaaaccactttaagatagatgggccggcagagttttaaaggttttcaaattaagtctgttcgtggaagacttactttgatttcatggtgtaggagggagatcgtagacttcgaatccactagacctgaagttaaataaacctggggtgcagttttggttagcctggtagcacggcatggtatcagtttcctcatctgtaaaatgggaacaatacttcatgtcccagcacaattttgaggataaattgagataacatatgtttgcaggcacagcaggtgtcagtaaaagttagttttctcctgtcgtttgctagatattttcacaatgcagcaagttgattcaagtggtgaagtggaaattctcacattaaacacataaattgccaagtctgcaatatataaaaaatgattaaatgtccttgacgcttaccaatcattattaaatcaaacctgaaaaggatctaccagcaatttgcaagcccgttattaatatcctttaatggacttgctctattaagtattcttctgtaacaatgttgttcagcaacacaacagaaaaattctgttgttagtattgtgtttcttctagtaattcaacatcatttccatttcataaacattacttgaggaattagttccattatcctacaaatctctctttaaaacattgccataatgtctctctctctctctctctctctctctctgtgtgtgtgtatgtgtgtgtgtgtgtctgcgtgtgtgtgcatgtgtctctctctttcccttttttctccttcctcactttctcactctctctttcctttctctaccccaaacatggacatatcacaccttcccatactcagcactcaagagaacatgctattgttattacagtaaaccaaaatggtctgagaacttagtaactattacatttctagtgtgaaataatttaggcatttaaaggaagaaaacacaatatcaatatttatgtttttaaaaattccagtagagtctgtgaaatgatggctaaattaagcaaaagcaaattaatcaaagagttacaaaggaagaattccaatgggcacttaatgagcacctataatgtgcaggcacataggttgacttttctttcttcccagggcaaacaaaatagcttctcagggcaagggatatcagaaatttggagtcacattaataggaaaagcactgagttaattgactggctttggaaatttacttcacaaagcattggattttctcaagagacaaatttgatacatgtccttcactggagacatgaaaataattcgttctttttaaagactttgaaaagagcagagacgagaaaagctagaagagtttctaaatgacacaagatctgtgaaatgatagatatttagcataaacctcatagagctgttgtgtggattcattagttaattagttagttaatgactttgaagtgttaaatcttattagatttttttttacactttaacacatctgagagagaaattactcttaaattagaaactgactataccactcaaaaagaccatctttttatggtatatcttcaagatgctctttcctgttctgaatttttttcctgaaatcctgggaagcctatctacatcctgatcccaaatccaattcccccaccctttttttttttttcagtattagcattggcttccagttaacactaagcacagccttaagaaactctcacggcgaggtgttttgtataaaaatataaagatgttatgtggtaataatggcatcaagaattaaacatgctacttaaacatagttttgtacttttgtacagcaggggaaaacaaatacaggcatacctcagagatatttcaggtttggttccagaaccccaccataaagtgcatatcgcaataaaatgagtcacacaaattttttggtttcctagtgaatataaaagctatgtttatgctgtactgtagtctattaagtgtgcagtagcactatgtcaaagaaacaatgtgcttataatttaaaaatactttattgctaaaaagtgctcatgatcatctgatcctttagagaatcacaatctttttgctggtgtagggtctttccttgatgttgatggctgcagacagatcagggtggtggttgctaaaagttgaggtgactgtggcaatttctgaaaataagataacaaggatgtctgctgcattggttgactctttcatgaaagatttctctatagcatatggtgttgattgatagcattttattcacagtagaacttctttcaaaattgaagtcaatcctctcaaactctgccactgcttcatcaaataagtttataagtttatgaaatattctaaatcatttgttattatttcaacaatattcacaacatcttcaccaggagaagattttatctcaagagacaactttctctgttcatccataagcagcaactcctcatccattcaagtttgatcatgaggttgcagcaattccattccatcttcacactccatctctaattctagttccccgctatttccaccacatcttcagttacttcctccactgaagtcttgaacctctcaaagtcatccatgagggttggaatcaacttcttcctaactcctattaatgttgatgttttgacttcctctcatgaatcacgaatgttcttagcaacatttagaatggtgactcttaccttaaaggttttcaatttactttgcccagatccatcaaaggaattattatccaaggcagcatgagacttataaaaggtttccaatttactttgcccagatccatcaaaggaattatcatccaagacagcaagagacttataaaaggtatttcttaaataatactctttgaaagtcaaaattattccctgattcataggctgcagaatggatgctttgttagcaggcatgaaaacaacattaatctccatgtatatgtccatcagagctcttgggtgaccagatgcattatcagtgagcagtaatactttgaaaggaatctttttttagcactaggactcaacaggaggcttaaaatgtccagtaaaccatgctataaacacatgtgctatcatacaggctttgctgttccacttacacagcacaggcagagttgatttagcatcattcttaagggccccaggattttcagaatggtaaatgagcactggcttcaacttaaagtcagcagctgcactagcctctaacaagagactcagcttgtcctttggagctttgaggccaggcattgacttctcctctctagctatgggggtcctagatggcatctttttccactagaagattatttagtgtaagttaaagttctgttgtatagtgtaaccaccttcatcaattatcttagctagatcttctgaataacttgttgcagcttttacatcatcacttccacttcaagcgttgtgctgttttactttgcacttttatgttatgaagatggcttctttctgtaaacctcatgaaccaacctcttctaccttcaacctttccttctgcagcttcctcccttctttcagcctttgtagaattgaaaggatctagggctttactctggattaggctttgacttaaagggaatgttgtggatggtttgatcttctctccagaccactaaaatgttctccatatcagcaataagtctgttttggtttcttatcattcatgtgttcactggagtagcacttttcattttcttcaagaacttttcctttgcactaacaacttggctagctatttggcaaaagaggcctagctttcaacctatttcagctttcaacatgccttcctcattaagctttatcatttttatcttttgatttcaagtgagataaatgtgactctcttttacttgaacacttagagaccactgtagggttattaatgggtgaaatttcaactttgatgtgtctcagggaatagggaggcccacagtaagggagggaaatagagaatggctggtcagtgaagcggtcaggacatatttattgattaagtttgtcagattctatggttgtagtttgaaggaccccaaaacaattacagtagtaacatcaaagatcatggatcacagatcaccataatagatataataatcatgaaaatgtttaaagatgtggcaataattaacaaaatgtaacacagagacatgaaatgagcacatgctgttgaaaaacagagctcatagacttgcttgaaacagggttgccacaaaacttcagtttgtaaaaatcataatatctgcaaagtgcaataaaatgcagtacaataaaatgaggtgtgcctgcactctgttggataattaattctgtgagaaaatagagagggagagaattggaatccaatgataattatcttattctttggaaatagtgatcacattttgacctgcatgctggaaagttgagaaaggatagcagcagcataattaagttagcaatattttaatatgtgagagacatttgtatagtttaaacaaaaactttttttgttggcatataatatacatagagaaaagtgcacatatggtcaatgtacagcttgatgaataactgagcacacacaagttctctgcacacagatcaagaaacagaacacatcagcagtgtttcaaagccccctctagttcttccaatcactattcccatacccaaggtaaccactactgttacctgtaacagcatagggtagctttatctgttttggtactttacataaacgcaatcataaagcatgtacttttgagtctcacttatttctcatttgacatcatgttttacaagattcatctatattcttgagtgtagttgtagaactacatatttctcatctctgtccctccccattttctctccccaccacacccaggcacacacatagaattaatccccctcttattcaaatgatggatctacgtatgtacttggaagttcttgataaacttcttttttcatgtattccacagcatgaatgactcaggaattgctaatgaaaattttcctacagtctcttttcttggcgctggtaaatcttaatcttagaatattttgcatttttaaaatctattcatgtacacaaccagctccaagaaggacactgaggtaatcatctttttaagttgcccttgttttcagccccaaatccctgacttttacttaatctctccagggcagccttctttctgtctctggccttcaacttagaaagccagccctactctaatgattgtattagaaaaaacttgcataaactactttacaccaaggtgttcatgcctaaatctttatctttccaaggtatggccccaggacagtgttgtaacttagaggaccaattactctctgattactctctaatggggtatcttgtacagatgcatttcttgagttgttctgaggtcccactatattaaaggacactaagaaacagagctatcacactcaatgctggttttactattagaacattattgaaattaccatttcactatatcacaaggtattttctttatgagggtccatggggaaaggggaatggttctgcttcttctacataactttattttaaaatgtgttgttatttaagcaactgagcctgccctctttgtttcccccaccctctctcactctgtctccctctcccctgctgaaaatataaaaaagcatcagagacaaacactaataaatttccagagactaataagtttctaggacttcataatttgtattttttccctacctttctcacccttggtttcacatactttttctttcattctgttttcaaatatttttttctttttttaatcttgataaatttagggaaaatacagattaactcaataaaatatactatttcttaaagaaaaaattttaatcactgacactaagttaggctggccaagagaggaaaatgcagtcatgtggcgcttagcgacaggaataggttctgagaaatgcatcattaggcaattttgtcattgtgcgaacatcacagagtgtacttacataaacctagatgacagtctactacacacctaggctatatggtataggctattgctgttaggctaggaacttacttgtatagcaagttactgtatagaatgctgtaggcatttgtaacacaatggtatttgtgtagctacgcatatctaaacatagaaaaggtaggataaaaacacaatatcataacttgtgggatcaccatcatatatgtagtccctcattggccacaacattgttattgtagtgcatcactgtatattttagggagagggctcttctcgaaattctcaaattatgcccacttggtgaactgtgatcagacagactgaaaaacctggtagttgaggcatcgtataacatagtaccatgtacaaagaaagttttaataaagcttttctgaatgcattgaccaaagatattttccaacaagcaaaatggacagaatggggagaatgtctaggaaatatctagatcaaggataggataaaagacaaatgcacttgcgtaacaacatggagatgcgtttttaagagagcagacctgttactacatgtgttatgtgacactttgtgacaactgaccgattcttattttcaatgctctcaattaaagatctacttgggaagattttattaatgtgttatttatctaagagtcattgatttatggagcttaaccataagatatagcatggctcattttcattataaaatttatatctacaggaagaataccacaaggacatggggtgttctatcctggactggtaaaccacatatgcaatcacaccaactgatgaaattgaacatattaaatgataacaatctgttatttgctcccttcattcctatgatcctattaaaatgaagtaaaaaaaatcccagaaactcaatgtgaatccataaatcataacataaagcagtccaatataatacttcagtgaaatgttcttttcagtaaaagagagggaggagaaggtgtcaagtgtgggtctcttaattaggctttgtattaattttgagaacaaagacataattccagatcagataaattataattgtgttatttttttctttgctgttaaagctatttgattaggagactctggaaaaagcatgtaatcttgcaaacaaatataacaaatttattgtcaaacattagcaaaaatttataatctgcattgataacattcctaaagtattcaatggagccattcagcaatatgaaagaatgcaggcaaatttctatgattagtatttattcaaatatatattttgccaaatcaataataaatttactgagaaactatcagttgtggaaatattatgataaacatcccctttaaaaatcactatggccagaccaggtgctgtgggctcatgcctgtaatcccagcactttgggaggccgaggcaggtggatcacctgaggtcgggagttggagaccagcctgaccaacatggagaaaccccgtctctactaaaaaaatacaaaattagcctggcgtgttggcatatgcctgtaatcccagctacttgggaggctgaggcaggagaattgcttgaacccaggaggcggaggttgcagtgagccaagatcgcgccattggactccatcctgggcaacaagagcaaaactccatctcaaaataaaaaaaaaaaaaagtcactatggccaatatgaaaattaggacctgttaggttgaaaacatccagtctgcagtgagtataggattaaacatgattggagtaccactacgtatgtttcaaatgcttatagtatgtgaaaattaaagtccattttcttatgcttggcaaataccagcagacttgctagacacaggcagcagcctccaatttcacagggcttgtgttcccaatgcacacctaaaaggatagctttctcacatgttttgtgattctaacaatgtgtgcagagaggaatggatactgtaactatgaaatggaaaagctctagatttctgagtggttcagaatcacgggcctaaagccagacattaaatagaaaacttgtcacttcacagctcagaaagttctaacatctccccatgacttaacacaatctgggctcaacctagtctttctgtttctctatgcaattactcttaataccaatatgctccaacaaaaccatgatttaccactctttgaacgtctccttcagggtctatctctaatttgctcaaattatttcttctgcctggaacattgctttttgacaaattatattttataaccaaatttaactcttacataaactattttctgatacaaccaaaagcatttttcttccccattcaactctaattgtatattattattattttacttctatagccattaaaattttctaacttgaagtatatttacttatatctataattatcttcctttcagggaaattttacagggaggaaaaaatcttacattttttttgtatcctaaacatgcttaaggcaggttttgagatatactatatgtttaataaatgtctgtttaaagaatcatatgtgaatacatgaatgtcacacttgtgagagtctcactgagactctagtatattaaacaaaagatccttatttccctatctttgtcaaaatatgtatgatatttgagatttagttcatatcataaaacattgcatttaatatattttatatatttttaataaatgtttaccattttcagttatgtgaatggctccatacagcaaaagaaccattagaaatataaaagcatcatcctatgaagtataaaattactcctgaattataagcaacctttgtagctacatgcaaaacatttattcagctgcaactatttaatccttacaaaaacaaaaaagcatgagttcatataagggccacactgtgtgaggggcatagagagagattttagaggcttcgcacagtgcagggagtttggtcttaacccattttataggtaaagaaattgaggtgtaatcacatgagacagaatttgaattctgatctgtcggattcagcacctctcttgtcactgtgcagaaactccctttgaatgctagatttcctctgaatagatggtatgcttatttaaatacaagacaagtcattttgccttgctgcactgtatttatcacaaggctattgccagctttttctttaacattaaatacacacacacacacacacacacacacacactgtctttttttttttttaagacagagtcttgctctgtcacctggagtgctggagtggcgtgatcttggttcactgcaacctctgcctcctgggttcaagcgattctcctgcctcagcctcctgagtagctgggattataggcatgcaccaccacccctggccaatttttgtatttttagtagagatggggtttcaccatgttggccaggctggtctcaaactcctgacctcagatgatccatccgcctctgcctcccagagtgctgggattacaggcataagccaccatgcccagcccaacaccatatcttttaaatggcttactatgtttgaggcattgcaataatgtgtcccctaacgtatttaattcttacgacaaatctatgagataggtactgtttactcatattccggatagggaaactgggcatagaaattttaagtaatatattgaagatcacagagatagggcatgaaatggaatttgaacccaagtctttcttgctcctgaatccaaattcttaaccacactattggcttttgttcctctccattaatcctgaatgtgatttatttttttcccaaaaaggaaactggattacttgacctgctgtttgttcagaatatttattttagcatgtgaaacatttaatactacactgggaagggatctagaggacagaaagtggaggtaggggatgcatacagagataggctcatctcacctggcctgattaagttgtttacatttttcagaaagcccatctccaagtccagccctaaaataacagtgaaccttcatctttaatggacataagaccctgtctcagaactctttagataaacagagcacttttcagagagggagctagtgaccttgacaaattggctggctttcctctcattccagatccgtgacattcagcagctaagcctaatatgggaaacaagtcaatattttccagcatgctgggtccattttctccccccaatatttttaagcataagacaggtgcagaaatcacgtcaaccaccactggaggggtgtacagcagctgtcacacagccacacagtggcaaaagtctttgctaagatccaaaatgaaaagaatactcattgtaattgaaactatgcaggggacagagcttcccagatgcatacaaaagttctgaggctttgaaaagagacagatgtcacttttatactcaatctaagagctactacctttcaacagctcatcaggaggtaaaatcaaatcttcagagacaaaagacataagcaacgcatctgtagcagccagaaagtaaattttttaagctacgaagggccttggagacgattcagggtatgccgtcttgtttttcatttgatgacattaggatatcatacctaatggaaaaattaattgtgtgtgtatttatgtgtgtgtgtgtggaggcacgcacacatgcatgtgcatcatgatgatgtactacttaagcaataatgggccattatagaaggtaaatcaattaattctaagttgacattgtcatagtcaggtaaattgaggatctctctgaaaatccattttcctttataatctgacttgcaattattatcaatgtacccattatttacagccagggactcttctgcttggttagtgcttatgtcctactagttgttaaatattttgaaaattagccctgcttgtaatttattatataatttcaacaattttaagataagcctgatacaaaaacaggttcttccctggttagctaacctaagagtcaaaagccagcacagtagtgttacagccgttcagaatgcaaggtatcctttgaaatacttccacagaagacctccaagtagttttcaaaaacctggagctattaatatgattcccactatgttctttaccttccactgaagaaaacagagcctactgagaaacaactctagtgtacagagaaaccaaccagcaaaaccaagtggaagtttctattcaggtctgacctcggttatcttaatcataaacctgacccagttgagcctcgctgatgggctcataacttagttccctcaagatctttctgacttttgtgtaagcaacacacaaatcaatccagcatatcacttctgatatcacagaaaagtaattcttatgaagaaggaaatcattaattgtctttgaatgtgcacccaccaataattcaagttattaaagacaaaaatcttccctagtaaatgctcactgccggttgtctgaaatgagagagttgaaaatgaatacatgaatcaaggaggtttattttaagattttccatattttgatcaaatggtgatgattacattacattttttttctgtactttcccaacaaagaataagtcataccatcatgttcttccagaaagactctttgcttgaaacagtcttactggcacaccatagttagttatgactcatgggttttgtttttttctaagatagctataaacttcaaagatacattaccttataaaaataataaatattgcttagagaatttcatctattttctacataataattttatctttgaaacttaaaatagatatcatccagattgtgcttctgatatgttttatgacatgctgacactgtcctcctaagataatattagatgatataagttttatttttttaaaaattagcccaaggctttgtaggccaggttctagagacactggtcagttcaaatctcaaccagaagagctatgtgaccttggaaaaataacccacccattctgaaccttcatttcctctgctataaaatcaggataataataaaatctatctcaaaaggttgttaagactatcacagaagttttgaaatacaaaataattagaacaaagctggtgcatagtaagtgctcgcaaatactagctgttacttccattctggatatgtacatcataattcctaacttaaaatgctggtcaaaaataaaatttatgcctctactagtcagtaaatccagcctcttctaaacataaaatatttatttaaaataaagtttctagtatgaaatttgaaatatatagatttttcttaatacatttcagtatctgcttttataaattgaatgtaaccatatagtatttgacagacaaatgtgaatcatgttgtaaaccatatatttgaaacttatcttaaatttgttctgtgtctagttaaactaatttaaaaatcaaggttgctgcttcttgagctccttttgcagggctcctcagtgactgcagaggagaaataaaaacgcttaaaatagcgaaaataatgtgacaacattcaggcaaaggcaaggctactatgtacaggagagcatgttgtgcactacacggtcccgcaatggattacaatattaatgctgacctcttagggcaaactgtaggcactggtcatgccccatggatgaatatgaatacataaacttagcttcagttaaaattatgtcaaattgttaacagaaggaaaatgaggtttaaagtccattgaaaattatttttagataaatttggattaaaatccaatgtgctagcaggcctcaaaatgttaagtgatttcctgagaaactgtcacagcccaggtatacccttccttggcggaatcgactgctactttttcttttttaattgctgaattgttcaagtctttcccacaaaaggctgattattataggccttgggctacaagtagagaaattactggactagacctggagctgtggattctggcctaaacactgtcattggcttgtaatgtaattttgtgcagttttctcatatataaaacggaagtaataagctcagatctcaattaggaaaagtaccaagatactagacgtaaacatgctttggaaaacattggagcacattaacatatatagcattatcaaagtctttccaaatttcttatcatataatacatggtaaacaacaaaatagaaggaagacttcctctaacctctgaaaagtcagaaacttttcctaggtgcctttggtattttctaatcttactctgagtattgtttccctgaaaagatccattttattctgactcaggtacaatataagacaggaaaatggatgttatatacatagatcatcaatagagaataggaagaaaaagataacgattattttgtggtatcattgtatcatgactctgaataatatctatcaattactgattactcactatgtaccaagcccagtaggcactatagaaatgtataatatcttattctcacaatcaccctatgatgtaggtgataaaatacattccaaatgacaatgccaattcagtaaaattaatcatcttgcatgacagtatgcatctaagaagtcgagggagacagaattcaggcacttatctgtttggctccaaagcctacattaattccagttttcctcattgcctctcataacagctggcacagagtagacactcaataaatgttggatgaatggatatatggatagacacacgactgcatgacttctgggaattagaatttataagagcaagactgaggccacctatctagactgtcacaaactggagatcagcctccattgttcttcctcttctgtaatttgaaaaccctaggttacaagagtttcttcattgatggtataaacattacccattctcctagtatttctgccttcacagatgagggatttcaaattcttggagcccattgtgtctcaccttcatcaccaagatctgactggggggtatctttctctagtgacgctacaacatggcatttggaaatttgcttaggcaaaatttagtcattctggtcatggagtagtgctctgccagaaaggggtgctcaaatctaacttgcagagcctttaagggaattctgcagaagctgacaaaaatattaagaccctagagctatggcatttggttttgttcttgtgcattttgcaaaggtacctgaccacccaaggaagaagaacctttttgcttgttagccttcatatttcctacatgtgggggctgcatctgcccaaagagttcctctttttctaattaacacaaaggtgatggataggccagtggctgtcttgtgcaaatctaggatgcgtttcaataagccagacccagcaaatgattctcaagcttagtaaggtttgaaaaccactggtaagagttttgggagcagaggggattcttcccaagggaagtgggagtaaattgagccttaatgagtaggcattgcttgctatcttgttaatgtattgaccctgtaaaaccaactgatatccagagttaactggcttgcagagcttgggctgagaatctttgcaagttattgtcatccaggcaataaacaataattacattatttctactccttagcaaggaggaggcaagctttgcaggcagctagtaagagttgtcagttccctccagtgaaatgttctctgcaaaaagtcaatagtcaaaaggcataatgctgtcatttcagagtgaaattaattcctcttattatttttacctgttgctctgttttcctgcagagtaaatctcagtattctgactgtgtttaaaagcatctgtatttttccaaagtggttgcttaactgatttcaactgaatttggcaaatcacactctaagaggagccagaaaactgatgcagtgacaggctcaacagtaaccaatattccgtttaatcctaacccttaggagatctggcaagggcctcatcctcctacgggacaaaaagagtttagaagctttttggggaaattatgtagtaagtgcacagcaaaaagaatgcctaatggctttgctttggggaaagaaaactagtggtaataaaaccatggaatgtagaagataattcaaaagggaaaagtggacaaacagccataatgctacctagctctgtctaaattgaattcatgacatgtatctatcacacatttcctgacaaaccatctcctgatgggaaatagagaataaacaggttatgtgaagtctttagtataatgttttctttcttggtcaataggaccaactttatcaaagatatctcccacagtctggcttcaccaagtaaatcaaaagaagtgagatgtaatcttttattatcattttttcctaaatttactatttgctcatttattaaattgaaagaatacatttattccacagtagaaatgagagacaagtaaaaaatactttagaagaaatatatccagaatatgtgtgtgtatatatatacatatatatatatatatatatgcatatatatatatgcatatatatatatgcatatatatatatgcatatatatatatgtttgatcctgaaggaagattacaaagttttcttgtactcttgggcatagtgggaaggacattagaatagggtaaagagtcctgggtcccagtcccagcactggtgcttaccagagctgtgccagtctggattctgtcaggaaacagatgatacactcaaaaggagtgactcaagaaagttaatccagcaaacctttgcaaaaatgtaggccgacttagggggagctggcaaggatggtgaaacatggggacagcatcagcaggatggcatcaccatcctaaggcagaagacaaggggaaaatttgctagaactgctgaaaagtgtgcttacaggagatggtcaccagcattgcagccactactaagctaggcctgaagggagccagagaaattagagttctcctttctctctccttctgccacctggacttacgcatatgaaccctacatatggccaaatgcaaccagaagcagtgagagggccctctgaagcatttcataaaggtgagcctctgtggcctggagcagggtacagaggaagggtacatagaactagaggggccaaaagcagttattgaacacacaaactatgcaattttgatcattcatccttgctggccttcagtaccagcttccagaacattaagaatctgagccagataatctcaggagtttattccatctctagtatcatttgtgaatattgaataaaagagaaaggaagaaaataaatattctaattggcccaactgatttatttgaaacaggaagatttagcaacttagcatttattggttaacaaaccacaggtctttttttcctccacctgctttcttgcaaaaaaaaaaaaaaaaaaaaaaaaaatgcctgtgcctgaaggttatttagaaaaactcttgaaagctattaatagaaagcagatttaaactcagtctctaaaaggcttaactttgtgtactatagttctgcctttgtagaaaaataaaaagcttttttttttaaaaaaaatagcatatagctcagattattagctatctctttgtcacaaatgtgcagctgggttcagaatttgcatgtttcccaggcaaaagaattcaataagtaagtaagcgaatcctgccattttattaaatacttacagaaaacaaaagcaaagcaagctttaactcagccggaaccagaacataatccccagagccaataacacatgttaaaattccagcaccagagccaaatttgacaaaggaacactcactatcctactactcctggggcaaactatcctaattttgattctcacactcttgcattttgagatcctccaaatatgactgctcaaagaagaaggaaaggaattaaaatggggagagctaaggtttgagatttaaaatgcactttcaagatacgtgataaatgggaggttcatgaaagttccctttataggtcagatatcatttaacttgtccaagtagttacgcttctattcagacatagggagagagagtgtaaatgaattatctcctccccacagcctttctacagacccttctctcttaattatacacatccccattgcacaggtcctgccaagcgctggtatccacagggtagatgttgaaaaaagttataattactatcttcagtctgctgctattttacaccctcagactcacggcaaaagcttacagcagaagttggcttagtgtcctaatgcagcagattcaactttttgacaatcttttattctcttcaaaacctcttcctctctatagaatttcatgttcccaaatcttcagtgataatggtagcattctcagggaatgcctggattgatgatcagggaactctttgagctagaaaccaagacaggatttctatttttattcctgtttcaatcctcatgcccagtaaaaataatgagatgtttctttaaatcatttattttatgaagaggagtcaggattatcattctttccacttctgcggcaattgggccaagagaacaaaaatatgcaagggttcagaattcagtcccctgagttctaagggctctgcccctggttatttccatgagcttgggaaagagaattaacctctctgggaaatctggaaaatgaactggtgaaagtagatgatttctacaactactttcaggtctaacattccacaaccttatttgtgccaatgcccccattctactctcagtgcaactgaacttacttgtccctcattgcaatctctaatttcttaagctcgtcctaatttcttagcacacctttctttcttttcctagctttaattttctctctatccgaccagaaactcaggagtaagaaactttgctgacacaaactgctatctttcttttctctttcttagccccatcttcttctaccaaagccatttggcaaggtctccaatctcaagactccctccacatctatactcctatgtctaagtttctaagcatgagttggcaacacctcaaacaacagatcctgctacaaggctagtctgtactgagtttataattgtttcctttcagaagtctcttcaagccaggtatgtaagtttcccatgttgaccctcatagctatttgaaatttttttttctttgctagcagactccctaaaaatatttctttctctcctctttcctcaagctctctgccttctctctctgcagataactttatttttcataaagtgattataataaaaccattttcacaatgaaaatgtgtagaatttaaaatacagaagttcatttttagtttaattacattaacataaaaaatgatcacaaatctcctacaaaaatcatggagcatttttgcatttctatatcacttccaactcagcttcattttgatttataagcttgactacacatctagctgtcaaaccagatgttgtatggaaaataccagctaagtctgattgaatttttcaatttgcctcatttgaaaccctacagcaaaacagaagtagttaagaacttcaaaaagttttagagtagagaactaattactaattacaatgatcttttctcagataatatgtagcatgaaaatacaagttaattattcacaaatgactacaagagaaaagagagaaaaacagaagacatttgttaattgaatcaaatattgtgaacatattccatctttgacattctgaaagatattggaaggttcatttaaatttgcaagcatctcttcatagcataatattccaaattaaaattttaagggggaaatacagaacagaacagaatggcataggatctatggtggatagcaactttagttttaattccactttgtgactgcccttagaaaaggggggatggtagggttaggaatagtgacagtgttgataaagcataggagaaggaaaggatctgtagaaatcttgagagtgaccctaaaatgggaatggttcttaagtttttttgctaaggactactagttaatcacaagggatcctttctgagaacaatgtttttaaatgcataaataaaaatataggactataaataacttcaattaacttgacatagttatcacaatattaaaaacacaaattagtgatacagtaatagatatgctaattcataaaatgttcaatagcaaggtcttctagcaagtctagaaactgccatcatttcaaaaaaagttacgaacataaacattatctttaaagctagctataatacctgtagtctattatgacaatattggtgatttctattgttttgtatagtctctgatctccagttcatctcattctctctcttactcactccaaaattttgctccacaattctaccaaaactgctccccttaaggccatcaataaactccacattgctcagtctaaagtcagttctccatcctcctcttacttgaactgtcagcactatttgacacagttgatcacattctccttcttaacctaccatcttcattacattcaagcatgccactcactggtgattttcttccaacctcactgggactctcttgtgaagttctcttttccatttcatcttaccaacctcttaatgttggggtgtcccaggttagcccttggaccttctcttttgtgtgtaaatttactcctttagtgatttcatcaatactactgatatagacaaatcaagatgactccagatttatatccatagccttgatctctcccctgaattctagatttgtatatcctattatctatacaatatttgcatatattaagtttgaaatgtctattactccttgaggacatttcaaaggcttaatagacatttcaaacttaatacatgcaaagtgactatcctgatcttcacctccactccctccccactaaacctattcctcctctaatattctccagtccagttaatggcatatggaggccaaatgtttgaagtcattcttgatgtttttccttctctctcaaagccacttccaactcatcactaaattctatgattagaagactccacgctgtaaatgtaacttaagtctctcattttactaaccatattgccactactctggtttaagccaccgttattcctgtcttggtttattgaagtaaggcttccaccttcacctcatctcaaaatgtgggctagagtgatcatttaaaacataactcatagcagtcactttcctgttcaaaaccctctagtgacatcccccatttcctcatcatgaaaggcaaagtaattacaatgcctcaaggcctaacagaatttcatacaatatacattttctcactgaccttatcacccactagcctctctttggcttattacaggaagagaacttcctcatggtctccgtacttacacctccttctgcctataatactcttgccccaaatgtctgcctcctcaactcctctaagtttttttttgttttgttttttgtttttgtttttgttttttttttgagacagagtctcactctgtcgctaggctggagtgcagtggtgtgatctctgctcactgcaatctccatctcccgggttcaagcgattctcctgcctcagcctactgagtagctgggattacaggcacgtgccaccacacccagataattttttttctatttttagtagagatgggatttcaccatgttggccaggatgttctcgatctcctgatctcgtgatctgcctgccccagcctcccaaagtgctgggattacaggcgtgagccaccgtgcctggcccacctcctctaagtctttattcaaatgtcccttcaataaggccttcatgataccccctacttaaaatggcttttagaattgtttctccttattttactgttctccaaagcaattatcaccatataatatagtacttattttattcatttgtttatctgtcttgcccaacaatgcaccccataaaggctgagatttttgcctggtatgttcacagatctctccccagtgcctggcataaggcaagaattcaataagtagttgttgactgaatgaatgaatgaaggggttctttggaatcttatcttccaggaagtctagcacatttatccattgcagtaagactcacacatacttctacttgccaaaactatatcatactctgtaaattaaccaaaattattttaaatgtgatgcttgaaataaaacaaagctagtacttacagtatttgctatagaaatactgtaaaaactaactagtggctcacaaccacatgggacagtgcatccacaaggagatgcttcattatgccatggaagagcaagcactttgacacaaacagacttttagctttgaactccacctctgcaacttgtgagctgtgtagcactgggaaattatttacctctataagcctcagttatttgcttgtagtatggaaaatgtgattatatgattaatgcatcttaaatgaaattatatgcacaaagttcctgggcacttgaaaaagatgatcctttcatcattcctcttgacaacgattactttccaagtagatgtgagcaaataatagtgtacttaaaaatggtcaaatataagaacaggattggaaagactgtgatcagatgaactgatcacctgcagtggtagtttgggtagagaggtttactgggttcaccctaaccctgacagttcccacaaaaatgatatttagatcccttttcagggtaaggtatagagggcatgtcgaaaacaggttccaaaatagaaggagaccaagactctattcatgagaaagagcagggtgagacattatcatctgaaatggaaggtgacaaagccaagcagaatttgggctagaaagtggtgttgccccattctcaaggatttgttgttttatcagtgcatagacatcaattttttttttttttttaagatggagtcttgctctgttgccaggctggagtgcagtggcgcaatctcggttcactgaaacctccaactccctggttcaagcaagcaattctcctgtctcagcctcccgagtggctgggtttacaggcatgcaccaccatgcccagctaattttcgtatttttttttcagtagtgatgggttttcaccatgttggccaggatggtctcgatcttctgacctcgtgatctgcctgcctcagcctcccaaagtgctgggattacaggtgtgagccaccgcacccagccagacatcaatttctgtccacagtaacatcgtaggaaaaactttgtcacactgctttgggattcagcacaacattcttctctttccttagacatttaaagtatgaggattctacattgaagagcaggtcttttttttttttttccgcatttcaatctagatgtttacattggtgggggagatacacttagaagcagtgtgctttttcataaatcactctaccttgtttctctcatactttaaaattacatacatttttaaactggcacaaaagtactgtcttgggagaaggcaagaaaatagataaaatgttcatcagatgataacaattgtaaatattcataaatcagggaccaggattcctatttcctaaggaatgtgctcagcctgggagaaacctcactttagaccagtggggctcttgggcactttcatcatgacatttaaacaataaatgtatctgtcaggtgatggtggattcacttcggaggaactgacacctttgatgaccatcacaggactgagtcaccaattatacctacagcctgcacttggttttcttctcttacagaatttcatgatccctccctaaaactgataaggcagcatggaagtaggagggaaaagggaggagataaagcagatgagaggcagactgcaaacccatccagctttgcaaggactgagcttcatcgctcacagaaaagtcaagttcaagtcacaactcaaaattaaaccctgactaatgtaaaaaacctgtgtttagaaacattttacacaaaagttacattttggaataatagaaaatttaaagctattaaaaagcaataaaataagatgaattctgcaataagattgccacgttccactcttgaattaaagcaaacaagcaaatatttccttcctaaaacttcctgcctttattctgctggcttccactctgtgagggccaactgtgggtcaagccctgttctttgtcccatgccaaaaagacagctgggagccacggtggaaggcagacaatgccctggatttaggtactagtctcctccaggttgtgtttaaaaagctgggtttttttggggtttttttgtttgtttgttttttggctcggcatggtggctcatgcctgtaatctcaacactttgggaggctaaggcaggtggatcatgaggtcaagagatccagacgatcttggccaacatggtgaaaccctgtctctactaaaaatacaaaaattagccgggtgtggtggcaggtgcctatagtcccagctactcaggaggctgaggcaggggaatcgcttgaactggggaggcagaggttgcagtgagccgagatcgcaccactgcactccagcctggcgacagagcaagactccgtctcaaaaaagaaagaaaagaaaaaaaaaaaagctgttttttttttttttgtaattaaaccaaactaaatatttcccaggagggcaagacagttcccaaaatgtctaacgaacttccacgtagagaaaacggttactgattgtcccaaagcaaaactgtagcaaagcctttccctgaatttttctctcttccttccatcttcttttatttctttgctcagtcaaaggccgcatatgtttcaaaggatacttgatataggagggtagaacagtactttcagcatgcagattttttttctatgttaagtgaaaataatgatttcatgaaatgtgccttcccatcattataaaacaattttgagagaaatccatcctccttggcaattccaaagcctgttgtttgctttgcaagcactatataagtctggagaggggcctgaaattaatatagctcagtaccataaaggcagtgtatagaactgtagtcaggacttaagatttgagtcttttgcttccttcactttgacatattacttgagaggcctgtacctcagtttcctaatttgtaaaattgggataacaatagttattattttatagtgccattttgaaaaatagtgaagcttctgacagaagacctcaataaatgttacatattttaaccatcagcattaataaacgaaaacaattttccctatttttggtcagaatttaggaaaaataagttccttttaaattatgtgtagacaattaaattaatcttttaagtaaaaaagtcttattctcatttttgatgtacagaattttagcatcatctaactaatcctaaaagactttgtataatgaaatgaaaaattaatttatttgatgtcattactttttaaaataaccaaatgtcatatatttatcattttaaagaattaatatgcagctgggttaactcggctatgtaatatattttttttttcaggatatacctttcagattattcaaagaaatagctaaaaatgagctatcagattcaaagaagctttttaacatagccaactgtaggtcagttttagtgttaaaaatttaatagatcatacacctaatttacggcgagggggaagcagtggctacatttaaccaaaataagatgttcttctacaaacattaacataagaataaaaaccacaagttttggggtgatcactgataggcaaaccatatttagaacttagcagggttctaaatctgtaagaagaaaataaatatggaaaaaaacaacatgaatcagtgtgctctcacatctccatatctctgtgttacccaacatagaactatagcttatttaagacatgtttagtagcttttcccatactttcctgaattcattccctgtttcaaattcaactaaatgggagaattagaagagaaattttttgtatttggatatcatggcctatcttacatttgatatatgctattgcaattttcttaaaatataagttcatagcgcaaaaagaaatattaagtataacatagaacctggtaccactataagcaggtgattattaacactccattaggaacgttgatggttctgctaatgaaacaatggttatagcaaaaaatagactatttttctggaaacgtgagatttttcttatgtgtacaagcacatacacgcatacattagccttgacataaaccatgaccttctatttgttaacaattaaaacattgtcttatataagcccaggtcatctgctagtggatagatatagatataggtatagatagatatagatatggatatagacatatatatatatagatagatagatagatatatgtagatatacatatatctacatatgtgtatatacatatatacacacatgcatatatatatacacatagcatgcatatgaattacaattaattaatcaataatggtcccatctggttaactgcattggaaaatgacatctttccctcagcaatacaagatttcaaccactacttgcatctgcaccctctatacctttaagcagtatgcaaatgatacaaccatatgaggcgggactatgtaaaacagtccattaaaataattttcccagatcaaataaaaactgacacattttctaacatttattaagaatttttaaaaatgaacgttctaaaaatgaagtcttaagaaaattctgaggtgtgaaacataaagataagagtgccagtgagaaaaataatctgtttagtagatttaaattatcattatatttcaccaaatcctgttaagaaagaatatatcccctcgaaaggttcaattctacaacaatgagtagttaataggttcttagaagggaggaagtcattgtactactgaatagtaataaaatctatgattcagtgtgtttcaaacatttaggaatgctttttgatgaatgggttttttaacagctactgaattggatttgtcctctttatataaaagtctaagtctatactaaaagaaaagaaatttatactctgagcatgaagttaccacttggaagtagttctttgccccatgactgctgagcctgaaaaacccaatctgtttctagaaaaaacttgccaacaaaatccacagaatttattagatagaattactcaagagcaaaataccatctctaccatcatcaaataagagtatgttgctggctgtggattttggtatagttttaatttttaaaaacagtttccaaaacaataccaagaggcagtttgattctacagtatggcaagtaaggaatatcagacactattttagagtatatatctaaataaatattatatatatatataaaacacatcgaaaaaagatatacatacatattagtttgacattaagggaaagaaattaaaaaaaagagacaagatgaatttaaactagagaaaatacaattttagaaccacatttaggaaagacaaaatgaagaaactggatatgaagaaagttcatatctaaaaaaacgtggttagaagcgattggattcaggagtttctgcaaacaaaaaggttgtctcctcagtgcctaaaacagcacctaacagagaaaagacactcaatacatattcattaaaagaagaataaataagtggctatgaaactgggtatacagcaccatattgagtcttaaagttacatttttaataggttaaatttaaatacatatttttggccgggcatggtggctcacacctgtaatcccagcactttgggaggccaaggtgggcagattacttgaggtcaggagtttaagacgagcctggccaacatggtgaaaccctgtctctaccaaaactacaaaaattagctgggtgtggtggcatgtgcctgtaatcctagctgctgggggcgctgaggcaggagaattgcttgaacccaggaagcggaggttccagtgagctgagaacacaccactgcactccagcctgggcaacagaatgagactccatctcaaaataaataaataaataaacaaatattatatgtaaatatatatatttactttatgagctatttcttttaaaataacatccattgctttattttctgactgcaaaagcaaatatactcattgcagaatatttttaaaaatcaaatattaataagaaaatgtaacataatattaatagacagataaaaccaccagcaaacattcatacatctatgcacaggcatttatatttacaaatgtgaaatgatactgtatatcaattttatgtcttatttttataacttatcattacattgtgaacatttccatgtcattaaaacttcttcaaaatcatgagttttaatggcctcatatcgttccataaaatgaatgtgcaataattgaattattatgctattgatgcacatttgaataatgtataatatcaaaaagttggggagaaaattttaagcagctttatccataaaactttaattgtatcttggattatttcctcgggatacatttttatatgccaaattgctgcatcaaaaggacagatttagcatttttgatccataacaccacactgttttcatgataatttgtattataactgctcccagtagttatgaaaatttttattccatgatacttcaaactagaaattttaagatctcttttacaatttgataggtcaaagctgatatacttcaaacttgattgctggtgagattgaattttttgtttgtttattaactatttgtacttcttttgtgtgagctgcctcacatttgaggagaaaagctgcctctcacaacattcataaggcttcctgaccctagagaccctctatatttccacaacatggagagtatctgtaactcctatcagaaacatcttagtgaaacagcatgaaagtttatgaacctcaggattactacatgaacatgagagtaacagtactgacctacctcagagatttctcccacatcattattacaaagtactataaggctagaattgacttggagtcaaggcgagttccataggtttaatgcgtggcacctatctcaacaactgcaaaatcactgtaacttgtaaaaaatcccagggccactcatggacagccacatctttaaacccacacaaaaatacagacactttgattacatgaaagttagaagctctaaactagagcaaggtcagttgtggtaagaaggtattagattcaagcatccacaaaagtttatagtctgtcagtcataaggatggctattgggatttctttacagttactctgttgtattttcactttggttttacagcactatctcttaggaagtcatccatatattacctgcatacacagtcagcttcttctcgatatacagcagatatgtaacaattattctttccttcccagacagtcatggtaatattacatttgagttcagtgaggtaactggtagccagaaatactccacaaaaggtctatattcttgggtgggggggggatacaattcttctattagggaaatttttatcacctacttatttttacataaattctaataatgccaagaaaatacatttcaaagaggaaggtatagaaatttagagatgactgtgacctcaaatatccatgaaatataaccagaaaatctgcatctacataatgacactattttcacatagccccaaaatgatatcttagaaagccaaaaatctttccttatctccaggcagaactatttcaaaagataacaaatgattgcccaagtgatatttgaattataccaaaaaagagacagtatatacatggtaacaccatcctctgtgtattatttcctcttggtagtccttctgtttttcaagataatacagatctcaagaattctcaatgttcaagcaagaaaattccctcaaccaagtgaaatagaaagaagttatctattaattgtgccaggatttcagttgttttctttcctttcttcttttcatgcaagtttatttgcctttctatgagtatttgcattatttgctctttttcccctttgaatcatcttaaaggaaaaaaaatgaaaatgtatctatttggactttaattacactgggcagcaatgaggcaggatagtgaagttaaaaaaaggctgggtgtggtggctcacgcctgtaatcccagcactttgggagaccgaggcaggcagatcacaaggtcaggagttcaagaccagcctgaccaacatagtgaaaccccgtctctactaaaaatacaaaaattagctgggcatggttgtgtgagcctgtaattccagctactcaggaggctgaggcagaagaatcgcttgaacccgggaggcggaggttgcagtgagccgagatcgtgccactgcactctaagcctgggcaacagagagagactccgtctcaaaaaaaaaaatacatacatacatacataaacagtgttagaataagcataagactgtgcttaaatcccaattgtactctttataatttgtatggctttgtgccagttttcatcttctttaagcctataaaaccaggagtgtaattcactcctttactatgaggattactttatgtaatgcacctagtagagtgcccacttagagtaaacactcaataaatgacaaatgtcatcattataactgtgttggtaagaacaggtaagggtataaaccactcccacctcactgaatttgcaggcaattcctggcaatagtgcccaacaaagagaaaatataccataaacataatttattttaattacaagagaccctgtcatctctactattattataaattaacaataggttcttctctttaatatttctcatttctgagccaaaatcattttttttcaacaaggtcagagcatattcttttttttttaaacatgctaatgtacttcagtatattccattctgtaatatttgtttcaggaaatgaaaattaaattttctttaattaacccccatgactcttgaaaattttcctcattgtccttgaatctatggtctttaacagtctttataatatcttgaactctacactccactgagcttttaagctttgtttagtgttgccatagcacacctactccttatgatagaatatcgccttctcaaattaacaacatatagtcaatttattgtggttttccagtttcactggaatgaacaaagatttctttctctcacaggctaaagttttctccctccttcattattcggcttcagagttcaactcctttacccacatgacataatcagctcaaaatttattatactatatatagcatcaaagaatacatttttttagagatgaaatgaggtctatgttgcccaggcttgcctcaaactactgggctcaagcagtcctcctgcctcagcctcctgagtagctggacctaaggcacgcaccactgtgccttgcagaatacattttattaacgtaaaaatcattattttcctcttacttctgcataaatggtatttttggtccatttgctctcggagaatagttaactttgtcattaacaggcccatccagattgttttattacttcagttgataaaaatttatttcataaagtgctttttctaagtaagacatgaacataagcaaacccataatattaaaagctttatatagatacaatttaaaggttctgtcaaatagattttttttttttttttttttttttttatgaaatggagtctggctctgtcacccaggctggagtgcaatggtgcaatctcggctcactgcaacctccacctcctgggttcaagtgattcttgtgcctcagccttctgagtagctggaattacaggcgcctgccaccacgcctggctaattgtctgtatttttagtagagatggggtttcaccatgttgacaagtttcatagattaaaaagtaggataaataaatacagtagagagaaataacatttcagaaatgtcagtattaaaaactaagtcaaccacaagcagttttacatcatgtttacaaaatatgctataatagtaatacacttgaggagggttaaaaatggttctttttttattgcttctcagccttttggctaagatcaaatgaacagttctttttctaattgttcaaattgatttcatagtcttgtaatctacatatttatgaaaaataattttaaatctcttataaatatcaaaaatgtcagtttccaattgaaataaaacagtattgagtaaagactataatgtatgagttttgaaaaagaaaattgacaattagaagaaaatttcataatattcattgtactaggactttccacatttttgatatgacgctaacatcaatattacaatgaattctcaataatttgtattaacaaatgacaagaacaatctgaactaaattgaacaataaagtatctgtaagcttagaagcattaatttcatagtaactaaacttttggtaaccaagcaattctatatagaagacttttaagtatgcccttctaagtttgttttagtaacattctcatttataattagcaatatataatttattttttaaagtgctaaattaaatacactctcaaataattttgttagactattaaattacttattttgtttcaagacggagtctcactgtcaccccagctggagtacagtggtgcgatctcggctcactgcaacctccatctcccaggttcaagtgattctcctgcttcagccttcccagtagctgggattacaggcacccaccaccatgcccagctaattttttgtatttttactgagatggggtttcaccatgttggccaggctggtcttgaactcctgacctcaagatttatccccctcggcctcccaaagtgctgggattacaggcgtgaaccaccgcgtccagccttatttatttttaatcaactttattgaaatataattttcataaaacaaaatgcataaagtatacggtttaataggttttaccaactgtatacaccagtgtaaccaccacacaaatcaagatataagaaaatttctatcaccaaaaaagttgccctgagtctctctgtagtcagtcttcttatgccctaccagatagccactgatctgtctctatcaccacagattaattttgcctaatttcgagcttgatacgaatgaaatcattcaatgtaggtttttgtttcttgctttcttttgctcattacaagtttaggcctacttctgattcacagcttctggtgacataggctggagaataagttattccttaagaagaaaggagtaatctaaaaaagtgcttcttagcagttcattcattttaattgctgagtaatactcccctgtgtattcctatacagcacactttacgcattcacctgttggtgttgatggacatttaggttgcctccagtttttgactattgtgaattaagctgctgtaaacatttatatacaagtcattcgccagcatatgtttttatttctcctgggtaaatatttagaattgtaattactggttcgtagtgtaagtgaatgcttacctttttaaagaatcttctaaactgttcttcaaagtggttattccatttcacattcccatcagtaatgtataagagtttcattggttcatatcatctactaatacaacacttaatatgtgactttttgtttttgttttgtcattttaatgagcaggaagttatattctcattgtggttttatttttaatttccctaatgactaatgacattgcacatcttttcatgtgcttaccaaccatttgtttttttttttctgaagtgtctgttgaagactttcatctatatttagttgagttgttttttcttcatattgaattctaagcattcttaataatacattttttttaaggagaaaaaagtattccagtccaggtcagcacaagctctgagtcaagaataggtctaaaatccacagatgcaattctgaaacaataggcctggaatcaaaggtagctcttgatgaagaggagatgagtaatctggtattttagactccattaagactcgccattttgtagctgaccaaaagggtcattctttagtcccatttaaaatcggcatttcatcatttcaaaaatcctgcttcaatctaagcaaattatcatgtgattctgcaattgatagctagctcaataactgatttatttgataagagggaacacttagaaaatatacagctctcatattttctaataaaggtattcacatataattaatagtaataagtactatctgtgagtagtatgcacaacatgcatgctgctgtcttttgcaaagtattaaagcagatgcctaagcattgtaggtaaggatgtacttgacttagttatgatttgattaaatgttccctgttcagattggcttctgaatcatcagctactggtgtaagtaaaaataagttggaaaggtttccctttcctgaggatttcaggaaaagcttcgcaactatttggctggatattgcaaatcagatcaagaattgggaagcggtctgtctttgacttatcttgcactatccaattctatgagtctatgattgtcatgtacagagcacttggcttagtggtttgtgtataacttttcaggattagtggtggcattgagctggttcatccacaagtttatctggttctccatcaagctaagttcgtcctatctgcagagcagacacagtatttctgctctttattcttggctgtttcctctatttagcactcctttctgtctgtttttctaagttaacacatgatattttggtattttaaactccattaagacttgtcattttctatctgaccaaaaatcttggtcttcttcaatcagtatatcaatacctccttataggaaaatatataaaagtcatttattctaaagcataaattatagaccaataactgcttaacatgctactgcagttaaaaaccagagttgattcttttctaccaactgccctctttaatttccctgtataaaaggcccaataataggtcagttagtccacaaaattttgttgaatacttactgttaggtgctagtagctttgtattaatgaaacaaacattgttcctgcctttgtaaaacatatgttcttgtgagaaggactttaaaaataatttaaagtaactcatgaaataattataagtatttctaatagtgcaggtgagaaacagtgttggagaacatagaaatggaatggcggcactaatatagggaatcagggacgatacccctgtaaaagggatatttcagctgagacctgaaattaaggaactggtaaggcagaaaaagtagagaagaacatttcagacaaagaaaaacatgtcaaacatcctctcgactctggaacccacatgacctttccatttttctcaccaccacttctattcttgccttcatctctttttctatagattactccaatagcctcattactagcctaccctacaaagtgttgaaagatgtcttcatataatataactgtaatgacatcatctcttcctaaaaatctacagtgacttccctaaagaaaaatggtcatattcccaagtttggcatttttggcccttttcaatactaatcaaacttacttttccaatcttattttcatgacttttctgccacactgatctatttactttcttcgtcaatacaattttattctctgaacttagtgctgttttctcattattcatttcatctagagtaagtctttaaatttcatgtaaatgattattttattggtaaaatgtataacaagtcacaggcctcttaggagatacccacgtttttgtttttgctcttgtttttgtctaaagacagtgattgctttccaaataactactttgatgtgcttatcatttggttactgaaatgaaccaaaatttaaatttctagtatgggcgagtttattgggcctttcaggtgaaaatcaatgtaattttatatctacaaatgcttccaggagaattagccaatggttgatagttccattgtctaaaataatgacctaatataaatcaatgggaaaatagattaaggcttgaaatggcaagatttgtttaaaggacctataatgggtagaatatataaaggttggccgggcacggtggcttacacctgtaatcctagcactttgggaggccgaggcaggtggatcacgaagtcaagagattgagaccatactggccaacatggtgaaaccccgtctctactaaaaacaaaaaattagctgggtgtggtggctggtacctgtagtcccagctactcaggaggctgaggcaggaggattgcttgaacctgggaagcagaggttgcagtgagccaagatcacgccactgcactccagcctggcgatagagtgaaactctgtctcaaaaaaaaaaaaaatgtataaagatcatatgatatgaccctcagcctaagcttagcaataaaactttagaaactacaagagtggcctctgttaagagctcacagaaggaacaattttctatgcttcactgtcacgtgtaaaatagaaagccagaggtacttcagcattcctatctaaagagcttccaaatgtgctctaaatttgtagatgtaagctgggccttgtatgttttaaaggttaaataaatcttcagatagctatctactattgttagataaaggagtcaactttttgccatagcaaagtaaaggaaacaggattctcttttctgagttgggtggatagtttttgtccataattctgtacttccaattgtcactaaagatatgtcatgctttatagcctcctatatgtctggatcacttgtgctttcatttggaaacaatacaaaatagtttataaatgtaagtatccttgtttaatacttatggaaccaaaacatattttaggaaaaatgacacttagtcaaacttttattcctaagtgtggaataatcaaggttgtatatagaaatccatactttagtataacatcatgagtgaaataaatttgcacacacatatatatatatatacacacacacacacacacacacacatgcgatgacgttcctgaaaatatgatcctagataattaagagaatggggagttgctattcaataggtataaaatttcagttatgcaagatgaataagttctagagatctgctgcacaacatagtgcctagagttaacaatattgtattgtgggccaagtgcactggctcacacctgtaatcccagcattttgggaggccaaggcaggtggattacttgaggtcaggagttcgagaccagcctggccaacatggcaaaaccctgtctctactaaaaatacaaaaaactagctgggcgtggtggtgggcgcctgtaatcccagctattcaggaggctgaggcaggagaatcactttaacctgggaggcggaggttgcagtgagtctagatcacaccactgcactccagcctggatgatagagtgagactccatctcaaaaaaaaaaaaaaaaaaaaaaaaaaatatatatatatatatatagtatggtgtacttaatatttttaagggagtagatcttatgttaagtgttcttaccacagtttttaaaaagagagaaaaaaacagagctgaaagaaactataaatagcaaataaaaattagcaattcataaagttccagtgaataaatacatttactaaacctgtcacattattttataaaggatttttatttaattaaataaaaagtagcatgaaagcaaggcctgacatatgcaacaaatgtggtcctaaattattgcttagcctgaattattattaactgtattttatgtaaatttcacaaagcctattatttgaaggaagccattactaaatcttgactagcgacaagtcccttgttaaatagccactcctcacatacttatttccttttttttttttttttttttttttgagacagtcttgctctgccacccaggctggagtgcaatggtgcaatcttggcttgctgcaacctctacctcctgggctcaagagattctcctgcctcagcctcctgagtagctgggattacaggcacccaccaccacacctggctaatttaatttttgtttttagtagagacagtgtttcaccatgttggccaggctggtctcagactcctgacctctagcgatctgcctgcctcggcctcccaaagtgctgggattacaggcatgagccaccatgcctggtcataactatttcttaagtaggacttttagaattggttcatcctaaagtgagataagcatacatgtatttgtgaaaatagtattcaattgagttttaatttgctcacagtattagaacacacctatggaagttttcctcatttttatgtatatttatattaaaagaaagaatgaaaaatttagtaatgtaagagtttctggcataaaattctgtatcacagaagctggaaaatttcggcccagggtgcagactcaggcactaacttgggggctttgataatgactctgccatacttctggccatgcgacctggaagaatttgttaaccattctatccctcaattgccacatcagtaaaatggggagtataaacagaacttagaacatagatgtttgtggggatgaataggattatataggtgagatacagagtactgttgtgcacacattgagtgcccaataaatgttagctataatctactttatcactatcataatagaactacagctttttcaaaatttcccaaaattttattctatggagaaaaggtcctttgaaagaactgacatttcctggatttgaaacactagactgaaaaacaaagtaaaacaaaatagaaaaagcctgtttttgtattttgttgtgttctgctttgctttactttcctcaagtactgttggaacaccagggggttccatcaagtttttattcttttgtgttcaaaagaagaggaaggaaaacaaggttatgcattggcactggagacacttttttccctaaaatgtttagaggcctagaatgtacctaataacttgtaaagcaccaactgtatttcctggttactaatcaaatttgtttctatttcatttctgagccaggaaggcagacacaagttataggtaaatgtcaggtgctttaactgacctacggcagtcaataaccagtctttcctcccctgatgaagtcaattactaatttagagaccactgtgttccttgtctcttctcctaagccaagtataccacaagtcaacaaagataattctttcagcagccaaacactagggcgaggaaatgcttactgtctgcttgctctgttagcagcaaactatatagggaagccatcttctggctcacacagagaaaagagaaccctggcactgccacagctgtcactggccttttctgtttcccaagcaaaaatcagaattgaacaggaaccaaaactattgagaccttccttctgtttcccaagcaaaaatcagaattgaacaggaaccaaaactattgagaccttcctacccacctgtgattaaatgagccaaatgagtagcaacgtggcagatggccctacagttaatgagattcttgcaagcccgcaattctgttgaaataaaattttgtcacttcagttttcagtacaaaattgtgccaactgaaccctccaacacttttctccaaaatgggaatcgtcaatctcacaagggtccattgtcagaggacaaccttcatgtacaagagtgttcaagataatcttgaattttgtaatggtctggaattgctatgactccctgtacaccagaactttcttctcacacattgatcacttcaagcatccacagtttttctttttctttcttttttatttatttatttttgagacagagtttcactcttgttgcccaggctggagtgcgatggtgtgatttcggctcaccccaacctccacctcccgggttcaagtgattctcttgcctcagcctccctagtagctggattacaggcatgctccaccatgcctggctaattttgtatttttactagagagggatttctccatgttggtcaggctggtctcgaactcctaacctcatgtgatccacctaccttggcctcccaaagtgctgggattacaggcgtgagccaccgcgcccagccacatccagtttttctagtagtttattcctaaatcaatatcctgactacagttaagcatcctaaaaatgaatgattacatttatagctgttttctttacaccttcatctatatctctaaatattgttctgattagacctcctgctttaaaacttcatcagctcactcaggcataagtcaccctgcattctgcactcttctggattttgagtccctttgaattgccactgaccatatgacttacccatccccatttccatttccatttattttttttggcacttcaacctcagtatctttctcctcctcctcatttacagcatatctccattgcacttctggccaacttccatagcacattttcttccttctgtagctaaatctaaatctgcagctgttttaatatggcatctgtggttaatttttagtacaatattgcacatattgaatggcagtaatgcccaatgctactgcaatattatgcaagacatcaaatggatggaacctattaactcattgcaaactcatgcattatgaacatggcatagcacttacctgaaacatacagtacctgtatggagaaactacaggttccttcaacgacttaagaagtgaggacatcgagcacattgcatcatcttcctgctgctgcagtgttctataattttcccacttacttgctcccaaagttgcatcaaaagaacaaagagaaaatgaaatccacaggaagctcccaaaggctgcctatttggctcagctgtctgtcgatttttctaggttatgagattgctcttggtgacttttgacaatatgagaacacttccctcacctttaatgatgaggcaaggggctccatacacataacattagatagatgagaattccacgaaaaaggataagccatccaatatgctagcatagaccaagatcttaaaataaatacatttgcattctggcagtttgaacagcagagttatttggaagaatggcactaaagagaatgagcccctttaagggcagccaagagctagattttgctagttaagcatttaatgtaaaacagaggccaattggaataatcattttgtactggaaaaaagaaacacaggctttggagtcaaacagaattagtttcaaataccagccttgcccctcagtagtggggtgactcaggcaagttactaacttctctaaatctcagttttttcacctctaaccaaggataatgcattccttacacacttcttgagaagataatttgatgtaaagcacccaggacaatgtttggtgtatagcagttacttcaatttttgaaaggtggcatacaaacataattatagcaggctttggcaggaagaggtataaaatattatcttaagaataaaacagtaggtactgaaattagacaaagacaattgaaatagaaaaaaattgttaaccttgtgaggttatataaaatagaataaaagagatcaatgaatagataaggtcagatggcaaaagataagctaagtaataagacaaggaagaataaaaggtgagagaaaagaaaagtagcaaatagattaaaatgtcaaaatacaggtatgaatggagtcttgcctttccagtaagatattatgagaacattagggaccctaagagagaagctgaagtccttcagctgacctggtaggaagaaggggagaagcataagaccccagggacacaatgcaagctacatcttaagcagactgtctgcagagggcttgagccttccagctctgaaggcgccctcggctcaggcagcactaaaggaaatgcactaatgagcagaagggcaggttgctgagagcagcgactgccgaacttcctggtcaagcaggggttttttgatttcataaatcaattacaatgtgctatattgatttcacaaagtcagcaggacttaaaaactaatgagcaaatttttttattattatttttgaaaacactgcagtgtctacagctcagcacactcggcagaaagacaaatggaggctttggctgccacagatttcattccatcctagccccctcccagccatgttcctcatctcagcatcagcaaagaatcaggagctggcataagaccctggtgcattatgccaacaaatctctccctggtatctgaagcaggggcagccccaactaatgtgtctgtgtttaggcactagtgagttttgtacgggtgcccaggcatccccagatggagcaaacaaggaaaagaacaagaaacccacctaaccaaggatataaaatacagaaggactgcatttgtgattgtggttcttaataggtagccactgccattttcttcccaaccatggtaacatctaaactggagtttttattgagctatttattttgtacaacatcaaacataacaaaattgataaggagattattctgccactcaacccctggcccaatgccaacagcttcagaaatgacctcaggtggagggaggcatagatagtttagtctttctccacagcaaaataaattatcccatgatacagtttttaggaaaaaatgcaaagtgggggataaatacattctgctaaaattttgctgttaaaatgtactacctgttaaaaatgtaccattctagggttgaaaaataattaatgttaaaaataatagctaatgttttagcacttgctaggtgataggctctatgctaagtcctttgcatgcactatgtcatttaattcttagaacaacggtaaatggtagatactattattatctcaattttatagttgatgataatcgaggcttaggtaggctaaatatctcctgagtgccatgtggtaagtgacattatgaagtctcatctgtttacactagagcctgtgttcattccatcagtaaatagttattgagcacctaacacatgccaggtactattctaggagtcatccgctaccaaaaaaaacactttttaagtcaagacaatgtatttaccagaaatgaaaatatttcaacgaatgatgacgttctttcagaatatgatttcatttattgtcaggattgagaaccagaaatccagaagatagttgataaactggctaaagggaaactaagagaataccaaacattattcttagtatgtgaatacaacaaattagagtgatgggggaacaagaaggaaggttaaaagtctaagaagttaattttttcttgcatagaggaagcagataaaattgaccaaatgtaaatatgagagaaagagtaattactagaagtaacactaaggaaataaaatctgtgtttcttaggaagtcattttgtctcacaaacacaacaaagccatgaggatagattaaaaaataaactgctacataaacttgatcttcaaaatacttctcaatgcgttcatgattccttttaatattattagagtaaatagtaaatatagcctgcagaagttttaccctcttaattttcattcctttatgctttttttcttgtatgtacttgatgactaaagtcacacttaaatgacttaagaaaatgtgctacaaagaaaggaaaacgaaaatttaaataatttatttttggtaattttcctttcactttcacaaaactcacaaataaacagaattaggtaaagacatgccccacaaaatactgccttttactgacacacattttttgctctgttttggtgctttttttttgtttaagtacaataagaacattaattcaaggtaggcacctgcctagatcccaccctcatttcctacaatcctctctcttcttcactactgttgagccaaaatatttcagttctacaaacatacagagctcatccctgcctttgtttctttgtctcagatttttccgttgtctagaatgttccttcctagatattttccttatggctgccttctgcaagactaacattatctaatacttcaccacaaaggtatttcctaccacctttatcagtcatgggtgagtaaaaaacaaatcaggtactcatatagtttatttagtaaaggggtgatttatagtaatatagtgattatttattgttataaagtttaacaatatgatagcacatataatgcagaattctgtactacaagagccagggaggagtggttaccaagggtgagagaataaaggaagaaacagttcctacagctcagaacatgaaaatataggggaagggtgcccaacaggaacctggccttaggtaaagaaaaacactgccaatcagtggggagctggcagggaggatccaggggaaagtatacccagccctcctcctcccctagttctcaaatcttctgcagatggttcccattggtcaaacacaaccagaggccagaagtaaggcagaccaacgacagagtccataaagtttggtcttctggagtggaaagcagaatggagaagggcaaagagaccaggaagggcaggtggaaatgatcatcaagaacccaatcccattgcccctagtcacttcctaccacattctttctgtttgtttatttgtttgtttgtttgttttttgagacagagtctcactctatcaccatgctggagtgcagtaccatgatctcaggtcactgcaatcttcacctcctgggttcaagcgattctcatgcctcagcctcccaagtaactgggattacaggtgctcgccaccacacccagctaatttttgtatttttagtagagacagggtttcaccatgttggccaggatggtctcgatctcctgacctcatgatcctctggccttggcctccaaaagtgctgggattacaggcgtgagccaccatgcctggcctcacattccttcttttaattatttgcattgtacttacaattttgatattttctttttagtttgtgcatctgtttaactaactataaattccagatttgcctgtctggttaatcagtatgtcccagagattaaaccagtgcctgtatactttagatataattacttgccagattaattaaaatagcaagactgctgggcatggtggctcgtacctgtaatcccaaggctttgagaggccgaggcaggcagttcacttgaggccacgagttccagacagcctgggcaacatggtgaaaccccatctctactaaaaatacaaaaattagccaggcatggtggcacatgcctatagtcccagctactctggaggctgagacaggagaatcgcttgaacccagtaggcagaggttgcaataagccaagatttcaccactgcactccagcctcagcgacagagcaagactccatcttgctaaactaaactaaaataaaataaagtagcaagacctctgtgattaaaaacaatacattgaaaaaactaatcattcatgaggaaatactctgtagtttataggagaatgatacaaaatgatacctcattttacctgacaagaattttagaatgaatcaactatagtcaactataccttgtaagtcaacttttacaactccatggctatcaggctaatcaggttgatttatcatatctagcaaaacagagatcatactacctatctgcagttaacatggcagttaaataacacatatgatagtcaatcatttctccatcaattaatctattaatttaacagatgtttattgaacacctactatgggattacactagacactgtgaatacagaagtgcaccaaatagccaaaaatcactgtcttcatgaagtttatatttgaataaggagtcaaggtcacatcgtcagaatgggcctcactaataagctgatacatgagccaagatctgaaagaagcaagaagaagaaaccaagcagatatacaagattttctggagagaaagaatagcaagtgcaaaagtcccgacgtgaagtccttttagcattttagaggacagcaagcaggcaaagttgtctagagccacgtgcgtaggttttgaaacacggacacagggcaggactaagggagagggaagcagaatatgttgtaaggacttaactttttctctgaatgaaacgggtggccacaaagtggcacatgacatgacctgattgacattgtaacaggggagcaaggcagaattagagagacagttataagagtatcacattgattcagatgagagatggaagaagtgatcatagtctgtggacttatatttgaaggtagaggtgaaatgatttcttgatgatagaatgtagggctgaagaatcagaaaggagtcaaaaaatgctgaggcttggggtcttagcaatccgagatgcccagaaagactttgttatttgtttgtttaatttattttccagttaactctgaaaaagagaggctcatccagttgttatttacctcattgccatgaaaattcatccagttactactgtctcattcccaagaatcattgaggaaatgtcttgtccttaagctttgtatagttaactttggaacaccatttttccattcaaagacttaccattacactttaaacatagaatataaacataaggtaagatgctggcaaaataaaaattatgaactacttcatttctgtgaatttagctcatgataactaaatttggataaattttgcaaagatggattttgatccagatttaagatttaatcagtggctttacaatttaagttagtttacaatgaattaaaggaactcctttttatgcagagggttttaaaaaatcaggttttcaatttttcaaatgatcttttaaaaacatttctatcataacaaatgtgggttaccaaattataaggaattagaatataatcatatgctttagtatcaaaactttatttaatataatttagtctttttgtcaataatttattattctttaggatggcagagactgtatagtatcatgaaggaacacaggctttgaagacagaaactaagctcaaatttccaattcctttgtaacttgctggcatcataaacttggatcaggtttcctaatcttcaaactcaagtatcttcattgatttaaaaatgatccccaaaataatactacctcacaggatcattgaggtaggattatattcacaggattatattcaagttttctgtttgtttgaatttagctcatttggaatttactaatttaacagagattatgattttggtagaaattcatcaaagcaacatttaagccaatacaatgattttctagctattacacaaatactcatctaaagttaaagtatacatcttttactgacattccacaaactcagtcattcttactgagtggaaaagctccaacttctgtgtattgtgtgtttttatttggcagtcactttgacaattttattctgaatttaaatctatttttagacctgcatgcattattttatatagtattgtgaagaagctgatatttttgtttgatacactatgttatgtcagtgcttctgattgccaaaaccaacagttcatgtttaaaacctttcagaacattctgcagtctgattaggtcacctctgaatactaggaactaaaatgagaccacagctaagaagaaaggagacaggtgcaatttttttcctacttattctcatttcctaataataatataatcaatagatcattataaacctctttcctgaaactctgccctcctccctgtttctctccaccctacacacacacacttaaatacaccgggttcccctatttgctccactactcactgaaggatcatcttcctcttcatttccttacacatccgggtgcttcctgggctttggtcctcgatgtttcctctcacttaaaaaaaaaaaatcccttttctacctctcttttatcagtctcgttacctctcatagcaagaaaaagtgtttttttatttcctgtatttcctggaaattgtatctgttttactttgatggctcttgtctagcagcaagaaatgaagaatccgacttggagtaaaatctttttgaaggtaatgccaagcccttattcctcttctttctccaattgactgtagcagagggccctcctaggggtcaatatttaactctttaattaatcaactgttattttagaatacagcataaagttctcacatatttaatatatgtcaacttattccctaaaagtccacagaaacaagcattgtggcagaggaaaatttattgaaaaatattgttccaaaatcttgcttcttgattatatttgtaggtataacagaattagactactttaatagctgaattcatttttatttcattgtggaataaaatgagtgctgcagatgccacactatggtttgattgttatatatgtttggtcatgtgggattagcctgatacatgtatgaactcaaatatccatgttagctaacaaacaaaaggagtgggtaaagagatgtgtatatatatacatactgaaagaactttttctatatatgagtgaatagcttacctaacgtaacagtctttacataataagactacttatttaaattttaaaagaatttacctctagatgggtttttgagtgaatttcctcagaaaattcattttcatggcacagaggattatcatacttggctgctggtctgagctcatccaggaaacagacttgagtgcttttattatccactagagtagatctcaaagaacagaagttactctatgattatttagcggcaataggacttaccacagttcctggcatttagtgttcaagaaatatttgttgaacttcattaaaaaattaagatagccacctcaatatcttagtttatacacacattttcaggcacatatatattatacgaagagaaatgcaataataatccttgcataaaacagatgagaagctcatctcactatgagatgggttggagaagtcttcattttctttaagagtttatactcaagcttgtcagtagacatcattaagctgttatgagattccttctcttgctcagttgaatctgcttcatgaaccaagtcaggttctcttccatggcaaaagtaatgaggtggggccaatgtgtcccattgtctcccaatatccacagcagccactcaacactgtagtgctgtggccaggtgaagggactctgaaactgtagtactatcctttgaagctaccacagttcttctcctctatgctgaattaaccacatccttgtttccatttaaataagaaagatgcacagaggttcaacccacccattattgaacatattttgcatatggaatttctaatcaccatattattccagggatgtttgcagacggaacctatttagatttttttgtacatggatgcctagagaattatggaaaaaactagaaatcatctagttctagtctaatacccacatttagcattcaaggtaactgagaaataaagaggtcaaatgttgctcaagatgactcagcaagttaggagccagtgtggaccagataagtgtccttttctctacaccatgtggataatggatgtttatagcaaagttaacattgaacctgttgagattcatgtagataatctggaattttatgtctcactacttgataatgttcataaattgaattatgtaaccaaaatctgtcctttaccaatacagatatcctattcaaggaagtaaaatttcactagtatcatgggcatctttagcatgtcaatttcagtagaccaagtagaactctagttaatttgttttgaatggtgaggcaaacaaagcatcattattcctatgaacatttaacagtttttgagtaatcatgatggcatgtattgaacattttggtgaaacaaatatctgctaatgatggaaatgtatttgctagtggtacaagtcttacaagacacgctgcagaagaaccttcagaaaataacctctgaccttgaagaacagatgttctaaaagcacacaacataggggttttgtaaatgagcagcactttggagtttttccaacttttcaaacattcagggaagtaaaaatgtcactatgccaggttttctaaattttcatatttcaaattagtataatttgagggaagttatttaaatgatctgcacattacttatcaagacatatatttctaagtgccaatgtccaggaattagtttgcttttctgaaataatatttaagataatcctttttaaaattaaaggatattttatcaacataaatagcctactcagaaaattatatcaacactaaatcacaggtaacaccatcatgttttatctctatttattttgatttttgaagtaatttaaaagggtatatttaaacattataaagtacactaacaaataaaacattttgtagactcagtgaaaacaaatttatttatttatttagtttttgagatggagtttcgctcttgttgcccaggctggagtgcaatggcgtgatcttggctcactgcaaccttcgcctcctgggttcaagtgattctcccgcctcagcctcctgagtagctgggattagaggcatgcaccagaaaacaaaatattttattcatcattagtaacatttgccagaactctgtgctgtttaaacttcataaagtatatcacatgtaggatattttctagttttctagtctcttctgtatatatgccagaataatatcaaatactttcatttaatcagttatgattattttataccaaagaaatctcattctagaaaagaaggccatctattcaccactcctgttggccattaaccttcatacctcccctttcagtgttctgtcttgggtcttctttcaccgtataaatcccagggttgatttgatccagtcactctgcagcaaacatccttgtatgtctctttgtgaacgtcaacaattaggatatggacttcctcagccttatcagatgttgccaaattgctctccaaagaactaatatcaatttacattccagccagcagtgaatgaaagttccagtttctctacctcccagacatatgtattgtcatgctttaatttttatcatctaatggctgtgagatgcaattttattattgatttaatttttatttccctaatcactggtgaagctaaacatctttttacatgtttatttgtcctttggttttgcacttctgtaaatcaactgtttatatcctttgcctatttgttgtttctttgagcttctccctccttctccttttcctattattcttcctcctcctcctcctccactcctctttctccttcttcttgttcctaggagttcttagtattatctgaataaaaaattctttgtcagttctagttttatgcattacaaatatgttcttccagtttgtggcttgtcctttactttttttttaatggcaacagaaatttaaattctaatgaataaatgtatcagtcttttcatttaacacttaatgccttggatgaaaatgttttatcccagggttatagaactattttcttaaatgttcttatcacagttttaacattttgttgatcacatttaagtctttaatcaatctgttgtttgtattttttcataatgtgaagcaagaatctaattttaatttttccttatggatacttctcatttattaattaatccactagttcttccttcttctcaattttaatgcctttttagtgatacaacaaggcttttatgagtgaggactgctttgaggctttgtatcctcttcaatttgaccatttttgtatcccggtactattattatactgttttaattgttatagctttataagttttttggattggtgtttcagttatttattgctgcaaaacaaaacagtggaggttttctaaaaaatcattattttccatgattttgtgggcagccacaaaattccgtttcccatggtatcagcccaggcactggacgatcatgaggtccaaaatagcctcattcgcatggttgactaccacagtgctagctgacaaatgggagctcagctggggttttcaactaaagcctttgtttttctccatgtgggtatctctatgtggctatttgagctttggaaagcatgataggtgggatccaagaagaaatattacaaaaagcaaaggcagaaattgcagatgtcttaaagtctagcctcagacatcactcaaagccacctctgccttattctattcctacaagttgattaaaagaaggtaaagtagactgcacctcttgatgggggagtggcaatgtcactttgctaaaaagtacctgggaaggaaaatagtgttgtgatcatctttggaaataacaatctattgcattctggcaggacaagccttatcatttcattaggcttcttcaacaccattttggacccttttccttccaactatgaatctataaattttagaattaacttgtctggttccatccaaattttataatgtgatttttgagtgaactttcagataacattcttcaacaaatgtttattgagtacctactatgctcttgcactaatgatacataaatgaaaaaaaaaaaaaaacagataaaacctccatctttcattgagcctgtatttcggattatgtggagaaaattaaaatatttatgacctttgttattctaataaatatattttgttttgcaaatttggttaggtcttcttttatgtccttcgtctaagctttataatttcttcttatccgatttattcttagacaaatttttgtcttgtttctcccaacatttagactaagctctttgggcaaatgttttaactttttgtcttctgatagcaccaagtacactgccagatatagcaggacaatgtaacttggtgaacagactgaataaaaactgaagtaaaagatttaattttccatttgtaaatattaatcatgccaggtcaaactatcttaaccaagttaagctcctagaaataagtagcattcatgtagtaagtgagttgccatcactatattcttatagaaggtccctcgtataaaaaccagtaagtaatgtaaaggagcaactacccaggtactccagtggttaaaaggaaaagatgaaaagaaagaaggaagaaaggaaaatgctctccaagctttatacggacatttaacgtagttaaaaatgggtttgcctggcctttgctaatcacacctttagctaataacttcgaaatttgcttctacattaggtacagtgtggaacaaattagctcacttaataaatggaatgaagctcagtgtgagtctctttaaaagcacaagaacattcctatttcatccctcaattaccaaatatctgcaattcctagttttgcatcatgctgaacttctaaagtaggaaaaaagcagttgaagtaatattacaatagcaaatgatacaaaaatagcattaagtaccaaggatacctaaagttcattatttcaattctttactctcaacaagggcagatctgacactgtgaaaattgctgacaaaatcatgacttaccaccaaacagaattttcaacatttcaagttatgattaagataaggaatagcttgatgactatttcactacattcaatactatttatagaatacagctgcagggctttgtatatctaataattattgtgaagaagttttacaaaacatcagtcctttgagaatttctatacattgtacaagttatttaaaatctgccaaatgttacaatatgaaatgtaaaactaggaaacccaaatgcaacaagtggaaaacatgggctcagctaataccacaacacactgccaagatggaactctccacaaggtctatcttcctgctacttctgtcctggtatttcccagagttcatgccttctcattccaagtatatgctaaatactcctaaatctagatctctagcccaagatgtgtcagttgagcaacagacccatgtttccaattcctctgaggtgtcattgcttgaatgtcacagaaataatgcacattccataatctcaaacataacccatgatttccatactctcctccttttgtatttctctctccgtgaatagaaccaccatccacccaggcctctatgacagaaccttgggtgtcactgaagacactttttcctctctgttacttctcatatcaaattggttaccaagtcctgggaattacacaggatctcatctttttccttttcttcatacccactgccatagccttggttcaagtcctcatcatctcttacatggcccatggtagcagtcagctagcaggaccccctgcttctagatgtacctcttttaatccattctccaaacattcaccaagtgatctttttaaaacacgaagcagataaagttacccatacctacctgtttaatacctttcaaaggttaccaatattcttgcaggataaattacaaatccttaacattattccctggctcttgtctacatctctatatttttttattaagttcaggttctttcctcatctgctacctatccatgccagacaactaagactcagactcagtctcactaatttgtagctttgcttacactgctccttctgcttaaaagatcttcaaatcttctcccctacttgcctttaacctgatgaatttctactcattcttaaggtctaatacaagcattactgcctctacaaaccttcctgaaatccacagaggaaattatacacttccatctttgtttcataaatctaataagaactaatatttatggagtactgatattgcattagacattgtattcagtggtttattacattattgtatcctataaacataaattattttcacattaccttactattatatcctacacaatcacttgtaaattattttagtacgctttattttacctacttatttacatattttgtaatattatcctactaaactgaaaactacttaggactgaactgtggttcatcttactctctattgcctaagctacttcattgcacaagtaggtctcaaagctctgttgataaatgaagtttaatggtttcaaggagactgatattatataattagagatgttaacaaatgcattaaaaattttaacgcatcttgaatcaaagcaattatctatctaacttagtagctgtgcaacaaagtaaaaagagcaagagtgccattaatatatctcaaagataagcttgtttaataatgcatgtttgggctgggtgcaatggctcacgcctgtaatcctagcactttgggaggccgagacgggcagattgcctgggctcaggagtttgagaccaggctgggcaatatggtgaaaccctgtttctactaaaatacacaagaaactagccgggcgtggtggcgcgtgcctgtagtcccagctactcaggaggctgaggcaggagaattgcttgaacccagcaggtagaggttgcagtgggtcaagatcgcaccactgcattcagcctgggtgagagagtgagactccgtctctacaaaaaaaaaaaaaaaaaaaaaagcatgtttgtgtcaatcacttatgtgtttatttgagttaattagcgcctatgcagttttctgcttgctcaacttattggaaaaaaaatttctaagggtatgtgcaaaaatattatctaaagtagcatttgaaattttgctctacaattacactgttaaacacagtaattctaaacaattccatgtgaactaacatctgtaaatgttcagcaattatccacctgttgacagtctgtaattcagctttgtgagtactactggtttgtgacattaaatcaagaggtttaatattttatcttggattaaatgcaaaagataatcaagaataagacagacatttagctgcctggatagcagttatagatctgtttatattaatactaacagagagtcaaacagttcccaaaacttttagatgtgatggcaagaataagagcagaagatgatctgcacatcaaacagctttttcgtctttgcttagtgtcaagcatttggcaaaacaaccctttgtattatttcagcatttcagaggcctaattttccatagttgtgactcacatatcctattcataggcagaggtcttataaaaatgaatgtgactgatacaatctcttataaaaatgaatgtgactgatacaatctgagcaggaaatacttattaccaaatgaccacaaattctttcttgtttgtaaaaattaatttacctgtgttaaattgttttaatcagatttcattttaaaactagcactttaagcatgatttaatctaacaactgataaaacaataacatttcaaaggcatatctagaacagtttaaaccaaattcttgtctgttcataagctctggtaaaacttttagatccctgctatttagtaaatctcttaatatgtattcatgtaactaaatactcctatacactgttttcctaaattcagggttctggatgttcttcccctcattattaggacaccatctctctgttctatcacatttcttcccaagcaagtttgtcatctaaatacctcattaaataatcttataccttattccgtcataacaatctataagagaattgttccccaggcagaggaagtcctcaaatttgttgctatttcctattctcttcttaattagtggctcaactatccacaaaatcacccaagccagaagcctacagtcatccattccactccatccccacactcctaattggtgattaagacctattgactcttcctcctgaatatattgcaaatctatttgttcctcttcaagttcactaccactgcttcatcattcatcacttggattattgcagtgatttttctaactggcctccctgcccaccaggctcagtttcatcccctcatttctcccccattccagctcattcttctacaacaattgtaattatatttctaaaatgagatggctgatgccattcccctacataaataagatgcaaaccaaattcctaacacggcattttagcacagcctttgcatatctcaccagatttatgtctcatctaccttcccatatactccagtgctacaattctttttctataagcagaaataagtgcctccttactctatgtttacttagcatacactgttgttttagtactagttgcaggaataaaattcaaaatagaagatagaacaatattttttaaagcacaagaagcatagttaatgtaaaagcatagcacaaaataaaatgtagacataaatcaaaatatatcaataacccaataaatacaaagggactaaatttgcaagtaaaggacagatattgcaaattatatttttatgctttttgcaagacacacaaataaaatacaatgacacagaaaagttgaaaataaaaagatgaagaatgacaatgaacagaagaaagtgagacacttgtagagaggcaaaaaaggcacattggaaataaagaagtttctatggaacaataaagaaggaatcagcaaaaaatatagtaattccaaactcatatgtgagaaataacattgtccagaatatacaaagtaaaattgagattagaaagagcaattgtcacagatcaacaataatgggagatttcaatgcacttttcttataactgatacatcaggcagcagaaggcattagtggattgtgggagatacaaataatgcaactaagaagtttgttccaatggctatatgtaaaaccatggaccctacaattagagaacacacattcacttaaatacataataagctttaaaactgaacatatacataaagcaaatctcaatcaacaccaaaaattcagtatcactcagaacttctgtgcatataagacaattaaattagaaatgtatttattactattttagttataaagaaaacggaagacagggcaaaagttaataaaattggaacactatagaaacacagaaaaccctcatatttcaaaattaaagatatttgtactacttttatttatcattttcaattgatggtttgcactcaaatatttcattaagacttcagttatttcaagaatttaaacatgattttatgcattaaaaggtatcagttaaaagacctgtgactgaataaaaatgtaaatcaattaattaaaaataggcattgctaaatcgacactggaatctgaaattatcatgggccttctgcctaacattttcaagaaaaaacttgggattcctgaaaaaaatatataatcaaggataggtaagcatctaataattaaattaagatcatcaatttgtattacacagaaaactgggctgttgtcatcttgtatggatcagaacatgattatgccataaaatccattcttctagcttcaatcactattgtctctcttttctaactatagaggtgatcagacagcatgcatcccttttaggtcacaaaagaaatcctattaaatgccaacctataaatggtgcttccggaaacataaactagatcagggttagtttgggatgaaataggccttaacttagatagaaagtagaaatgaataatgtacatttcataagtctttaagcaaaaaacaattggcaattttactgtattttatcaatttatcttagttgaattttatatcactgacagattacttgaccatcaatttttctgatttgtatactaattctagtcttattttcctaaaatgttttcctaataacagcaatgtattcagaaattgtaattaaaagtcattgaaggtcatctgatttgttgtgttggctttagatcagtgactagattttcccagtcactgctctgtcagctttaatacaatgcatccatttgtcttactaacacttcaatttatgggatagctgtttttcacaattaaaactactgaagctttagtatacatggaaatgatcatgatagcattttctccatatttctaacaactctggaaggctctattgtaaaaatatagggccttccagatgactagatctggtttcctgaagacagcttttaagattgctatatgagctcaagagaaacatttacaagaatctttagataaattactaagtgctgcagaagtaaaaccatttggaatagatttctaaactcctcttacataaataattggtgagtgattgaggtaagaaaaggctgcccttactcttgctgacccaatagacaagacagctgatgacgaaagttgatggcgaattggcacaagaaggttaaatgcaggagaaatgaaaccgatctacttattgtgatgatgttgactgctacctagttagttctatgagagacaacacctacttacacaaggtcttccacttaattgggcttaaggccagttcagtaatcacaaaattacaacaagctaaaaattacaccaatcacctcctccaacctctgtatctataaagaaaccatgaacttatataatttacccaggaaacaggagtcagatctgctgcctcctattacaggagtctttacattcaattaaactgaattagatatatgaattcaatagaagaaatcttgatgtaaagtcaattagtataaatacaagtcctccctcaccccacacctgacaattacaataaaattctatggggagcgcattatgaagagtagagaagaatgccagtgcaattctgtaaaagctaaggcaatctgagaatttaattttggtatgtctagccaaagtcaattactcatgaacaacaggctggaaagtgaccaagggctgactcagcagctttcaaactcttctgttgagtttaaaaaataaaatgcgaaagtagagagagaaaataggaaggaatagtccaagaaaggacgataaaaattaaataggccaggtgcagtggctcatgcctgtaatcccagcactttgggaggccgaggtgggtggatcatgaggtcaggagatcgagaccatcctggccaacatgatgaaaccctgtctctactaaaaatacaaaaattagctaggggtggtggtgtgtgcctgtaatcccagctactcgggagggtgaggcaggagaatcgcttgaaccagggactcggaggttgcagtgagccgagatggagccactgcactccagcctgacgacagagtgagactctgtctaaaaaaaaaaaaaagaaaaaaaaagagaaaaaaattaaataaactaataataaaatcataaaatctgggctgtgagttcacttctagaatgctaggtactcatggaaatttacctaaaaccaaaaaggtgaagtaggagctgaagacaggggtgggggacagaaggatggggaaatgggaatggggggcacagacaggtggaaaatttagaggaatatagaatttttcaccagcttgaagtaaaactttctaattattttaaaaaaccttataatatatcattactatgtagaattaccaacagataaatttagtctttaatactcaaaaagaataattttataaagaaagttaccacaagacaactttagtggatcctaattgtattcataatgcaatttacaaaactgtgatttacatacatcttgtcaggcacacatcaaggacacaaaaggcacactcacactatctcaaagcatgtaataaaaaagggtgctataggaaaagaaacccaccagtttctactgactgtatctcttccttttctttctgtttagccttgtcatcattaccaaggagcttgctcattcctaaaacacatttgctacaaccaggcatttctctttcagtcagggcttcaccatggctgggaaatagacattgaggaagcagagagtgcagaaatgggtatgagtcttagagtccgaagacctaggttccgaggaggtcaccgtctggttgactgaccatactcaagctttattaacttttaggagctcagtttcttcacctaaaaaaatgagatcgttggattcaatgatctctaagctctctgacttgaaatggattcaattcactaatttcccctttttgaattttcctcatattctcttaaacagagtcgaatgggaagctttttcaaaacaataagtaattatttcttatctataatattctacttatatatcaaactgccctcgcctttgccaaagccctcagtggacaaataacttcaaataactactaattctcagagcagtgcaagtcatctaggatcattgtttacattctatacatattgaaaggctttctgtaaaagtgagaaatgttttaatttttaatgataggaaaagtaatgctttctacaaggttgaatctaaatccaagccatagataagagctactttaatttaactggtatttatggttgaggagcagaaaacaaaaagaaaaaaaattcctttgaaaatgtttatttatgacagtctaaattactcctttgacacaatgaacacaggtaaattatctcagagctgtgtttaatggctctaatggctagctgggtactgggccatgtatttcaggatgcctacttgtttataaaacttgtttccaaaaatcaggctaatatagtactaagttaccaagcagaattttttttttaattccagagtcactggccatatttcatatataattgctgggttaaataaacacaattaggttttatttagcatgtatttgattatgaatgtcttcatataaataaaaaacaattttttaataaactagactaggaaaggataaaaacttagtatcattattattctaaacataccaaggctcaagttttcattacctaaaatatactcttcgtaagacttgtggctgccgaataaaatacattcatcagatgcagtattgctttcacggtaattatgatactatttataatgccatggttatgttcataggccactaacaaacatatgcagtcttttagctacaacactcaaacataattacaatgcccctttccattgaaataatctatgcatcccgccacagtgacttcattccttaccaggatgcctgctgaatcagactgccccaattattcaggcacagtgcctatgcttatgactaataatattggggaataaacgaaattaatgtccatgacttcctgaccattttggccaatctcctttctttggtgtcttctgctttaaccctaatactgagtaatcttgaactattcctggcataaaaagagcttcacatactgtacaaagtcttcaagccctacaccaatatttcccatagtatgttccaagtatttcagtcttaggggatattgctcaaaaaaatcagagtgcggagaggttccaagatcgaatacttttgggaaactttgcatactatattcccaatccttaggattctcctaatctattcatatactgaaggctcttataagtcctgaagtaaagaaatattttatctacatttaactcacgcaattgcaaaacttacttaaccatgaaacctatttcatattactttttcaagtgagtcttattaacataaaactagtggcaaatatttgggtgtccctgtcttcatgcagaatttgactgcccaggtcctattcctctagagactagttagattctggccagttaactggagaaatcaatacaaattgagaggttaattttgttaatagattcatgtgttgtctctagcagagggtggttgattttaacatacatttgcaatgcatcagccaaagtgcagcataaaacggaagagaataaactgtgagactataccttgcacatgttttttattgcatgagtaagttctatatcaggtctggaatttctgtactcaaaggacttatattctgaagcaacaattacaaatattgagtggaggtaatatttgtggacattgaatcaaaccagttttctcacctaacataaataacttacctgcattttgatgttaaaaaaaaaaagccacctgccaagatctggctgtggagccatggctgtgtatcagccatgtatttgagtagtgacaaatacttaattaacagggtcattgaattgagaagaaggcctgaattttgatttctacaaaaaagtttcagagaaagatttttgctttaaaagtctgactctttataaaatttcttcctgtctttaaagaaagtcaaaacatggacaaaagccacaagccacctatcaatattcatgtgaatcaaaaaattaaatggtaatgatgaggatgagaaaaggagagaaatgtatcttgcttccctgttaaaatgatgacacatgtaaggacagccccatggcatggtgtctgatacttcatctctgttagctttttcttcccataatgcttcttccctcaaaaaatgctgatcacagaaattttgaaacacaagatatttgtggctttttttttcagtggaaaccatcattattgcctgtaaccttgatccgttctaatagaggactacagaactaatcctacaataagtcaagataactgatggcattggcaagtagttgaaatccttagtctaacaaatactgctttcaaaagactagtatactcactgataaatgcctttttaacttatatcatgtcaattatttgctattcattatctttataaaatatttcctggtttggggaactctgcaagtttcttgtttctgatgctttgtttaaacatatacaactatgtatgttcagtctgacaaagccaccacttcctccagccaaaagggaaataactctagtagaacgcagtattttaagaacagattttgttgttaggctgtattacccccaaagaaaaggacaaaattagtaagactgaatttgttactatttactcgccaaaccctcaaggtagtttcatagagataatcacaaaaacaggaaatagtacacaatgtgggattggtgtttttcctacaagctccttttcctatggattattttttttccaatggagagaaatgcttttttacctggataataaattaaaaagtggtttcttgacattttactgcttttatttattccatttaaagaaaatgatttccaaagccagacaatggtgctgttcaatagaaaatgatgacctttaattaaaactctgccccttactaattttcacatctttaccaacctcctcatcaatgtggaagaggcataattgaagggagaaaacacctgatctaaatacactttatctaaatcacttcccccaagcagacattctctatctcagttcctagttcatttccttcattgtatttcctaattcaaaattatttctttcttcacctgttcattgtgcctgtgatcacataggccataggttttatatgggagggagctttgtagactagtgacttcccagtgttattgctgaagaaaggaatagataagggaagaggaggcaaaggtgaatatatctgatgaatcggaaaaaaaggtatgtggtctcaaatcgcaattaatctctaaatgtaacaagcaaaagcaaaagtaatgcttttgtttattttactccatctttttttttttttttttttttgagacggagtcttgagctgttgcccaagctggagtgcaatggtatgatcttgactcactgcaacctccgcctcccaggttcaagtgattctcctgcctcagcctcccgagtaactgggattacaggtgcatgccactatgcctggctaatttttctatttttagtagaggcagggtatcaccatgttggctaggctggtctcaaactcctgttctcaggtgacctgcctgccttggcctcccaaaatgctgggattacaagcgtgagccatcgcacccaacctactccatgatttttttgattatttattttgaaattattcagcatcttatctcattattccattattacagtaattatctaccacctgttgaacagtacagtgccaggtactttacaaacaactttgcaactatcttgcaaggtaagaactcctgtgcctgtttcttgcagggaagctgagttgcataaagtgaagccacaaagtcacagagacaggaagtggcagagtcaggatttaagtttacttctgcctgattccaaagctgtactctcttctctacatcacaccacttaactattaagtggtgtgataaagaggtatgcttaagcctcttaaagtatctgtcttaccaaattgctaataaactttgcaaaagtcgaagctagaatctatccccctccaccccttctctttctccctctttctgtgctatgtatatactactctacatcttgaaaagagtaattttatcttcatttgctttgtagtttattcaacttctatttccaaaaacttagctttttcctgggacaaatcccccagatgttttctattctcttataacttcaacctctacctgctaaagtagaagtctcaattatttaagagattcagaattatgtattataaagtttacaaattatgtaataaaaatttaaattcatttaaaacttgagtaattatgatgccatcagcacactataagatgtaaacattttaatggtgaaatatttaaaataaatatctttgaatgttcaaattctgtttgatacatttgttctctttatttcctcaaaattacagtcttaaatttttttttcttttgagatggagtctcactctgttgcccaggctggagtgcagtggcaaaatctcagctcactgacacctctacttcccgggttcaaggcatcctcctacctctgcctcccaagtagctgggattacagtcatgtgccaccacgtccagctaatttttttgtgtttttagtacagatggggtttcaccatgttggccaggctgttcttgaactcctgacctcaaatgatccaccctgctcagcctcccaaagtgctgggattacaggcgtgagccaccacacccagcttacagtcttaaaaattatgtattgcttattggttcttcactgtaggttcaagagcattgtcaattatgcctctgtgactcctaaaccagattttaccttcaaattcttgggtgtcagttcctgtttagcatcaacacattgaactgaaattagactgtgactcaccatgtatttccaaggaattaacaaattggctctttttcctctcccactatttggatattgaaattaaagtagctaactttaaaataatttcttgatttttaaattacccttgaccaactttttattggcttcaatctgactttttttttttaacataaaatagcccttaaatgtatacttatcatgatttttttcatttctaaaataagagataaaatatttgacaagcaggactttcacactgtaggcagttcaactgccactgaaactttaattaggtcaaacttggaatctaaaatcttaaaatgatatccagtaaaagggaaaacctgaaaacataaggtaaaggcttttttctgaaacccttgccagtgtttccctgtaaatgttacagccttcaaagaccactcaacatttcccaccattttaaaatccataatttattacaaataagtatagtagaaaggttctattccatactgaatatattaataaaaatagtatttttaaaaaaaaagttcaaaaaattgtcaagtaactcaaaagttacacataacataaaaaccattcacctcaaaatagccattatttcagatattttgataaaaatatatacaaaggaagctacagaggaagaaaggccaacaggtaatgtggataggaactgaagatcagttttgttaaaatggactcaagctacccacactatattaaatatatgtaccatattaaatatagctatacttgaattaatcacagtataagaactttaaatgaaattaatgaatttactaaaaaatgagatgtttcttttttcttgtttttttttaatgcccatctttatcctgcagtagagataaatgtttcttaacactccaaaatgtattgtgtaataaaatattgatgagttcaggaaaaacttatgctttaaaaagttgggaccattacttgctataaaagctgaagaaatgaacatattaatgttttatcctaacttccatcaatttgatattatatttttcattgttcattcatagtttctattttattcaataaccatagtgctcatggtttttaattttcgttctgaatttacattgattaaagatttatattcagttttttagttggaatccctccatacctgaattgtttgtcttgattcacctcttagtaggctgaaattcactacagcttttttgtttgttttgttttgtttttacagggtggctattcaatttttttttacttataagaacaataatgtatttgttcataattgtgtgagttagcaaggcaattctcatcggggctggcctggctcatctctgaagtcatctgccagttttgaaggggattgatggtctaggatagccccattcatttgtctggctcttacaagcttgttggatttagaagccccagctaggatagcacatctctgctccatgtagtctttcatcctccagtaggctagctcaggcatattcacaagtggtagcctcaggattcaaaacagcaaaataagacagaaggccccagtgcataagaatctttttaagtctttgtttaccttattgtttttcagtgttttcttgttttaattttccttaatgagggtttatactatcttgtgtaacttcttatgggcttgaaaatgtttgtgcatttgaatttatatttaaaagataacttgggtgggtataaaaccttggtatatactttcttgtactcagaatttttacacataattctataggattttggtatttaataaacctgtgggaaaactaacctcatttttctctcttccatgtgacttgatattcatgctgaataaacacatacatgtattcattatttttaatatttattaaccttaccgtgatacagaatgccattaaaatcatatgtaagtctttatttcaggaatttatcttctactattttaatattcaagaatacaaattatatttatattggatcccttttttttcttttccacatctttcatcttcccataataaatgttgtgtttttgtgcatttgaactaaattttatgggatttttttcaaagcttttctccatatttctaacttggttttcagtcacatttattccacttgttgttattgcttctaatatttttgtctatgaaagctttcgtgtttctctcccatttctctcctgatatacataacctctttcatctgtttttcattgaacctctactttgattctcatagatattttttcaggctttttgtttgtttgtttgtttgcttgtccgtatcatatctagtataatttccctgagcgaatgggtaatttttatcctaatcttccaatgttttttgggaaatttctcttgtgatttttttatacagctctttgttgtgttattatctctttagtctcctttctatttgatggttgtagattgagagaaaaaacaggagcagtttgcagtctcttgtttctcttgctagacttttttactccattcctctgtcaccaaatctcttatttccttttcccaggtcacacctctccatctggagtgagtggctaaaaacatatccttttgcatcagagactttctatgttatggtttgtacgtactgtctcttcttccttcttcactcctcttcatctctggcattctctggttctgaaacttggatctaagcaagaaccctgtcattctagtatagattcttcttcagctacctgtcctggaggctttagggattcaaacttgtccttccattactatatatctcttccttctgagtcagggctctttagaaccttcaagattgtgactcttgcttttggagaattatttatcatactctaactagtactatggcattacaagaaaaataaacacacacgcatatgcactaaagcagaagattacacatatcatttataaatacatattgttctttagaaaagttattattatagttatagcaactaacatgtctcataattgtatgtaggcaaatatacctccttcccacattagttagaataatctttggatacagtaacagaaaatccaacaatgttttaaaattgttttaaaatatgttttaaaatataaaagggtttatcatttacctttgaaaataaaaagtcaggaagtagtgtcacctaatgttggattgctgacttaatgatgcctaatatctctccaattatttttggcttatcacctcatagtccccagatggctgctatcctgtaggtattagatctgtgctcaaggcaagaagaagagtggggggagcactagctacaatcatcctcttttaataagaaaacagaagcatctttaccaccgccaccaccactatcacttccagcaagtttctgctcacatatcagtagctgctaggaattttccaatgcttttgtatagccatgcaagaaagaagagtgttagcaagagctttcgactcagccaaccaacaatgtttgccataccccaaatgctgaactcctccacagaaaggatttgagcatatccatatttgtatgcccagttctcagcagagtttgacatatttgtagatactaattaaatatttgtcaaattatactcctttatggttaacattatttcttctaaacctaacaattgaattgacattttcaaaaacacatttaccatgaatcttagacaactataatataatagagaatctacaatataaatctataaaatctcatattattaaactgaaattaagattatttgtcaactatgtcaatataggccaggcgcggtggctcacgcctgtaatcccagcactttgggaggccaaggcagacggatcacgaagtcaaggggtcaagaccatcctggctaacacggtgaaaccccgtctctactaaaaatacaaaaaataaataaataaattagccgggtgtggtggtatgtgactgtagtcccagctactcgggaggctgaggcaggagaattgcttgaacccagcagacggaggttgcagtgagccaagatcatgccactgcactccagcctggggcagagcaaaagtctgtctcaaaaaaaaaaaaaaaaaagctagcctgttctgtttttaataataaactattcagaaggttacaaattcagtagaatacacaattgctagtgaaaaaacagaaatttacccatagagtgcaattaggaagccagaaagtgctttacagtgctgcattgtctttctggagttaaacttaaaactttactgtcaatatttatggaaactttcattctattccataacatgtacatgttggtgataatataaatgagtattttttccctaaaatttttagtagaatttcaccctaggctatgtgtaactttaataatgatgatgataatgatgacgatagcaaatatatagagtgcttacatgtaccaggtacttttctaagcactttatatgtatgaactaatttaatcctcataataaccctaggaggtaggtattatcatcaaccatacatacagaagagaaaatggaagcagaacttgaggaagtaatttgcccaaggacctacaggttgcatgtggcagaggtggaattcagtcccagatcatcaggccccagaacctggcttcataaacacctgcccttgaaacccactatggagccccaggagtacccatccatggttttgaccaacattacctcctctgtcatttcaagaactctataggcattatctttaggtttaatatatgaggaaacagaaacttaaagaaattatggtaacttgccaaaaatcacaagctccgtagatacaagtcaaacacaactctctctggctctggagtctacattcttatccactgtgcagtgcactgtactgacagaaggggaaaaccctacagtgtgtgatgcacttcctatgtcacagagtatgaagaatgtcacaaggtcacggaatttcagagctgaaagggatcatctagtccaacccattcatttcatgggtagagaactgaaacccagagaaaatagaaatgccaccacctcggtgccagatctcctagatgcccacctacaggtcagtcctctctatagtatcttctccccttttccctttaggttgatttttcatttaaaaattatttgatataatataaattgttatagctcacaattgtgaggaaattataaatatttgcctttatgattttagaatgatgaaaacctttgttattctgcagactttctccaaagctttatttcaaaaagcatcattgttctttttcatcttagaaaacataaaacctacttgcttgtcttcaggaaccctacgaagataaaaattatcacaatttatacccaacatacctaaagaaccctgtccattgtgccctcattggttgtcctcttaacttggacaaatgtaatcacgtctttgatgtatttccagcttcacggtggttttggatatacacttctgtaaaatgatcaagatttttgttggaattcacgagtgtttgttaaagttttattaaaagcgatcctagaaaatataactagagcttactataatatgttctgcaggtgggaaaaatgttacagctccatgaacataaagcaatcattaattagcagcaaagacacgccattttcaatcttatcttttcatgattttaaaaaaaccaacacttttcccttatattttccaggtaaggcatcttaccagttcttatgcactgcaatggccactaggtaatattctttaagcaatactgttatacatattattatattacagcaatcctaaacgagataggaaagacatcatctttcattttctacatggagaaattaaggctcagagaagttaggtgaaaagactaaagtcaaaaatgctaatgggtgtaagaacctgactcaaattcagatctgtcaaatgcatctggtgtctgtccttaatactctattaagttgcctctcttcatttaataaaattctctaccattcaaaattaaagttgtatatctataatgtttgctgtttatttcagtgagtagttatttcagtttttaatagatatgttttcctttattaggatttgttaaaactaaaaaaattaataataacttcaaacaatcattgttatcatttccaataagcaaagcagacaatttaaagagacagaattctcagacatgcaatgctatttcaaagtccattcacgtgctgtgcaaaaagtcacattaaaacactttatactgaactataccatgacctcggcaaacacagtactcctaaaagcacagttatacttgttgatggctatgagtacagattacttccttttcttgatacaaaagtattaaaagtattaataccatacagttaaatctgaggaataattaatttgaaggaaggtaataggcaggtaaagcagctcagtataatcaaaattttcctttaaagaggttgacagttactctgatgtaatatcctggaagtttttttccaaatgtgcacttctgatttgcatgaattttaaagtcattactggtgaatacagaaaagatacaggcccactctcacaaggatgtagattgatctctgatatctagccttcccagtgtgccatttggggtgtgaaaaggtaccccagagccccaaggtctaaaaacccactaaatcagggtttcccaggactgctgttttataaacactccagagaatttgtctctaaaaacaagtgatgaaggacagagacaaaagggggagtgtaaaaaataaccttttttccccttaaagcaaagaatcaacattagtttgtattttggttcattgtagaagtcgatcactattgtgcactaatcatttcactagaaaaagtatttcttttcctaccattcttcaccatgcatgctttagtgcttcacaggtgtacaagtgattttcttaaatttataaccacagtagacttacatagatcccttataaaattgatgcagcagtggtaataggtttacacaaaaattgtaatttatgtcattctgttttgttgaagggaatcttggcttctatttacagctttaattaactactgtatacttcctaattgtataacctgtgagattatggactatataacttaagaaatatctttatctgggaatcccaggtggtgcctgtttgtaacatatgcattcttgaaatatattcttctagacaaaattagtttttagattaaaatattggagaagatactgttcctatgatctcttttattttgtacttcaattccaaaatttataatgtatttgccaaagactttctttagtagctaatggaaaaaaattctaaagaagagatggtggtaaggctgtaattttttaaaagaatgactattctttcattgagatgatatatgtcctatataaaaacttcaagtaataaagagaagtttcagaaagtttcactttaagtcatccaaattccatttatcagaaaaaaaacagccatctctaccaccaagtaaacatcattccaaacatagctaaatgtttaccaaggtagaaaaatggtcagagagatgtatacatacataagccttaattttgaaaaaaatgaaatcaaattatatatgcattttaatatttaaatgttatattttcttttcctttaatttgactaaagaaaatttgaactaaaaactgaaattcaggtaaacgtttcttaaacccaaaacatgttttcttttctacaagggcactccaaagttgaggtaaaaaatggaaaaactttaggaggttagaatcatctgtctatttcaacattaggtagtagctattaaccccatgctatgtagttagggaaattaactgatacctcttccaatattaccttgtcacatattaatcattttcattaacatgctttcattatcatagtttataccatttatatgctattctctaatttctaaagctgttattttttatccatagatagatttgatgctaaccatcttaaatcagagttcctccattcttgagctactgatgttgactcatcatgtatgtgcatgcacatgagtttaaagaagagctccagggttctatattgtctaagttttgtttcagaatgtctttctcttgatactatatttgactgaaaataaaacttgagtcatacttcccctccttcagaattgtgtagtaattgcttctctgggttctcatattacgtggaaattgaaagccaacctttattctccttacatgtagctggtatcttttccataaatgttcatctggttgaatatttatccttggagttcaggaaacagtttaaagtatctctcagtattcattgttctatctaaaattgtcctagaacagagtatgaacttcaatttgaagattcaaatctttgtaacaattttcttctttttattttttatttttattgattcatttttttctgttccctattcttaggatcaccaattacgtacatgttgtctctcttttccctgtcttccgtatctttcttcattataaaaacttcacactgttcatacacatttcattttgtcagatttttttccaacctagtatctatgcttgtgactttgttttcaatcaagtttattctatttgtgttgcttccagtgtctattttatttctgtcatttttttcatttccattttcattttttactgaactcttgttctgttttcactgcttttattgctgtatactctcttctttgaattcatctgtctcctttctgaaccctatttttagaatacgtatttgttgtgatatacacttgtgtcatttatttgcttgttttcctctccatgtgtgaaacagaaaatggtagttttatgcatgagtttatccactgttccctttctgatcgctactcctctttgaatgagatagcaactgaccaagtagtacaatggggaggggaagaggaaggggatagctggaaatgtactgaggaagttggcagccactatttcagcttacgaactcaaacatcttctttccaaatattttattttcttaacattgaaagtagttcttccctcgtttctttttgtttgtttgttttatttaaggagtttgcatggatcacagcaagtttccctacagcagtgtaccacctacttcttccaccttctttgacagactgcctgggctgaaagacaaagtggtagagaatagaacgaggttgttggcagaaagtccctctgaggcttcccttccctaccattctagagtctcaggcgggatttctacgtggttattctctacttttcttatgtatcacgcagaaactaagctctctttaatcaaaaactaccaaatatttttgggggaaaggcacctattgataatgtctgagtcaacatctcttagtgggtttgattatctatttcaatatttaatatatggacttcgtaatttgtatcattgcagttgtgaggcttccttgctttcttggagatgacaatattttccctcttttttgacttctttgataattttagtagactttgagaaagtaagaaaaacacctctataacaatatctaaaactggaatgatacgaatattttatatcctatcaaaataagttttaccatcaaaatgtctggttcaaaataggggatttctaattagttcacataaattgtatctactgaataccttctatatatgagaagaacctagacacttggctaggtgcaggtgtctgtacaaaaattaatgagccaagatctggaatctcatggagctcacagatttatagctaatcattgtataataaaatagatgtaacaataactgagcaaacaatatattcatagtatgaaaatatgggatttaatattttgtgatttccaaagtgttttcaggtccatttaactaatattcattgagggctatgttagatctaaaaacattactgaaattgccaacttcaaataaactaggccaaggttaggttagttcccaagaacacagtgaggttaggttagttaccaagaacacactgacatagagaaaggctgtttctgattagaatctaggattctttctaccacatcctgttgctctggaaagaagaacagagttgattatgtggaataaaaagaaatctactctgtgagccacgattagtcctccacataccatgctggcatccacaatctatcttttgtgtaccacactgggaaccacaatccatcctctatggttcggcctttaagaaatatactgtgattcaccctcttgcagtaacagaaactcatatggctctacctacaacaccagccatagttctaatgtttggaagtggaggtatttgaaaatatttctttcttacaggacagttagtaggttaatcaaaaaagttgacaaaatgtgatgtcacaaaaatcatctgtgtgtgtgtgtgtgtgtgtgtgtgtgcgcgcgtacaattttatgtgtacaattttattttgagatggagtctcactctgtcacccaggctggaatatagtggcccaatctcggctcactgcaacctccgcctccagggttcaagcgattctcctgcctcagcctcccaagtagccgggactacaggggtgtgccaccacgcccagctaatttttgtattttttaagttgagatggggtttcaccatgttggcaaggctggtctcaaactcctgacctcaagtgatctgcccaccttggcctcccaatgtgctgggattacaggtgtgagccaccatgcctggcctgtggatatatattaaacatatattttaacttaaaatatataaatgttaattcacttttcaagtgtttacagtagggccaagactttgtattttggtagtgattcactcactataaatatgtacttttctgtattttccactttcatttatttttacttaaaatgagagcataaaggcatatgaggccaactacagcaaatgtctatgttttatgaggtagtttactcttcgctttcacccatttctgatttgattcctgattcctgattttcttcacccaactttttaaaggcaacaccccttaagtcttatcagcatattcaaattggttataaatgtccaaaaccacatttgtattttgcatttctagtatgttacatgatatttgattaaattacataaaaaatctagtacaactgttataaacatgtttgggaacaaatacagatgacctttaaataaggtttcaattcaactggtgagagcagtaatagacagacctgctagtgttgttacctagtgattaagtctgtgggctctggagccagaatgcctgggtgtgaatcctgatccattacctactagcctttttaaccgtggacaagccacttaacctctctgtgcctcagtttcctcatatgcaaaatgagaatgacattaattaaggttttgttgtgaagattaaaggagttaatttgagcaacgcacttaaaacagttcatggaaggtgttaagtgttgtgtataaatattagatattattactacccaggcattcagtgtataagagacgccagtcaatgtgttttgcagatgaaatggaaaacactagctaatctggcaagtgggttaaagggaaactattaagacaaactctgattttcagtatcagtttgttaactagtgacccttattagatcataagtatcttgagagcaggaattagatcttctgttccattcactattacatatctaatgaatacagtgcctgcacttactaaatattttctgagttaattaatgaatcaagttcaaatatggtaggatgataaggtttttacaacaggatatcaatactacctcataaatatgggttacttcacatttgaaaccattcttgccacttttctttttttaattttattttattattattttgttttgagacgtagtctcgctctgttgcccaggctggagtgtaatggcgttatcttggctcaccacaacctctgccttccgggtccaagcgcttctcctgcctcaccctcccaagtagctgggattacaggcatgtgccaccacgccaggctaattttgtgtttttagtagagacagggtttctccacattggtcaagctggtcacaaactcccgacctcaggtgatccccctgcctcggcctcccaaagtgctaggattacaggcatgagccaccgtacctggtttcttgcctcttttctaattgattcttgcaagaactttatcgtatataaaattatgtacactttataaataagaaatatggagtacaaagaggttgagtaatttgttccaggttacacagtgtgagtcattgatatagctggggctcaaagtcaggactcctggaggtctccctatgtaatgtcatcccttccatataaatagtcttaaaataacctcagttaatcctttgtctccatgaataccatctaccctgtttgtcctatttgacttttgatgctccttactcactttaagttcaaattctaagcgtccgtttatgaacaaatctgttcctcttccgttcttgcctaattttctccattgctgtaattctaccataaaaacagccaagcatgagattaaatgcatttatgaaataagaacgtcacttgtttaatttgctttaaatacctcacctgtgatgcatttaacaacataattgtgttaataccaatatcaactgctttccctcactgtgtcaagaagtacagtagtttagattctaccaaggtcaccttctcttgcagcacagtcccaaatcgccttacaataaaaaacatgttgtcaaaatcaatgaatggacagaattatagtattttttataatcatagcttaatgaaattaaatgggtgagccacctcaatctaagccaatctttaaaatatcatcctaacaaatgaagcaaataagtaaagaactattatgtgggaggggaagcaaggggttgacaagcgctcaaatatacagcctcatgttaaattatattattaagagcacaagggcttctttatattcataaccattcttaataatatgtcccttctgagcttttattatcttctcttatgaatggatggcagcagggatattgtaacttatctcaattgtaagttaagctatgtaggattcatctctgttcacttacagagtctaacaatttatcccctctataagtttcacaatagtcttaagtttattgaactcaaaccattcaacaaatatttactaaattttgttatgtcttatccactgtattgggcactgtagagaatcaaagattgcttaaggacagccccttacttcaacgaacttaaaatggaatggaaaattcagatttggacatcaaaagttatttaaggggagaataagcactaaaacctgggttttaaaaaggcataatgaaaatacaaactagattaattctaatggaatgaccatgtaagtttcagaaaggtgtagtatttgatggtttcctaattagtagggttggaacagaggggcttcagatgaagagatgagagtgactaatgcatggaagaggaaaataaggggcctcaggaataagagtatgacattgtggctaacacttacactacccggaagatagtgtgagaaaaggctagaaggctagttaaaccttgactatggaaagtctgagataccaactgaagagtttgcccttacttgacagttaacaggtattaaaacttctctttgtttcatttttgcagtgggttgattatatacattttgtaactattactctgacaggaggagataaaatgtgacggaagaggaaggccagtcaggctattgaaagtaatttaggcaaaagtatcaagatcagaaaagaagttcaattatccaacacaatactgggaaaaaaaagctcaactttgtcaattattaagcaaagatatatacagaatatagtaccatttcacacctttaaaattagccaaaaatttaaacaataattgtgaggttaaaatgtaagaagcacttgtatacaatcagtgaataaatcagtaaataatacttttggaaagaaatttgatattttaaaagtcatatgaaacatatatattttactgaaaatataaaattttaaataccgttcatacaaagagtcactgtcatgttatttgtgacagtaaaaacattaaaaaatcctagatgtctaacaaaaattacaataaaaaatttgatgggttgctatgtagctatcaaaattataatcatgaaagttatgtagtgatatgagaaacatgtaaaaatggaataaaattgtatctatactattattgcaactaaaatgtaaatatatattccgaaaaaaatggcaaaagtacatataaaattaaaagttgagatactaaaaaatttcctcttaagatttctggacttcttaaaatgtgcacaataagtaatttaaagcattaatgtgatgctgaattaggacaatggcaatccaaatgaaaggaagtactataaagggaaacatggtagaaataaacaggagtgaagtactaggagtttgaagggatgaatgaaaagaaggatgcagacttagaggctgagagcctggtagaatagtcagagaattaaaagtaaactaaaaaggtttattcatgccagttaaagcaaacaagttctgctctaattgttaagtcgcaatagacctttcctacgcatttggaagtacgaagtgtatttctgaagaaatatcagtgctaagacaggaacttggaccttccctgaagtagcttgtatttgaagccaaaggagtgggaaaaaaatatatatcaaatttaaggatgtagaacaagaagagaagacaactttggaaagaacatggagcaacacttccaatataaaagataggaaattcaaaaaagctacagaagcactctggaaatgaatagtcagtgttagagatccatgttagcatactgccatggcaactgagaaaaagctttttgtacacacatgcctctgtgtgtgtgtgtgtctgtgtgtgtgtgttctatgaaggaacaagttatccacatattatagagaagtagaaaaggaaaattgggaaaacagatcatagaagttggctactccaagatgaccctagaaaagtagttttcacagactaataaaaataaaattttcagagatgacaaaggaaatggcaggaaggtcatgaattttaactatgccttcaaaaaagtgaatttagtaaggttgcagtgtacaaagtcaatatacaaaggtaagtatactattttttaccaaccacaaatgatgaaaaattttaaatatacactgaaggccgggcacggtggttcatgcctttaatcccagcattttgggaggccgaggcgggcagatcatgaggtcaggagatcgagaccatcctgactaacacagtgaaaccctgtctctgctaaaaatacaaaaaaattagccgggcgtggtggtgcacgcctataatcccagctactcaggaggctgaggcaggagaatagcttgaacccgggtggcggaggttgcagtgagccgagatcatgccattgcactccagcctgggcaagagagtaagactgtgtctcaaaaaataaataaataaataaataaactgaaaacaaaattttctgagtgaaatttaaaaagactgaaataaatggagaggtataatatggtcagtgattggcatactcaatattttctaatgtcacttttccccagttgagctatgtatctaattcaatgccaatcaaaatccaggtagactttttgtagaaattgacaagtagattctaatatttatgtggaaatacaaagaaccagaacagtcaaataaaggaaaagatggtatggtaaacttaagatagtatcaagatcaattctctaggtaatctacagtgaataggccacagaagatagagacccagggaatgtgaaactgctgaaaaggttctatgtagagtagaataagacattcctccatgaaaagtttcctcatggcttttcatgcttcctgaagtcaagaacttcaggaaagaagcatcaaacttcagcaataattccaacccctgacaatccaccaggcttatccatggatcttctatagagaacgatgactaaaatctacccctagagctgattatttaatagaatagctctaacttaagggatctatgataatacatgattcttccacttctcatacccaagcaaagtctaatgctgtcagacaaggtgatgatcctcagcttggaaagacctaaagtgggaatgctaattcctgtctctatactgtcattagaatctatggagaaaaattgagtcaatatgtatcgatctatttcagaactactaatcttcttacaaagacatcaaggaaaaattacatagaatataaattgctgaaacatgaattggattttacttaacataatatacaagaaagcatgtaagactgcaaggttaggatacaggagttttacaattttgctacagattatgtaacttcaggtagaatgacactcaatacttggatggtgttactatgaaattcatgggtaagaagttgggctagataatttctaggattattttgggttattactcaatttctaatcctcagagtctatattaatttcctcttgctgctataacatattaccacaaatttagtggtttaaaacaacacaagtttattatcttccggaggacagaagtccaaaatcagcctcactgagctaaagtcaagtcagcaggactgtgttccctccagaggtctaggggaaaatatgtttccttgcctctctagcttctaaagactactacactccttggctcctggatccttcctccatcttcaaagccagcaatgtggcatcttcaaatttttctcctctctagctgcttcagtcatctcattgtgttctcgtagagtctgactttactgcttctgtctttatattttttctctcttaccatgaccttcctgcctccctcttacaaagacctttgcaggtacatcagtgagcccacctggataatccagtatcatttccctatctcaaaatccttaattgttctgcaaaatctcttttgctgtgaaaggtaacatagttgcaggttctggtgattaggaagtaaacatctttggtgggtggagggcattatttggcctaccataagaccacgttaatatatgcttcaaagtcattatgttttggagttatgctataaaatcattttcctaactttgaaagaaacaacaaaatgagccatatatgcaaatgggtgtaaccagcaaaagttaccttagaaaaatagataattggttcattgatcttgttaatgctcagatattggtaaattatttatttggaaggaccttcagagcctactaaacattctttggcatgtcattgatgttgctttaaatattttaacttgctcaaaagttatttataaccaatattaatgaattttaaaagaaaccacaagaggccgggtggggtgactcacgcctgtaaatcctagcactttagggggccaaggcgggcggatcacctgaggtccggagtttgagaccagcctgaccaacaagaagacaccctgtctctactaaaaatacaaaattagccaggtgtggtggcgcatgcctgtaatctcagctactcgggaggctgaggcaggagaatcacttgaacccaggagcggaggttgcggtgagccgagatcatgccattgcacactccagcctgagcaacaagagcaaaactctgtcaaaaacaaaaaaaaaaaagaaagaaaggaaggaaggaaggaaggaaagaaagaaaagaaaccacaagaaatatttttcagtatcacccaccaattggcactgaaagtaattaccaaagactcattcagttaactaaattctggtatatttgcatttttaagttgtttgattagctcataagcctattttgtaagcccatgcaaaaaaaaaaactcctctccccaaactaaaaacatggttttgtaaaggccacatatccaactttttacctcccctatataattttttgatatacttgttctctcctaagtacaatgcttgggaaaataagatcatagattaccaatcactcagaaattccagacttcctatataataataaaagcaagtttattaaaagggtgaaaatgtattttgcatcttgttatttgcaatgttactgagaatagctcggtttctgacttttttctttaacccctggaggaagaatatttttaaaatctatatagcaagttgaaatcctctctaaagtactatataagtactatatcattacacaacaacaacaagtattgttcttagttacattttgaaaatccagacaagttataatgcccattaacatatgttcttaatttttactcaaatactgatgatcgctataaagacacatgcacacgtatgattattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcattcatagatgggaattgaacaatgagaacacatggacacaggaaggggaacatcacactctggggactgttgtggggtgaggggaggggggagggatagcattaggagatatacctaatgctaaatgacgagttaatgggtgcagcacaccagcatggcacatgtatacatatgtaactaacttgcacattgtgcacatgtaccctaaaacttaaagtataataataattaagaaaaaaaagagagaaaaaaatacttatgaccatctggcaatccagattcaagtagagttttaagaagatgaattaatatttttggaacattttgtaaatatacattttgtaaatatttttatatttgtaaatataaaaatagaactaatgaattgtattaaatactatttaaaataaaaacaaaataatataacaaaacaaaagaaataaagcagtgttatataagtaatatggaaaagttttaaatcttcataaagctaagagggaagacattcaagaggaacatgccttcaaatagctccttatatattagtcaaaattatctctcaagaaagaacagtcttctgaacattcatattgaaggaaaaggagcttaaaccctgggaggaaaccaatttcttcataaagcatctctttcagtttgagcaaccagtgacgaaaaagtatattaacgttcatttaaaacctcttctgtctggttcttagttgttcaaagagttgattgacataaggagagatttatgaaaaatgaaacaaactcttctcatgtgttaattaaaagagttcagaaacctaaaatctacaaagcttattttcctcatatatctccttaactctgagaggttgtaatttaagatcacattaaaatagaaaccatttagaagagggatcatgccttctttattctgtataagacacagttaattctgggttctcagaaaataaatgatgataaaacatctccttttaccaattcacaaataatttcaaaggactcagccaaatctgaaaactctctgagagcgtagatttttgccttctacttcttttatatcccttatagcatctctagaattctgctgatagagtgagtgcccaataaggtgagaagacagaagagggaaaggagcgtaggaagtaaaggaagaaaacaaaaggaggagagatgaggaaaggaaggatgagaggaggaaaaggaagatagagctgaatgagtcacctagatctttttaattcccctcgtggaactcactgaaagttttacatctgacattcaactgacattcttctaaaattggtattcctggattactttaatgactcagaaaatattaaatacctatatttctgtcaatgataatgacttgccttttttttctttcatgacttttttttttttttttgatacacagtctcgctctgtcacccaggctggagtgcagtggtgtgatctcggctcactgcaacctctgcttcctgggttcaagtgattctcctgcctcagccttccgagtagctgagactaaacatgtgcgccaccatgcccagctaacttttttgtatttttagtagagacagggtttcaccatgttggccaggatggtctcaatctcttgaccttgtcatccactggcctcccaaagtgctgggattacaggcatgagccaccgtgcccggctgacattttcatataattgtccataggtatttctgagattgcctaggacatataatatgtccaccagagtacctacaaagagtatattcgttttttccttttaaaactttaaaatttacactgatagatatttgctgtttgcttctgaatgataagctcttaatgtcataatgatgatgatatcactttatatttgtatagtacttttttgtttataaaatctccatctgttttctcacttgaccctcataacaaccctgtgaagcaagtaaggtagctggtattaactgtatttcatatgtgaaaaagaccagctgaagttcagagggaactatccaaggtcacactgctatattcgtttattcttctgatcctgagacattttgcttttctctactgatgagtgtatgctgcactgcattggacaactttatatggagcccaaccttttcttttcactggagtttcccatccactcttatttcttcagttttgtggtttgtcattgtttgtttgttgttgttgttattttgttttgttatttaatgtaatggcacaggcagataaattaaattttgtctttatggcaacaattttatggattgactcagaagctacagaatagatttggagagtacctatcatccacagcttgcatgacttccagtatttaacatttctcaaccaaaaaatttagggtttgacaatcagtctttattaaaaaaaaaaatctagaaggtagtacttgagagtggatggcatctggcaaactaggaagtaaagactttaggcaaatagtcaatgaaatcgagcagacattttgaaaatagaatgtagttatgtcaaacagcatgtgcaatgagaattttccaggccaagaaggaagtcagagataactgatacaacaagctagttctacttaaaaaaaaaaaaaaaaagttcttggagtttattttcccttaatatttagcaaactatttagaacatttaaaatctaaaacgattaaggtcttctaggaaaaatggaagcaggctagtgaagtcattttagcatttttgaggtttcctcccaagcattctacaagtaattacattaggaagataggaaatccctgagtagactattagtagtttagtattaaaatatcaaaattaatgagtcattttaacattttggtgcaagcataaggcaaaactcaactttttattgtaccacatacttagaaattagagtgcctcaaaaatcaacagcaatcatatcgcaactccccactaagtgttttctctgtgctttccattaataacatcagactagcccaggagtatatgtggatgtaagagcacactacggtgagttcaaaaggtgtgctttgctgatctttctttatgtctctctactgttcagcataatcacctcttttattagctgatgacttctatccaggccattactccataagctaaatattagcagctatttgaaaaggttcactaatgtaccaaatattcttaaataaaacatgaatttacagttgaaataagaagtttcaactaaacaattaaaacaaatcccaaatccatttggaggatattaagcaaatttgtaagcaaatagggtcatggatattttggagctggttcagagcaggttgattgataaatggggaagacctataaagagaggttaaagcagttggcatttgggcatggttgagggttggtttagttactgtcttaggaaaagcatgataaccggtgggtactcatctacttgagtcaagtatacacaaacacaaacattatttaagctatagcacttaagattttgaatgtcacaagtgagttttaacattgtattatttaaaacttacgtaggttacaaaagagaggtttgggatggctttttctcattgcctttaaaaataaattttaattttcccaaaagacttaagtgtggctctactaaagcgtaaaacaaaagatatttttacaaattaacttttaactctgtgattctatatcaaaaaccaatcaatacctgtgatgtccaatagggtagccactaacctcatgtacctatttaactttaattaaaattaaaagcacggttcctcaatgacactaaaaaccattctaaatagacacgtgtggctactggacactgcactggacaatccagatatagaacagccccatggctggccaaagttctgtcagacaacactgacctatccaaacatattccaaatccttcataaatgcattaagatatttgtgccctgtatttcaaacactttgataggtaaataaaattaatttttttctaaaaaacaatcttgtaataatcatatagaaggtgtattttaatcatcaaaataatctgttttcaaagtttagctaaattaataacaaataagcttgtgctaaagcaccagttggatggtttacaagggaagtcagacattcatttattgcatttttacacttagcagcttcactttaaagcattctgctctacataatggtgctctgttaaacaatgtttaaagttaagaaacatttgaagtcgagttctaaagcaatctgcatatgctatcatttaatttataaacttttgaagcacttttaaaaaccctcttaattataaaattaatgaaatatttaaatagctcaccagttaaaaatttaggccctgttgtgaattaaggaattaatcttgaactatatttatacattatgtgtatataatatattcacacccacacaaaaaatatataaatacataaattaatactgaagtgccccaaaggagtgattttacatattgtatataataattttatatatttttatgaagataaatatctgattttgcatattttcatgaagatattatgtagatcaatatatttgtttatcaccattattatttctccatagagataatgaagctgaggtagaagagataatttaatccagaatatcagaaaagtaccggtcagatgcggtggctcacgcctgtgatcccagcactttgggaggccgaggtgggcagatcacgaggtcaggagtttgagatcatccttaccaacatggtgaaaccccgtctctactaaaaatacaaaaattagccaggtgtggtggcgggagtctgtaatcccagctactcaggtggttgaggaaggagaattgcttgaacccgagaggtggaggttgcagtgagccgagattgcatcgctgcactccagcctgggcaacaagagcgaaactccgtctcaaaaaaataaataaataaataaataacttagctgtgtcacacacagcctctgaacacacattttaccccgtcatacttgacttctgttttcacatgtttgtaaagagtttaaactagatgacttcaaaagtaacctttacttaataaagttgtattattccaggtataaataaaaccctctgatttatataaattgatatatatgtctatatataacaatacatttgtctaggtcctttcctagtaaaactgttcaacatcaaatgaggtagaaattcacaggttttaaatttttcagtaacagagaagggaaaaaatgcaagaagtcaagtggtttgcagatgatagaaaaaatcagtgtcagatctaagaatatcattcttcgtcttcacttctggctacattatccctttctactatacattgtgcttatcactaatgtattgaattaacatgagctcacttcaaagattttcaagaaaatttatcattttcctgataattaaaaaggaatactgccaagtaatgtcactaaaagactgacagggactacttaggacctttaagaggacataatgtaacagcacttttgcagaagtcaggttattagaacttaagtgttggaggtttgaaatacgcccatcaacctggtaacaaaactgtcagaattaacaaattgaaatacgcactttgagtagactaggaccttagtttccgctcaaagataatgtaattcttgtgttaaagatctaagaaatgagtgagaattactctgttcttagagttctgcaatgtcacaagatcataaaatcctgaatcaagaaggacagatcagaggtcattttgagcagcctcttttattgggccacaaaacatgcttatccccatgcaataatggcattctaattccagtctttatcaatagtaacaataactttagcaattactttttaatctcagaattctagaaatctgagttctaacaaaaacacggtgtatataaaatggtttatggccatgcataatttgtctgccttcttttccagtaaaatgaggtaggtcatgtacatttcatattttagctcatgaaatcttcaccattttcccacaaggtttgtttccactttatatgtgagaacctgaggcctagaaaaaatatacaacttgcccatggacacacaactagcaactggttatcagccaagatttaagtcctctactttgactccagaactgacattttttatattgtgcttcattgctttttttttgtttgtttccagaacaagggttacctatgcagaggtaactgacatatgaaaactatccttagaaagaaatcaagtaaagtaaatttgcctactttcctcaatagcccatttcgcctccaataaaatcatatttaacgggttgatttccaaagtatgagtttgttttacaaaatttaagaggaggaaaaaaagaatatgggtgggatttgtggaggtcctgctatagttaatgagaagatatcacaaatcaggtaaaaatactctctacagatttcttttatgtttgcctcacatactgccaggtattaagcatcagacagatgttattgatgtaatttctacagttacaatttttcacttgaaattcaaaggtagttaacagaacattattcaaattgaatctgtatcatgtttaaggcttctagcttcattatataatatcctgtgtaaaagaagccaaataataaaatgtctttgatgtcaacaaaagcaattttcctttttttatgtgttctcagttcaattagctcccctatcagaccacactgaatccttggctctcagttactaacatacaagcttttcagctgtatattaaaacaactaaggttttggtactgcataatgacattttctatttaattttcagcacaccatggaatctgaagtgattcagaatggctggcttttgaaattcctttgaactaaataaagcaccttcatttttacttgaattattttacagtacttttaccaatgcctaaaggaacaaagataacagctatttttttccaggaggattttggaaactcgaaattcttaaaagaactattttaacaaaaataaattgaaggaaaccgactgattttaattttagagatcattgctttcaaatatatgatcttcaagtcctcttgaattttgagctattttgaaatcaagttctatttgtataaggctttctctctgaggcaaagtgttatgtgagggtgctttccagcattcaaaagcattatatctcaggtcttaaccatatttccacatgtgcacatcttccatcaaactgtggctcatagcacagttatgcaacacaaatctcgatgcttctctcccatcaatttttgaggaaatttttgaagagttccccaaatcagattattatctatgtatcaatacttggtcagaaaaaattcacctgaaaaccattactgtatactgtaccaatacacgatgtaaataaaagttgagtgcagtagacatagttcacttctactacttataacacacatagtgcctaatatgtgccgagcactgttctaactacatattgtaactcatttaatcctcacaacaaccctatgaagttagtactattattttccccattttaaagagaagaatactgaggtacagacagatcctaaatggtggaactcagattcaaacccaagtagcccacttctagaatctgcataagtaacttttactgtatagtgtttctttttgttttttttggacgaagtctcactctgtcgcccaggctggagtgcagtggtgcgatctcagctcaccgcaacctctgcctcccgggttcaagcaattctgcctcactcagcctccctaatagctgggattacaggcttgcgctaccacacctagctaatttttgtatttttaatagagaccaggtttccccatgttggccaggctggtctcaaatgccttacctcaagagatccgcctgcctcggccttccaacgtgctgagactacaggcgtgagccaccgcgcccggcctatactgcttcttaaaaggaaaaataagctgacacattgttagaactgcagccaaaccagtgcttttaattacctaactagtgccaatggactagtttcctatcctttaccatcctgtactatcctttgcctggttgccagggcaaccgggatcactttctttaaccacactggagcttattctgtgtaatcatttgccaagcaatcatttgccaagcaatcatttattcagtcattcaacaagcacaaatcaagtgccttttatgtgcctcacacttgtaagtgatgaggatacaatgcccaataaaatgttctggttgccctcaagaagctgatattccttcttgcaatacttctatgttggtttatgatctatcacatcttctagtgtccagtgcctatactctctagtgtcttaggctctccctttctggttcctgggtattgtcatcatttcaatctcctaccctccattaacacatttatattatcctttccactccttcaatgccatcatccaaattcaggtctttactaataacctacaaataaattacaagaatggccgtgtgttctgttctccttacacctaatctttctcaaacgaacttatttaaccacatcaccaccctcctactcagatgcaaaaactgactctctagtggctgtataataagtaaatctctttcatgtaatattaaatactgtttacaatttgacccccaacctaccatatcagtcttgcctcctaccatttgcttcagatgcactccagtctaataaaatatatctatttgcagttccctgcttaccatttgatcatgttgacatatctcttggcaatgctatttcttctggccttcttactgcctgaaatatgcccacctatgtctatactaggaactcttggaaggccccgttcagaaatcacttatttcaagaagcccttattgaggtcaccagttagaagtgctcactgtattttatgaatactgatagctccgcatagcccaatctaatattcacctgtattgaattatctgtgcatattacctctgctagactgtcctattccttgctgataccaagtacaagttccttacccatatgaatatatagatatgtatagcatagtgctctgcatatagagtatctatatatatagtcaaattaagtaaaactatgatttaaaaatatgctgcaagtcactagatttcttaagaattgcatataacatcatcatatttactgttgtcaaaatataatgttgagaatgattcagaagggaccaaaactgaagctaaggagtttggaatgactttatatttatatgcgttatttaaagttaagttcctttgaagttgttgctcttgtagatgttggtatttttttttaattttgaagttggggatcagggagaaagtaaagaatataggagaaagtttacttgttttttaatgtgaatcagtaaattctaactcggagaactttttgacacacaattccaaaaaccctatcagaagctttgacaagagaagcagaaatataaggaaaatttaaaaagcccaagaaatgctatcagttcacctccctcagtactcaaaattcaatctttcaatcaaattaggcaatagacctgaaccacatcagctgagtacatcacagaaatgctttcactgtattgagctttaatgttattcttatagcttttatcaacatttgctttaaaaaaaaatccatagctgaagcatgcgtctgcattttacaaagaaactgtccagtacattattctatattccctatttagtagccaacattagaattttaattcaagttatgctttcactttctcctttctgaaaactagaactagacaacttttcttgcttttcttttttgacaaaaacaatgctttaataaaacatggatacagaattagagcaattatgttaacagtatggctactgaatttgcatcttctaacctctttaggcatgaccttatttctattagagatattagaccttagtagagatagtctcaattataattgttttacataatttggggatttattttattttattttatcttattttgagacagagtatctctctattactcaggctggagtacagtggcatgaccatggctcactgcaacctcaacctcctgggctcaagagatcctccaccacacccagctttttttttttgagacagagttttgctcttgttgcccaggctggagtgcagtggcgcgatctcggctcactgcaatctctcccttcagtttcaagcaattctcctgcctcagactcccaagtagcgacacctgtaaccccagcactttggaaggctgaggcgggcaaatcatgaggtcaggagtttgagatcagcctggccaacatggtgaaaccccgtctctactaaaaatacaaaacttagccgggcgtggtggcagctttttaaaaaaatttttggtagagacaaggtctccatgttgcccaggctagtatcaaaatcttaagctcaagtgatcatttcaccctggactcccaaagtactgggagccactgcacctggccaggggttttatttttaagagtatactttttaaaggataaatatcgaggctgtgcccattcatttgtttatttatgcaataaatattatcttttttcaattctagagatacaacagtgagcagagacaaaagtttcttccctcaaaacacatataattctaactctgggaaatgaatattaaagtaggataaaagcaaaatatataaaacattggataaaaattgtgaaaaaaaataataatgcataaaagaggaaggaaagggtagttgttttaaataggaggaaatgatacttggttgacaacccaaagggagtgactcattcatctatttgagatgcaggcgatctagtcattaagtacagagaccttgggtgttccggggctacctggagaccaaatggttggagtgaagtgagcaaggaagagaggcatttgactgggtgaggatcttggagtttattataaggactttacatttgactcattaaacaagtagagagatgttcacacatctcaactaatagtaataggtaatttttaaatgatgtttacttgtaagtaatgtgtcagtaagcatcagcaaaaaatgttactttagagatatttaatcatttagtttaatgccatcctttctcttctttcatgtactcagcaaaatcatattcagcagttactatgtggcaacactatgtggcaacaatggaaatctaaaaaaaaaaaagaaaaaagaaaaaaaaaacataattccaaacctcaaagaaatgtctctcaagtggcagagataagtattaattattaaaatttcttttctttagcttttaggtaagggaaactatataagatgtttaggtagaggagtgatcatcatatctgcatttcaggtagattcacatgtagaagagatttgaatgaagtatgactggatgcaaggagatgaattagaaagctgtgaaaaatgatgaaaacctgaactaagacactaacagagggtgaggaactaagtagaaagttacaatccatttttagaatggagtattgacaggactttatgactaaataggtgtaggtggtgtgagaggaggaggaatcaagaataactcccaatttttaacttgaacaaatacatggatggtagttacagtcagtgagttcagcttaggacaatttgagatgtattggtaaattatgattagctgacagttgatattatggaaacccagagaggttgatagatttaaaagaaggtccaggacagaaacccaggaataccaacattcaaacaggaggcagagaaataattgttcattaaggggattaacatgaataaacagaaaaaaattcatgtaagccataggagacgagagattttacatctaataatattgttgactgtgtccacctgtagtggcaaacttgatgtgattatttatttcgatttaatagtactgtttatatgagtattgtagagcaagcatttcagagcaagttattatatttataaagattatctgaaattcagttggataatcctcctgaatataaaatatattgtattattttattgttgttgttgattagccattctaaaaaaatctatcctcctaaaataaaaatgcattgtaaaattatttccttcagtccttcaaatgtagtcacttcaatgtgcttttaatattttagtttacttaagtcactatatgtcaattaatatcatttatgaggaaagaaatagcagtgctacaaagaaacaaaaatacgtactataagaagatgaaaatatatgtccattaattagaaaatcctaggctactgtgtgagctcaggaaaaggacaactcatttatgaaaatgaggttgatatatattctgatatcatggaaatttcaatggattataaaatcagtggaagctcaatgctttgaagaatacattaaatgtgcataatagcagctagtatatttttgttatctggtctttcaaccaagtacttgtcaaccaagaattgcttacaaaattttcctatcaattcctaaggtgaaacaattaacagggttaacagtccaaaatcattagtcaggtcattggcagaaccaggagttcaatatgagatattttttaaatgtctctctttatattgtctgatacttaaaatctttaaaagtaaatgcataaaatgaaaacatcaatatgtctttatatattatgttataataatacatacaaatttagtagaaaggaacaaattaactataaaatccagataacttgtagcatatgtaaaaaatagtcttttgagaagattcatgatagatattaatttttcaggcataatcaagaattggaatccaaacagtagaaaattcgtgttagaaaggacttgaggttgctatatcagcagatatgttctcctttatttttacagtttctacctgtcatttgctctataataatacatgaacaaatgcctcacactgagattactatgaaaccataagctatactgttaccatacttaacattataaccaaaattacaacttcacaaactgtaactcgaggaaaattacaggttataccaagtgtagcagatgtatagaactgtagcagctgttagaaatcctgaatattataccttatgaaattatatttccagttaacataaatgctaaaataagttatttattctaagaagttttttctggagacaaacatttccctgtgcagcagaaaaagcctagtattagaaaagcctgctcttacaagtacattcgaatgttcagaaattcaaatgaagcatatgttgtcaattaatccaagtatataataatttttaaattatgcctctatttacctatgggtgatgcataataatttattaggagagttgttgatactttttttgtttaaaaaataattattagataactagctcagcatcatagagaactaatatctagaggttagaggtgaaaattagtaaagggaccagaaaaattaaaaatcatgacagaacaccagcattatgtaaacagttaagtaaatcaggattaagaaccatcccaaaaatgcacctgcaaaatcgaaacaagcaagtagattgtttagatctacttgcttagtccactgcttcagaaatcagcactgctttgtttaaaagataattattgattgctatgttatataataatcttccaagaccgttacagattaatctgaatacctatgacctcaatctgaatttctatgtcttagaagttttggagatagccaacccaccaatctgtcataaagcatattagctgtctgggggttaccagttcctcaggaatgtcaccctgtcctgtcctctccatgtgctgatcatgaggagggttagtgacactccacacccattcatctctctcttttttttggtagtgtaatgagtacagcaatcattctagcagtatttgctatgacaacatcattcagccccaacttatgccaaaaatgtgcatgttaagtgaagggaaacaagctctaatggtgccctttaatgttctgaagacacaggtgttctctgtgaacttgacatttgctcggtctacatgtgatcctaagggttccagataagatgaattactgtgtgaaagtcctcaggcattttctcacagataaatagcatgaaattttgtgatggagagagaacaacctcagtagtaactaggtaaagattgtactggttccccagttgataatgggagccactgcacaaaggtcaaacaatttggatgcaaagtatccaatttgtcatcacaaattggatttgagagtgccatgaaaatgatgagccagcacactgcttctaccccatggtgacatttactctctcttacccactctcccttagttcttatggattcttctgaaaatataagatggaatttttttctagatggattagagaaaatatgtgtctatattttttaaacagtatacaatggtgacattattaagatgatgacactgatggtgatgcaaattaaaacccctgagaatcttcactagatgcagtaataaaaaggttaaccaagatgtcaggaaaaaatgcatcctgaaatatcagcgtaaaagcagaatccattctctgtggtatttttaaaattataccacatgatgttaaattataagcacacatcagttcaacctagcaaactttcattgaacaactatgacatacaccaaagagacaaagataaaaaagaccttgactgacccttcaaggagcttgcaatcctttttaagtggcaaacatttatgccactaataaggtgatataagcattttatacttttttttagatttagaaatattacagtaggagaaaaagcagatctttttacacacacaaagaaaacacttagaattgtactgataataagattagtgttatttggtccatagagatgccaaggtatgtcagttgtctcactgagaactagggaattcagccaaaaatggttcctgatcatgttctgccagagcaaatagtactgaagaaaatcaaacttgtcagaatagattttctgagatgtgatgagctagtgttagaatgtgaaccaactagtgcttgaatgttgaactatgcttccagccttatggagagttaaggctccccaagctgcccaaggggccttcgtgatacctgttttgttactataaataatagaggttacttagtgaatgccaaaagtgatctaaacattcattagtattaactgtatacctatgttgcaaatatcaccagaaaagatattggaaaggtaatcaccatcaattcttatattcctaaagctttcttccagtcctctttttctcctttcatgaaatagttttcagacgcagtttggaaaacaagtatagtaattgactggctcataaaagcaatggaaattaaattccagctgtattgtcattttcaaactcatgtttttggctacctcatacctctaaagcattaaaattggcatgtgtctattaatacattcatcaattctttcattcaactcaataaaattgagttcttaccatgagctaggccttgatgactcatagataaataagataatattctatcctccagttttgcttagaattcagtaaggaaagaatgacaataaagtgctgtagctgatatattgtattcaggttaagataggaaataaggctgtaatgattcattctccccctgtgggattgggatcacattcataaaagcaattgtactggggtatcaaaaagtttgtgaggttgaaacagaaggacacattgggcatatatagtagtttgataaaattgaagtaaccttaaagtacgtgtgaagggataggagacgtgagcagagctgaggctgagagacaaaaaaaggcctatgtggtaaattcagaatttagactttttaataaacaggagaaaactatgaaagaagaggatttttggacagaaattctaaaatgtgttttatgtatacattaaaaagaacaaacctggatgttagagggctaatttgagggtaatttcaatagtgcaggggatgagcaatggaagcctgaacccaaatgggcatctctgtgatagagaatcatagaggaatgacatttgagaggcaggacagacagagctgactatcagttggatgtgagacatgaataaaaaacatgatttgactcccaagtttctggtttggataagcagttgaataattatatcattgggaaataacaagagtatcacattatttgagttttccatgtcttctaagcatgtagatttttagatctggagctcaggagagagatttggagtcatatatgtataagacatagagtgtggcagtggatcaaatagtgtgggcaagaacatataaggtaagaaaagggcttgatgaaaacacagtactgtcagaagctaggaggagaaaggaagtcatggaagagaaggaacggaggaaaagtcaagtagggtgaggaaaggtaagagtggggaaactattagaggaaaaaaaagaggtggtcagcaagtttgattgtcatagaaaaagaaggaagagtaggactgaaaatgtttgctggattcagaacaaagaagtccatggtgtcagttgtcaatgattagatagtcaacgagagttaatttagttccaatggaaatgtgaggaataggaggtagttaaagggcaatagaccagagggtttaactatatttcctgtaacaaatttgaatatattcgaacgctataaaagaggagccaaataagtgaaaactgagcagctaggtctccatacctgaggaatcagcaaccggtggaatagtacaaaagcaaagtggaagaagtagtgttaaataggaggaagcaagtcaggaaatacagatataaattacctgcaggtgtgagggctagctcttgggagatttcatgcctcaaggctcactttctttctttttttttttttttttctgtgcaataagatctgggtccatttccaacttttctccctatagctcacatacttgaagtgtgccaagaacaccagatatggcaacatcccacagatgatgaatggtatgaaaatggcctgagggttctacatcattcatatattctctgatcactagagatttattctcctatgttctctagcaaaatgattacagaaccacagcaataatagtggtctgctcaattagccaaaacatgctactgaaaccctttatttgttccacagaaagaaatgatctaaaaaaatcttttctgagggagtaggttttcctcctaagctgcatgtcatttagctcttccaatttcttctagtatagggtttatttcaatgatttctctgcctaatgtgatgctgtaacactctgaatctcacatctttcctcagtcattgatgtgctgatcgttcagtctgccagatcattaacaatgatttttttttaaagaacagttaacaccaattcttgcagtaatgcctaccctttaatctcccactgctcctaaaaaggaatcatccatctttatatgtcttttcatctatcattggtatttgtgctttgttctttgacagtttcagtcaatctgattaggttttatgcacagcaactcaatagcacaggataattatgatacagtgaggactacttttttttctgtttacttctatatgcccaacattctgttctgtaggcaatctgacaattggagaattttaatgcaaaaataatctctttaaaaaaactttcaaaaatttcaacctctattttagattcagggggtacatggacaggtttgttacattgatacactgtgtgatgctgaggtttggggacacaaatgatcccatcacccaggtagtaaacatagtaccaaataggtagtttttcagcccttccctcctccctctttccccccaactagtcgccagtgtctattgttcccatttttatgttcacatgtaccccatggctagctctcacttataagtgagaacatgtaatattaaagaaaaaatatggctgcaacatagtaggcaaaattcattttcaaggagatcagaaatccaattgattatagcctaatccaaataatttattatttaacaatttaacgagggggaaggggatatttccaaaacgtttaaagtttatttctcataggattttaaaattacctggcactataatatggaaatagagagtagcattaacttgtcaaaaattaataaaaacttgcttttaagaagaggacaaagggagtcaaaatggattgtctaaaatttaaatgcaatgttagaaagatcacttttgatgctatctggaaagtttcccagattccccattgagctaatctctgtgagtgctcattataagaagtgatagctatccctctgtctcagagacaggatttgtcttattctgattgacacagctcatgttatattaagtttgtgaaatgaatacaaaagctaagataacttttgtttttaatgacttgcacctttttttaaaagaactcttagggatgttataaggataaagtaacataatagatattttgctcagcaaaaagcatgattcagcctagcacagtggaaagatcatggtctttggagccaagaaaaaactgaatccaaatctaagtaacctcagctctgccactttctagctttatgacctcagataagtttcttaccttcttagcgcctctatttccccctgggaaaaacggggataaccagaagctgtgaaaagtaaataagatttgatatttaaaaccttgcctaatgctgaccacatctaggagacgctcaataaatgttaatccccccaggttcccaatagcatagcttttgaacaagtttatagatgccaaatatgaaagaaataaatacatattaaagactaccagatacgtgatgctacctagttaatgcttacatacagtaaatgctgaagcatacaacaaaatacaaaatgttttgtatttctttcccagacttgtagtggtattcttagttcttgagattactctaccaacatttattaaatacctgttttgtgacagtagagtataaacacagataagaaaccatctttgttcccaaggagtccatgatatactttaaagaaccacaggagattgaaattggcagaaaccctggaggtcaccaaatacctccattttttaaaaaaaatttattcattttatttttgttggtttttttgttgttgttgtttgttgttgttgttgttgttttacaaacccttgtgttgcgagggctgactttcaatagatcgcggcgagggaactgttctgctacgtaggaaaccccgacccagaagcagatagtctacgaatggtttagcgccaggttccccacgaacttccattgcgtgacgggcaagggggcagctgcctttgcggccagaccccgtttcccaggactaggggcactccgcactggaccctagtcctggcgcgggatggggcggcccccaggcggggatagcgggggaccgacatccgagaccagccaaggcccccctctgttttttttaaagaggagaaaccgaactggagaaagtttcaatgaattactctataccacattgctagttagtggcagctccagtgaagccttcctgactcctaacacagtgacttttcctttaacctggtcccccaaataataagctgtaaaaagatttactggaagaaaaatgcacaagaacttctcgagtaggtcagatttctttttttctctcttaagtataaccacatcatgtttgatccattgaatttctgtaatggtagtgtatcattacataaaataaaagtgaaaaagaaatacaacaaatttcagactgccttatgaaatacaatagctaagcttaaatattcacagggctaatcccagaaaaggcagtctggactcggttatccacataactacctctattatccatttcatattagaatgtagaattataacatagttaatggggtttcaatttaaagaccccgtgtcatcttattagcctatcatctgccctattttctccttaatttaccttatgtttatacaattcttatctcagggccacgttgctaccataaatcaaatatgccaggtttcaagtttcagcatatgagcacagatgtgagcgaacagcttttgatcactcagttatctctaccagagtaactgaaacagggattctcaacacatagaacttctaatccaggctgacctcaattaactgcaagctaatagacattgccacgatatcttcctagaagaacaaggggattcctggaaagaaaaggaatctatccgtctttcatcccactggtcaatacctttttctcagaatcaattattgacattttataatctatgatcttcaccaccgtaataagacttcaggaaaaaaaaatgtaatttcagcagaaaagattggaagcatggtactagggatactatacattggcacaggagaagataaatgtattgactcagcattttgttaccattatccttctctctaaaatctagttctgaataaataaaagcagggactcagagcctggcaggatatcttgccctgaatgcatggcccataatcgaagctttcaacaggactttttgggtgagtagataggaattaagggtccaaagaaaatttgggcactgccttccttttacattgatgacttaaagaagaagaggtacattagtaggtaaagaagaaataattaccaatttagaaagagggtacagagggtagaaaagaaatagtctaatgtttgcaatatgtttggaacatatattcagggtccaggagcactgcctgtatctgattccttgcttctgcttatccagagatgagtttagacagaggacaatgaagacagtactcagacagtacacttatcttctcccatcccaatatatagaatctctagtacaatgcttcaatccttcctgctgaaattgttttaacattttttctggagccttatgggagtggtggagtctctagatgtgtaaaatgccaataaagaatgcttactgggaaaggtattgactagtgagattaaagacaaatatgctcctcttctttccagaaattccctgtgcccctaggaggagactgtgtctgttaaataatgttaactccagaaggaaagatcaaaaacaagagagaacaatgaaaggatagtgctaagtgtgaaagaaaaacattaaggaaaggagtcggagggaaagtaagagtgttactgcattatatttaaaccagcctgtcacaaggagaaaagaggcagaaacatgtgtgcttcttgtctgaccacttatctaccaaatccagttcttctacctttaccttcatcgtttcaggctctcgtataggcaataaatggtgtcaaagattcagcaagttgctactatatatttatgaaataaattcacatatatttatgaaataaatacccatcagctttcacatactaaaataattagtgtaaaagctattacattaaattaaattaaattaagatttcattttctagcattaacaggtggctttccccttattccttattccatggtaacatacccttctaaaaataaaagtttcaaccagttttcctgctcttagttcaatgtcatcctaaaaacaaaaaaacaaaacaaaagtggccctaacacctactgggtgttaaaagataatcttggattagcagataagctttctgaagtgggaaagtgagattgagcaaggggaatattaaattgtcaagaacagtaccatgtgttctttctaagaatgaaaaacttagaaatttgctatcagaagtgaccacctctctaaatagtctagaacaaaaaataaaataatttattttgtaaaaagaaacatcttcccttcacggtcttcctccctttcctacctctgttcatcccctgccatgttcatgaggtacaaacaaaaataacagtaggattaacctggaagaccctactcatgaaaaatcatttatataaacgaggaagaaaattctgcccactttctagcatatcaaggaatattgttaaacgtatttaaaagccagtctgtgattttgcatggctttattaataatgttcttgagaaaacaaagccagtacatagataaattccttacatgatgatcaacaccaaggaaacctcttactgttctcagacctaacataaagaatgatgattttcattcactgtcaggtacaaaagcaataatatatgcaaaataggaatacaggaaatattgcacagctcactaatatactgcaagttactaatgggaaaaatatcaaaataccttaaggactattatatacattatcacaacactcaaagaatgaaaatcacttattcctttgaaaattgggatactttttattttgagagctgcagaaaaccctatgacgcactacatagctctcacagtaaatttccaggatcaaagttcaaaaacaggtacatgataaaatgagcaaagtgaggtagacaacagaaaatgccaaaatgacaataactgaaaatattaatttccaagtattatatctcataacataatagtaacatgatgtctcaccgttcccagctcatcacatgttctaaagctgttctcctcctttttataaaactttattatcctgctgaagtttcactcatacaactagtcattccttaattttatacttagttattccttagttattcttagttattccttaattttattttcttttaacatagttattttatagcaaaaatttatgatgataactggttttttttttttttgtactcttcttatcttaaaaacaccagttagaaaaaaatgacatttataacttgtggtctatggaacaagatcagtaattattccatgcaggataatgttagtatactaagtgagacagcatcatttagaggaaaagaggacaagaaaagatgatgatggtagaaacaggaggcagggtcagttatttccatattgatcatgtagaccgtgcctgataaggtaagaggtctattattaatcaaccaattcaaccaatgatgaaggctcaacagaaccccaatgtcagggaaaaagcattaaatttcaaatcccattatccaataagcagttatttatgaactacatacaaaatgtaaactgaatttctaagccacatacaactatcagtataattattctataatctaaatatatccttgactctaagaatatacatatttcctactacaaaaatttactcacccagtttactgataattaattccaccaaggttgagatgataaaacttcaagggtttatttcacaaggttgctttgtgtttaacttgaacaaaaaagggaaaataaacaacaaaactaaaacaaccattgaaccaacacacctgaattttcaggggtagaattttaggaagaaaacagtccctgacaagtacaaattctctacatagaaaactgcctattcggcctcagtctatacacaaaaattactactgcacagattctgtgtagtagcacaaatagaacaaaggtcaaagattaaatgtaggtatgtgcatgtgttttatatatattacaaatatagtaatatatacacacacattttgtattagcctatgttattctaagcattagtcttagcatatgctgtgtttcacatttagaaatccctaaatgtgttcagaactgagggatgtattattcataacttatctttaaatgtattatttaatgcagtatccatttgtaagttagtagatgctgatctcaccaattcattgactgtggctaggcatgcacaaatttcacataaagatataaagctaatatacatttccttcctctgatttccattgcccggatttcttgcactaaacttttctgctgtgttgcacatagtgcatgcagaatgcatgtagaacatgccctgaagaatctgcaatgcagataagaggaaagcattattcccaatttgcatatcacaccacacacagtaactgatttgtcaaatatcaaacaatttacatattctaggcctcctgctctccctttcttgagcgttcggtctactttttctttttgcaactgaattttatagagaggaaaatatatctttagctaaggtgatgtaatttgaaaatataagtattagatttctccaaatgacttaagaatattagaaaagaaaaaaaaagtacccattcagcttagattgcagaacagacagggagcttaaacagcaggctctgactgaaaattaaatttaagcttccagttactgcagcaaaacctaagaccaccttccctctgtagctcgagtgggagacattgttctgctgtctctctaggctctttggtacgctgaggctgatgtgattgcccagactcgtgtcctgcatggaatttaaactacttttgtaacagcaaaaggaatttactgacttcctctcagattgaaagcagaaatgaccactcgcatcaaattatttacttcgatttgtagcttatttaaaatgaggtaggttgtgattgatgttgatttttattcaatggctcatctattctgatatttcagtttcttaaaatatttatgcaaagttttgtttggattacttacatacgtagcacaaatgattctttatttgccatggtgacagcacaaatcacattatttgcagaggttggggagtcccacaaatcagcccccacaacaacaaatatttatttattgaactcttggaacagttacaaagaaatataagagacagtttctgttttcaagaaccttacaatatgggaagataaaatatttacagatacaaattaaccaataaaataaagacagagatacaagcaatgccacaaagccaaaatcatagtggagattctgccctggcaggaatgagatctcattacctgggtgaattattattcctctagttctcagtctgtctctgaaaaatgaagacgtgaactaaattttctcccaattcaacagccttaaaatttaatatgaattctcttacacctaaccttaaatgtcttcacaattgtactctatgtcttatctatggaaagggaagttagtagccaccaaaagatatttcaattgatctattttcccttggacattttaacagctaataagccaagaaatgctatctaatttccttacacatcttttttcttttttcttttttctttttttttttttggtgacggagtctcaccctgtcaccgaggctggagtgcagtggtgcaatctcggctcactgcaacctccgccttccaggttcaagcgattctcctgcctcaatcaggagatggtctcgatcttttgacctcatgacctgagatggtcttgatcttttgacctcatgatctgtccacctcagcctcccaaagtgtagggattacaggcgtgagccactgcactcggcccacacatctttatacaagaggagtgaagttatacacattgtagtctatcctacaattttttttttttttgagatggagtctcactctctctcccaggctggagtgcagtggcaccatctcggctcactgcaacctctgcctcaggggttcaagtgattctcctgcctcagccacccaaatagctgggactacaggcatgccccactacagccagctaatttttgtagttttagtagagatgcagtttcaccatgttggccaggctggtctcaaactcctgacctcaggtgacccgcccacctcagcctcccaaagtgctgggattacaggcgtgagccaccacgcctggcctaacctacaaatttttaaatgggattttgtttggaggggtcgttgagagtctatttttcagataaagaaaccaccttacctagttacaagcattgagttttctttccctgctaggtcctctaccttatctgtggtaccagccaaaaagtcaattatttttaactccgagaaaattctgactgcaaagcactgcctcttcctactcagtacagatgatcaaggtgggataacacagaagaatcttcacacccactcatcactctctctctctctctctctctctctctctctctctctctcattaaaagcactaagcggccaatgccttactgtctattccatgggcttcactaggctgtcccttcttaggcctagaacgaaatgggcttcacaaatagaaattattctaatccaaataatatttccccaagtctcacagtgcaaaacaccacagcagagagcacatggtgatcaagaaagacagcattatcataaacatttgtatttcttatgctaacagatcccattcttccagtctgtggcattgtcccaaactgccccatcaaaggttctaaaatatgcttagggcatctctattaagaggatgaggagaaaggaggagggggaagatgctaacaactaaatggtaagtttttacataatggtacatcctgccagccaacaagttttactacaaaaacaaacaaacaaagaaacaaacaaagtttacaaatcctttctcttttttttaagttttattgattctgctgaatgaaaacaaaaaacaaaaaataaatgtttatattagtcctaaatgtaagtttcgtaaattctaaatgtaatacagctgaagcaataatagtactcatttggctcacctaaagtgccaaaccatttacctcaaagtatgttcattgtacttacactgactatgtgtttcagttgtaaagaaaaataacattaaagagcaggtatagaaatttagtctataacacatacaaaagctagagctataccatcccctaaaacatgaagaactttgtaatactgctttgtaatggtaatataattactttatcatagtattctgttttctgggaaccaatcatcttttagaatattaaggtttggtcaaccttcacacaattaactttagtacaagcatgagaaaataaggctacctacacactaggatgcagtgttttccaaatacgctaatcttagaacactatacaaatacaaatacaaatttgcaggacattactggaaaaatctgattccattgatctgaggtgagatagaagaagttggaatttttttaagagtatctctagtaattcttattttctggcagacttgaagaacatttttataatgtactcaaaaccaaatactaagaattttagattatatttgccaggctgcccatcagtcagtatctatatgcatatcatttgaagaagcttgaaatagagttagcattaaaaatagttcctccattatctatcacacaaacagcataaattcttttgttttcatctgaagcactttttgctctttgaggatccttttctaaactgtaaatttcctggaaatgctaccagtcaatatctttgaggaactaaataatagtccttgaagagcaaaaacaaatgaaaaaataaatggtggtaagcaatggagaaaaggagtatgaaacgaattctgctaaaggaattgcaagatggaattgactcattttcccattgagattaatcttttgaagccaaaacaaaatccgaggaccacagatgtaaatgagcatgacttgtatatctatgacttgtgctagaaagggctatattgtcatgattacctcccaaatggtcaatgagactctggctaaccttccctaatgaccttatgtcatccatatatcttaggaaaagtaactccctcccctacacgatatctctaaaagagcccactgaccagtttccttaattctgtccatctttgcagattacagacacttagtatttaccgtttcaaaagtaagcagcttagtatccatcgctcctttataattccacatattcacgtaagaaggcaatgataattcaggaggtacttcaagatcagtcagtgcctcctggttattaaaaaaaaaactttataaataaaaaggctgtaccccaataatataaatttgtcaacaatgtggagatataaaaatttaccccagaacatcaggaagaaacatgtagaataaaagtactgaaatgtaacaaaagcagagatgtgacctataggttcctttaagggtaagcttttgtgtcacacaaagctaagtgaccaatgaggacagcaggatcacaccattgatccaccaagtcaatctgagcttcttcaatctctggcctaatgcttcattatagcatgaagttcccccaaaatacactaatatgggttcaacaatggcgactttttaaagtaaatgcttggctattaatgccttattggttccctaatagaaaagggcaatgctcatatgattcctttcttaccactcttccttccaggttcaatatgatgcagtatttccaatggcgggagacagaaacaatgtcacaaagtgggagaggcactaagaatgagatctggcaccacttactcttgtttctatacaatcgaagtacaacacttctcaattttctaggcgtctttggggagagatcttatctctcttaatggtaccaactcagtaacccaaactgttcaccaatacttcttttaagtagttgtgaggtagggagtccaacacttcccaagagatcctgttagtacattatagcaactacagggaatgttttacaaatgactgtcattataatgttaaatctaacatatatgccaacccccttagtttatacaataactttcctccaaaaatcttaattaaaaataaaatatagctgacttcgttataaagagactcattaaccaggacattgcagtttttattttatcaaatagaaatagtgaaaatgaaagatgacatattttagagtcagcacatcctgggtccaaattccacctctcctgcttcctacctacgcatctttgagacagctgcataggctctttgcatctcaactttccacataaaatgtggcaccccacatggaacataagtttgttttttatcccttccataggtgtcaccattagtacaagtattaaaacttctcataatttcccattgagttttcatattattggaacaaactcattaagcaaagattttatgaggctagagtaaaaagagagcagtcaaactatagacacagaaagcagtcatggacagagattcacaacagaactttacacagttcctgtccaaagggataattaacaaagcaaataggtaggtgttgttttaaccaaacagactaagataatgaaaaaggaaaactgcagctctggaaaggagacaatgccatttgcaggctagaaagttatggaaaattttctaagcaataaaaacttaacatgacccaaaatataatcaacacaatattttgaaggcagacaatgcttcagaaaagatgaataggatatcacttaccatgggctttgttctttgtaagaatttcctggtatttttgtgggagtaaggcttgggaatttcagacctcagagctaacagtgggcagaggatgaaagatgtacctcaaaggttcttaaaagccataaggatatcaggggtgtcttaaatttccccaacaacctccatatccctaatgataagttgccactgtaaatggctgttgtgtaatccatcatgaatatagatttagttattgactgggaattctggtcaaggaggaatattttcaggttttatttacactgatgataatgtgtttcctcatgagcataatactgtactcttgcctcacctcttatgttcttttgccacatgtaatatatgtatattatattgttgaggtggagatgaagaatgcttgtaaagtattggaaagaacaatgtcacgtttttatgtcctctgagaaaataaaagggtagtctacctacagcctgaaatacatactgtcgcccattcatggaatttatatcacataagagttgattaactgagctttaataaaatatggttggtatacaagttctaattcaagaactggagtgcctgtggacccactaggatgtgtttaaggaaaatatgtttgggaattcctttggtttgggtgaggcaatatttctctggcttgcagttacttctatgcataattggtcattgttagtcttcccaatgtaggactggattacaggaatgctcgtactacccatttttgcatctaattttatgttcacaattttgcattatttttcttcatgagggtctctcaaattgtataagcttcaggcttgtgaaaccaagatccactcctgatctgtatctgtaaacactgtacttcttaagcatcaaaggacaggtttgaataccatcaaaggacactcacaaactttctaaaatatccacattcctaaggataacaataagggcattccaaattaagtggcgacagaaaaataaacacaaacccaacagtcctccacccacaaaattacattatacagtaactttcaatcactatgatctcaagagctataattaaaatagcaagttcaagtactttatatgacaactatgatatgaataaatctgctagagcaggatgaaacaaaagacaaagtgtgtcatttacttgtataacctgcatcacctcaggaaggtgcatatgaggttacatcaatatcaagtgagagagcaaggattatgtggtggcctgagtgaatctgctcatgctcctgggtgcaaaagagtgggaactgactgagactgattatctttattccttcttgacagcttaattaagttctctaattagtcacagtcattaagcactacatcagcaattctgcctcctcttggattggcttcttctctagtctaattggttagaaaagttagctgatctaaaacattgtctttcaattttgggaaatcttctttttcacttttattgagatataattgacaaatagaaagagtttatattcaaggcatacaatgtgatgttttgatatacatataaattgtgaaatgattgccacaatcaattaatatatctattatgtcacatactgtgtgtgtgtgctgagaatacttaggttccactttcttagcatatgtcaagtatactctaagttattattaactatagtcaccatgctgtgcatggtcttcagagcttattcataactactagtttgtaccccttgaccaacatctctccatttctctcactctgggacccctgctacctacccttctactctctgcttctgtgtattcaatttcttagattgcacatataagtgggaccatgcagtagttctctttctgtgtctggcttatttcacttagtataatgtcttctaggtttatccatgttgtctcaaatgacaggatatacttcttttttaagactgagaatactgacccagcaacacgaggttggtttacttcaagaagcaccctcaggaaagttgtaagtttgctgaactgggtcctcagccctgtcctgatcaccattttaccaccaccaccacgatgagcttcttcttcactctctctcccactctcactattctctcagctattcatcctttcacactgtctcagtctcttttgccatcccttgaggaaaacaccaccaaagattgaagccaaaatatgagagttcatactctaccccacaaatcagttcttacaaagaagacttcaaagaaggtaatgctctcaaggatatcactttgcagaagtgatttcctataattccagaatgataggcaatcagcaggaaagataagtgattgcgcaaagttccccacatcatagacacacctagaaaagtacagtgtccccaagacctgtcatgtctttcaactaatcttttcttgcatgctggtgtctcttcactattatatccaatgcagtaatatatttaatacctcgaattacagttcctataatcttaggaaattattttgtgatcacatttctaatcacagcatctcatgaaacacccccaaccactacactgcaacaacttacaaaagtattctgggattatgcagataccatatttggtcttagtctatcacatcattcttactagagaactttgttctaggcttttgtcagataacatattgttttatgtattacattggtttcaagagaaattttataattcttattcttttttaaagtccaccacaggtacaatttctggctgtaaatcactactttaaaacaacagcagtaaattagcagtaaacaacatttgaagtaaattacagcattttgaaagaaatatctttggccctttctccactatattcagaactgagtgactggcccatgaactatatccctcctcacaaggtatcattcacatcctccattgccctgcaaggccccttttttttctgtgcgcagaagcccagagagcactttctacaagtttagggaacatgctgatgtagaaacatgaaggataaccacagtatacaagtagtgcaagctatttctctttttgcaagggttacctgttgtgtatctaaggaatcgtgactagacttgtaatgtctgcatcacagagcatctacaaaccagaaaatctgagttctaggctgttttctaatgattcttagacacatatcaatttctaagatcataaaatgaagatacttagtatgactacacctgcctatcttctaggcaggcgtcaaggacattgtaagccataaatcaccaaaaaaaggcaagaaattatttttatcatgactaaaaattttgttttccctcctttagtctttaaattctgctaatgcagccttctaagaaggacatttctcacaaaggattgataaatatctgcacacacaaatgagtccacttagtcttgagaatctaatcctttagtcataattatcttggtctccatgcagtctaatttcagagttctagtaacaaggtaacataacatccactttctaaatgccctcaagttggtcacattataagattaatgagccagatcaccattttccaaaaataaatacatagaaccttgatttgaattagctaaatgaattgacatcatgttagtgatgtcaaaaatggtagagacttctatttcagcagagaaaaagcaaaataatattttaagaccaatgaggtttaagaaaatgaggagtaaataaagaattgaaaacaattaattgcaaaaattggaggggtatttgggcacagacagattgtaagagacactcgatggcaagaatgaatttaggtcgaaggtaatatgaaatttagccatagaaaatttttaataaggatgatatgtcgtcaaagtatatttggtgccatttggaaaatgactgagtcttaaaggatttttaaatgatttcctttttttaaagttgtcatagtcagtttgttctgatcttgagaaagtaaatctgtcttctgatggtcaagtgatggtttccctgaacatccaaacttggtcttcatgaataaggaatcagaatggagaaaaatctgaaaatgcataatgaacttttcagtttagctatgttaatctgtctcaaaattaggagtccatgacttttatttatactaatgtatatttgcatatataatagcatgtatgtctttattttgctattaagtcattttgcaatgaagatatgtaaatattttaggtgccatagggacaccaaaaaatagaagacactgtttctgtttctaagattctacaaatatgttgagggagataaaattagcactaataagaatggcttttttaggtgaggcacgatgataaaaatgtcttttttaggccagacacaatgactcacacctgtaatcccagcactttgggatgccagggcgggtggatcacttgagcctaggatttcgagaccagcctgggcaacatggcgaaaccccatctccacaaaaaaatacataaaattagctgggtgtgatgacatgcgcctgtagtctcagctacttgggaggctgagatgggaggattaattgggcctgggaggtagaggctgcagtgagccgagattgtgccactatactccagcctggtgacagagaccttgtctcaaagaaaagtctttttaaaaaaattctgtaaatgtatacaattaattgccaagtgactaaacagaagacaagcgtatatgaaagtatgttctagtattgaagcactttcatgaaattttaatttatactcaagtacataaaagtaaatgtttccaattgtggcagaaatagccatgctcatcaaatattccagttagttttctaaatatcccagtaactttgcagttaggcagcaccagataacacattctagttcatgggcactagtggaaaggatttgtgtcacttctgggttaaggtagcaaaaatctcatgtgctgttggcagtttctctttctttaccatgggttcctgtctctctctctctctcttcttctaccatggccagtgaggagtctaggcatcattccagatgatgtagctagaaaactgtggtgcctctgtcagcctaggttcctgagtgactatggtccttaaaactaggtgtgtctcccagtacaaatggttgtgtacatatatgacatgaaaaagaaatacatttttgttttaagctatgactttaactagtttttttaaattgtttttgacagtgcagcatagactagcctatcttgactggtagaacaaactaaagctgtgtgaatgaagaaaaaggcatccagaagtgacctgtcaaaataacctcaaagagtcatgggaaccttccttagtgactcaatgaaattttattttaatacacttgaaataaaaattcattaattctattcaatcaataaaaaaaactaaggctaaaaattaacggtttggggaatagcagaatagtgaaaaataacagagctttgagagagttatcaccttgcttcctctatgatacctggcatattaataactaccaagactcagagaagctgaactgaatgaaagcattttacctttattctccccaactattagcttattgtccttcctttgcctccctaagaagttacatcaggtgcatattgctacaccaatatgtgaactacatgatgacagcactatttacaaaatagaaacgtttggttcatcagcaaagtaatttttagatgtggtatcagagttcctttattgttaactccccctgtcctgggtttttatttttctctctcctgcttctctccataccatttggctcttcttatctctgttctgcatctttagctggagtggaggctgcacttcccttgtcccttaacaggcatatcaaaaaatgaatataagggccaataggaaggctacctgtgaattgtagcaatgttttagcagaagagaaaggatgttccacagaagtgattccttttacctgtcctcacatctggtcaacataaaagggatgatgaaagagaaacgatatttcagcagttgtgtgcatattctaatatgtatctttgtttctaaatagttgatgcattctagcttaatccttaataagaaaggacagcttcattacaaaacaaattcctcattggcagataagcagatgagagggagaatatttaacattactgataaagaatcaagttatgttctagattcatgcagagttttatagaattggtgcaaagtattagaaaatttataagaaagcttatttactgtaaaaaaaatcaatcttaggaaatagccacccacacatttttcaacctacttccccaaaaccatagtataacccttagaaagaacattgaagaacagataggaaggggaggtaataatatctttaagaactcactaatatgaaccactttatatatatatacattatctcttaggatcatataacaaagtttgaggcaggtggatgatatttgtatccccattttatagataagaacgttaaaacccacagagagtaaattgtttaaagtcactcaagtactaaaccttactcagtgtgatcaaaagcccatattctttattgtaacttatagcatataagctcctataaggaaaatcacttactaaaaatgtcttctcttctgtacatgccagcagtgctattcctcaaagcaataatctgcatagttttaaaattagtggtgctaaatgtcagcgatgactcatgctttagcattatctcttaagtatgcaggtgataaactttaaaaattaagtacattcattgtatttcaatatttctctagccattctttttggttgaaagtgtgtgtgtgtctgtgtgtctgcgtgtagatatggggcattaaggcaggcaaacttagaacacaaaatataaaaattgggtggggaaacatctggatgacctcaatatttacctaacattcttctttgcaaatgttctgaattgtctcatcaattctgcatcatctctgcccccttatacacttttccctgcattgcctggaagctacactcccagaatttcttaccagcatggttccaaatttgattctgctaatgaggtacacttgcaaaagatttggaaggcagatgagaaagaaaaattaattttcctccaacaacagctggaaggcaggtgtcagacctgaagtttgtgtgggcttctgaaaatcaccaacttcagtgcccaggtagccaagatcagcagcaatttcctgcagtttttttagctctctcatatgctgagagttaatcgttttgtttttttttctgatcgttgtcttttaggctttccagtgctatgtaagcacctaatttcctaaagttaattacttctgacttgaaatattaagtgtgatttctattttcctaaccaaaccctgaccgatgcagtatgtccaataagaactcattatcagactaccaggaaaacatattttaacacaggcttacaagaaaaacagttaccaagtatggatgctcaagacagccttaaagcaatgcctagtaagaagtgctttataataactctgatgcaagatcacatgtccaatttttaaaagatgtattagttcacatttgttgcattaaatgattttggggaacaacatagcctgagataggacaaaactgagaatcaaactagataaagctgaatgtgataaaaatatatgcctttaaaaagttaggggtctcaatcaggagttaaattcattaaagaaaaggttatgagtactccaagttccaacagtgaggcagggtcaagagttcactccagctggcacgaacaggcaggtaatagaggacctaccaggtttaaatggggaggttatcactgtcagatatgaagtggctccaatgaaaggttgggaccagtgaatatctgccttagttttagataatgcatatgacatggctttacccactgaccagtgctctttcgagaataaatacttagacacctaatacgtatgaagtcacacagataattggcatgagccaaatgagggttacttgtactctatataaactcttacatactctcttatcagtagaaatttctattgagaggtggcttggagaagatctctaagttgctgaatcccacaaagactttaaaaaggtagaaaattctaaaaggatgatgctagcaatcaatcaaatactctggcctcctctagaaggaaactgatttgatatgtttatgggtgcatttaccttctgcacacacactcgtcagctaatcaacacaacaaaagtaacacagtcagttggatggaattttagagtcatctccctctatgcacgtgtgctttggcaaaatcaggtacaatatacctgacgcttcagcttttcacttaatagtgcacttatttctagttagcccttgagtcatcttcccagatgtgttagcctatcaacttgtttttttcatgaatatgataactacttatctttcatcttacatcattagaacatttgaattgttaaaattccacatatttcaatatgatggtgtcctgtaatctctgaagtcttgggttactgagtctgctgtgtgtctgaagctacactatgtattagcattcttgttaggtttaatttcattttctacaatgatccatcccttgaagctccacaaaaaatatgcagagcatatttattgctagtactagtgtaaccgaaattaccaaaatctatagaattttcataaatttatgtattttagaataaattattataaaaagaattaaaggatgtttaagttcacaataaattttacatcatctatagacactgaattattagtcagcaagctttctctataacatttataattagaaccaaataattttgactcttccccttagtcatcatttgtgttttaatttctgtccatgtcaataaggttattcacagaaggcaaagaaaaaatattttttaagggtttgttttgctaagttacatggggagtcagaaattcagttaagatgaactgtgtgaggtattaattgaaatttaagtgtataatattcttgagttaggtatggaagatgacagtaatttcaatctcacttttacttcacatacattagatgtggtaacttcttttcagtcagagggacagatgaattctctaggaaatttatatgtaagtatttgcaggtacctttaagctagttctgaggagaaaaaagttatatgaggcaagaagaactttcaataaagaaaatgcatgtaactgcccagaccctccttggagttataaaagagccatataatttccacagcttccatataccaccaacacttatggtcctacatagcaagtcccataaagcctcagtagacatgtgacatcccgaaaacagagcaatgcccatgatcctatgacatgaggtaagaaattcaaggcaccatggttccctctgacacctgataaactgtatgtatttattttttcctagaaaaaaagggtatttgacacatatcgggagacacagtttcaaatcccacgttgaccatacacatgctgtatggccttgggcaactcctttgagtctctgtttcatcatttaaaaaccaaggttaataattcctatcttcacagagttgtgataacaataaaaatatattatgaaaatgaggaggctttataattaataaaggtataagggcattgattattttctcaaccctttacataaattagtagattattctaatcttgtgacagagaaaataaaataaatattgaaaagtattatgacagaaactagctagcttcccaccacatctgttccatcttcttcctgggcccacaggaagtataagcttcccactctcctttacagttagaaatggcaatatgactgcattctaacatgaaggaagtggtgggatatttccagtcttagccaataaaattctccagtgcctggtcctccatgccctttccccaagcatgagccacgggaagagaactccaaggtcctagataaaaaactaagccacacgataaaggaggcatatatgtgaatgaccaaatggaaagcctcttactgaccaggaacaccagttttgaatttcacatgtgcaagttatgctaaaccagtgagattttggggtttgtctttgacataattcagtaggacctcaactaaaagagggatatagacaagttaagtgtgaaaaggaaataccaccctcaatcaggctgccattcaaaaaaaaaaaatatgccaccaagtatacagatgtcaactatgattgtcatattttgacaaaatattattagaaataataattgctcattttagagaactgatgatctatgaggttatttagggtctgtgtgaaacttttagttctctcaatcatctggggatcatgagggagctgagatgagatctaactttctcaataccatcaccagtgctcgtttccctatagcacactgctgtgcccactgaagtcactggctttttttttttttttttgagacagtcttgctccatcgcccaggctagagtgcagtggcaccatctcagctcactgcaacctccgcctcccgggttcaagagattctcctgcctcagcctcccaagtaactgggactacaggtgtgcgccaccacatcaagctaatttttgtaattttagtagagacagggttgcaccatgttggccaggatgatctcgatctcttgacctcgtgatccgcctgccttggcctcccaaagtgctagaattgtaggtgtgaaccaccgcacctggccaagtcccttgctttttaagatacagttagtcatgcagttcttgacaaaaaaaaaaaaaaaaggtacatacacaccaaccattacagaagccaaaatatcaagtctagactgacaacctctgcagctacactgaaaccccacatcactaaataataaaaaatcctaatgtgactttctcatcttgaataattgttaaacaaatattatccctcttcctttctgccttctactctttatattcttcattttggaaagttttgtttatgaactaaaatattcgatattatatttagtacttagacacatctcttctagcttaccatctagcagaaggaaatgtaaatagtgatgttatattaaaaatctgcctttaatttaattttaaaatgaagggtaatggtaaattaatatggaagtttggacatgagcaatatttatttggctgaataacaaaccctctttaaagtgaatcctgtctcttaatttaacagagtgaaatttatgtttttataggcaattatgtgtcaattcagagaatctcagatttaaaagtggcaaccacttctgaatgaaaatgctttgagtatatttgtgtgatctggatatatttttcccagaaagtcattatgtattcataaatgtgaataaaaaccacatatgacataagcatgtcatataataaatcttagcaaactatatggagaaatataccacagaagtgaaacaatttttaagtatgtgtgtatatttatatatttgtctgttcgtattagaatcattttatgacaaatggaataattcagtaaccactttaatactgcatgtttaatatttattgagcaataaaccatatactaagcaaaaagttactaaccctcccccaccaaaaatgatttgctcgtattcactttttcccttatctaatgctgcaaagataattactttgtccctataataacatttccacaattcatttcaggaccagtgattagtccacaaagtttggcaggtttcagatcagaaatatgtgcataaaaatgctgactatttgaaagataagtaaataaattaagataataatttagactcatgttccccaagcttatctaataaaaagaatctcctagctttttccttagagtacatcctaggtaacagctaagagtcagtattattaacaagctcttaggtgattcaaaataagaaactggaaaacatagattcagactaagctcaattatcctattcattcatttatgcagtcattcattcattattttattcattcaatctgggcacactatgtgctggatacaacaggataaataagacatactctcagtctcatgaataaatgcaatgaaatatgacaaacgcttggctgaaagtatgtacagggtccattggcaacacaaaggaaggaggtgtcaattcaatctggcaggttgggtaaaggtttgtcctggcttcacagggaaacccacatttaaaccaagtgtcaaattagtaggtaatcaatcaccaagtgaagaattaaagaacatcctagtaagagaaataaatgccgggttcattgtgcagaatgtatcagctgagtatcaaattagaagacaaatctttttggaaactatttagagaaataatgagagctaaactaagctgagtcagtggaaaatagaagagaaggggggaaggatatataatattagaaaagaaggtggattggacctgggaagtgactggatgtggaaagaggaaagggagggattggagagtccaaaatagctccaaggctgcataaaacacatatagatggtgacactattttcaggtaaagggaataataaaagatgataaggtttgggggaaaggtaggaattcagtcttgcatgtgttacgttgggggacattcgatggatctgtctgttaagtagttgaatacgtaagactagaaccctggagagttctgagtttagagacacagatttgaaacttaacaacaggtgaatagtgagtgaggtcttaaagtggttaaaatcacacaaagaattttatagtgtgagaagcaggtcaagaacagaactttggacagttcttatattttagtaattatcagagaaaaaaagacaagaagaaaatgagagtgacatcagaaaagctgaggggagagagttttaataaaatgagttatcaacagcaaatgacccaaatatgttagaaaaagactaaaataatccatcagatttgttcctagagtggtcagtgattaagaagtggtatgagtttggaccaggcattgtggcttacgcctgtaatcccagcactttgggaggctgaggcaggaagatcacctgaggtcaggagttcaagaccagcctggccaacatggtgaaaccctgtctctactaaaaatacagaaattagctgggcctggtggcaggtacctgtaatcccagctactcaggaggctgaggcaggagaatcacttgaacttgggaggtacaggttgcagctcagatcaccactgaactccactctgggcaacagagcaagacaggaaaaaaaatatatatatgtaaaaatatatatgaaagaaacagaaaaagaaaaagaagaagacaaaagaagtggcatgagtttaagaggaaatgggaggtaaactggcaacagtgaaagtaggctatagtctcaaacttgattagtaaagaaaaaagaaaaatatgcagatgaatgatcaaagtatacccttttttaaaaaaattagagaatctcagaattaaaaagagtttggataatcatctagtgcatttcttttaccccaatgcagaaatgccttccaaagtctcccttacatgtaatcatccaacttctttatttgaatatttccaagaataggaagcttattaactcaaaaaacgctcattgtaattaacttgtttttgaagtataagattttatatatattatatgtatacatatcatgatggtgaatattcataaactgaatacatctatgtaagcaatatctaaactaagaaacagatattacaaggtgtacagcagcccgccccaccccaccccaccccaccccacccagtccctgcccagagtaaacactatcctgacctaaatacatagattagttctgtctgtttttgaaatgtctataagtagaatcactcagtatatactctgttgtgtctgaatgttgtgtctcactcaacattatgtttataagatttactcattgttatacatggctgatattcattcactctcacaactgtatacttctactgtatgaatattcaaatttctttttacctaaggacccattgatgagcatttctgttttggcactattacaaaaagggctgtttgaacacttttgtacatcttttggttaacatgtgtacatatttctcctgcatgtatatctagaagtagaattactgggtcatgggatatgcattgtagatgccctcaaaatttttccaaagatgtttccatttatacacccactagcagaccatgagaacttccattgctctacatcgttgaccaacacatattttctgcctttttcattttagtcattctcgtcagtgtgtagtattatcacattttgacttaatttgcattagtataatgattgttgaagttaagttctttttcacacatatatatattgcaatttggatatcctcttatgtgaagtgtctgttcaagacttttactcacttttttattggattgtcttttgtctttatcttttttatttgcaggagttcttatgtaatctgaatgagtcatttgtcagatgtgtgtattaagaatatcttctcccactctgtgactgtcttttcattctcttaatggtatgttttgatgaacaaaagttcttagttttaatataaaccaatctctctctatatatatattttttatgtttgtgtcccgattaagaaatccttgtggcggggagcagtgtctcgtgcctgtaatctcagcactttgggaggccagggcaggcagataacaaggtccggagatcgagaccatcttggccaacatggtgaaaccccatctctagtaaaatacagaaaattagctgggcatggtggcgtgtgcctgtcttcccagctgcttgggaggctgaggcaggggaatcgcttgaacccgggaggcggaggttgcagggagctgaggtcacgccactgcactccagcctggcaacagagcaagaccccatctcaaaaaaaaaagaaagaaaagaaaaaaaagaaatccttgcctactccagggttacaaagatttttctgctatgttttcctctatttcctacctagttgccctgtttactatattctttttttctcataacttttctctgcattaatcaaacatccatttatttatttgtagtaacatgctaactacactttcttttactgttcttttagtgtttacctgaggaattgcaacatgcattcttgagttggttctatataattattacttttagtatcttcccagaattgctaaacctagaagttttaaacttcatttatcacttcttacttttgcaatggtattgatgtcacatattattctgtatgtattttaaatttcacaaagcatcactcttattgttcaatatagttcacattcatttgtataaaatgcatttacactctccagcattcttcaatcactcagatatttccaaggttctatttagggtcattcttctacttacaacaattccctttggtattccttttagtgcaggcctcatactgattaattctctgtttttgttttgtttttgtattttgggtttttttttttttggtcagaaaatgtctttgtttcgatattttcaatagatatatttgtattagttacagaattgtaggtttgcagttatcttctctcaacactacatttcatttatcttctcacttcttttgttaagtcaattctcaatcttgtacttagagctctttaaagttttttttgtttgtttgtttctttgacttcatttaagatcttgttatctggttttcagcagttttactgaaatgtccctatgaatgtttttattgtatttatcctgcttcaattttgctaaacttcttgaacttgtgtgtggcggtctttccaaaattttagaaaattcttggccttaactcctcaaaaaatgcatctccccgtgtattctctcctctcctttgggacttcatttttacttatgtttaaaaaaattagcataacacaaataccatttacacaatatctaatttttccctttttctttctatgctttgagtattttttcagttcactaaacttgtattatactgtgcccaatttatcatatgtccctagcaaactcttaatttcagatagaggtaggactttgttttgtttcagttcaagaatatgtgtttgattattatttttattaattatttttttgagacacagtctcattctgttgctcaggttggagtgctgtgcacgatctcagcgcactgcaatctctgcctcccaggttcacgtgattctcatgcttcagcctcttgagtagctgggattacagacatgcaccaccaagcccagctaattttttgtatttttagtagagatggctttttgctatgttggtcaggctggtctcgaactgctggcctcaagtgatccttccaccttagcctcccaaagtgctgggattataggcataagccaccatgcccaacctgtttgattattttctatgtgtcccacttctccaatcgaattttcttttccttcactttttttagtccaccttttaagtccttgccagttacctgtaatatctggatcatctatgtatctgcttcaaatgtatactttttcttttgattatttgtcatgtagtttcacctatttgtatgtctacgtactcttttattgtatgatagaaattagttaaagaagaactacagaattccaaacgatatcttccaccagagcaggtttctcactttcgatattaagcagaagagacagaggctggacgtctcaagccaaccaaggactcagctgggttggggctagattgcagttttagtggaatgtagtcttccccttgtttatctatacttgtaagccatgacactccctggattttgattgaaagcctggtatatctttatcttctgggccctgaaaaagttctctttcagaagttttcagctcatttctttatcttagggccctaacagctacaaaatttggtaaatatcttcaaaaagagttcaatggtatgtttgagtttggtgtctccaggctgccaagtccttttgtttgtttatttcctactaaaattctactgccttttggaagctctgcctttggcttcctatgcagcctcaaaacacagcaaacatcccttggagaaagatgtgtgttttagatccctcaagtctccagtttgtcccagccttgcagtatcactaaaagttttgctaacttttcttactccccaaagacaccttccgcctaggcccagtccagtcctcagaccacactcagaataagcaaatgccctcagggaaataaatacatgcatgccttggaataattttcccttctgaaattttagttcttttagtccttgttgcttccacagctctaggaactatatctaatttatttggtttgtacagaaaaactggtcctatgacctacttgaaaatcaaagctattacattttaatagctctgattagtttttaaaactctattgacacaaaattgactctcccatattttccattaattggctaaattttgaaacctggaacagtattttaccttcaaccatattgctttttttcatctatttaagattatctcccttaaatatgtttttccttcagtctaaatatcaccaaattctaaacttctattttatgtttaaatcctttgccatcctgatcatcatcttcagtaaaaactctcgtttgtcaacatccctcttaaacaagtatcaacaaaaatcctagatgctatgattaagcccaataaagagaaaaaatgagagagtcatattaaaaaaacagagatacaaaataaagaggaaaaaaacgagagaatcacacacaaaaaataatagagatacaaaagaagttatctagtgaggtgtttttaaaagcacatgaacaaaagatcaaaaaaaatcaaagacagataaacaaaatagagatcaaaaaaatgaaatgaaagcttccaaaattctcatgaaaaatgctaagcataatgaaaagaacattttgatcctttctaagtctttgtttcacaattacctgaattcattctcacaattcaatcacattttactgatgagttaacttggaaaatgttaagtaacttttgaccaataacaaaatgtaactaatagcagagtttctaggtttggatacagatatttatttcgcacagctacactcagatctactgaattatcaaaataatgccaagtagccattttaactcttttttttttttttttttttgagacagagtctggctctgtctccaggctggagtgcagtggcgccatcttggctcattacaacctcctcccgagttgaagagatcctccttcctcagcctcccaagtagctgggactataggcacgtgccaccatgaccagctaatttttgtacttttaatagaaacggggtttcaccatttggccaggatggtcttgatctctcgacctcatgatctgcccgccttggccccccaaagtgctgagattacaggcatgagccaccgtgcccagctgccactttaactcttttttttttttttttttttttttttgagacggagtctcgctctgtcgcccaggctgaagtgcagtggcacgatctcggctcactgcaagctccacctcccgggttcacgccattctcctgcctcagcctcccgagtagctgggactacaggcgcccaccaccacgcccggctaattttctgtatttttagtagagatggggtttcaccatgttagccaggatggtctcgatctcctgaccttgtaatccacccacctcgggttcccaaagtgctgggattacaggcgtgagccaccgcgcccaacccactttaactcttttcatacaaatttatctagagaaaatgtccttctaagaatagacatttctattattcaaagagaaatctgtgtagattctgtcttatgccagctaaagacatgtatataaaaccacaaaatacattcttaatattatgaacataacataatttatttatgtatgtatgtatattatgaattataattcatttatgtatgaaaagcacacatttgagaatcaagctacctattaaaatggtctatatttaacacacagacatcatgctgaaaatgggtagctctctacctcccttttgcatattaagcaatatctgtgtaattgattctctctcttttggtacttaaagatgcatttggcacttgagaaagctatcttcagcttctaacagtaagtttgtttcctagagctgtttggtacctgaacaattcagatacatttgtagttactaaggctcagagaagagggatacaaatttggttgttttgtgttgcttctaaggatttctgcacacacacacacacacactcacacactactatttaaaatgctcttaactgaacaattttaaagaaaaatataatggtcagaaatcttaaattaaaaaaaaatcaaagcctactttatccataagtaggtaaagcaatggttacatttaaaactgtattaacaagaacaagtatttcattccaccattaggaaaagagttaccctgagagagatgccagttttacttaaattcattgtaagaggtaaatgagagcagagttgacttgggtctgggcacaagtaggacacctgccactattaagatggaaaagagataagaaaggtgaagttggaaatacttaagattctccaacgtcacgagactacatacttgcagttctgccaatgtttaacattttctcaaagtaagatatagacaaagtgctccagtctaggaaatcagatgggcccaacctaccactaggaggaaaaggaagctatgacattctgaagtttggcacctcgtaagtgcccactactattaattgcattgaatatgaactgaactgtgggttcactaaaagcatgcttctggagttaggaggccttggcaaatgaggctaaaaattaactcacacattcaaagccatctatttttaaaatgcatgataagcaacacaggaagcttttataactagccagcaaaatctgagctttcaatcaacaatttctttcaacgaaggtgtggagcatggaaagaatccagaagcacagatggtattttacatctgcacatgcaatttcctttttctccatttttatataaacctctctctttttttaagaatgatagaatttaccagtaaaatgcagaactacttaattgcctctagaaatgttcacacctccatttcacatttttagcagcaatttaactgcctttaagtatatgtagaaagatgggagggtggaccttttaagctcccctgtattacaaagtgaataatttcagaagattcaattcctccagagagctacaatttttccagcacttaaaataactgcactccaccatccttatctctaactattttcctaggattaatgctaacttttcactggatcttaaggctaaaatgaacttcagagatcatgttacttcagtcctctcctcaaaatatgagtaatcatgatccagtagggctggcagcttgttcaaggtcactttgctgcatagcacaggggaaaggagcaaagtccacctgcatcataatccacaatcacagagacaaatgtaggaagaccaatacatagctgtgtctccaagaatctatttccaggactccatcagaatgccaagcccttcttcttataaagtaagtcagattcatttgagcacatagagaagcctgacttttaaaatctaaaagcgtttctttaaaaattgaatacaaataacaggtttcactgtcatattacattcaaaccaaagataaataaggcatgaaaataatattggatagaatgaaattccaggtaaccaaacatggtacaggggactgaatttgtacatttaggtaacggggaaaataaaaatactacaacataaactaagagaaactttcaaaagcaatgttcaacttacctttagaaaaatgctctactgaaataaaatcaattgacatatcctctgtttttcatactaattcctctggcccaaacctctctcttgagctctagaattgaacaaagtacctccatgacatctccattggactatgtcaaaatctcctcgtctttatcacgtctaacaccacactcaccgccaaagcaacttgcattgtctcttgtttcaggcaacgcccccaacatgaagatatttgtgcatccagaaatctaaacattcctctgagacctcctaatcccttcagcaaatcctgaccctctacctcaatcactcctgaaacctgctaaatttcctccatctctgtggccactccctgcatccacactgccatcttgcttctctcatggatcttccagtagcctttgaacagctttgcacatgttcgctctggacctttgttgtccctcctctccagaatgaacttttgtcaatgcaaaccagttcttatcactctcgtgcttaaatccttcattggcttccactggctttatgataaagtctaaatccttcaaaatccctaaaaatttataaaatggtccacaaggaactagtggccctgatggctttttgagtcccacctgacccagtccctttgccccactcccccatcctgccatatccctgtagtctccagtccaaccattctggaccctctgtcccctgcctgcctctcatcctttgcacaatgttaccttggcttgaagcatgcttcctcccactttctacttgattcattcatctcaactcttgtgaaactttcttaggaaaatcttctatgatgcaactccctgaaagactggttccctgtatttttcctctgtaaccaacatcaaaatttgtaatcttatatttgtataactattgtttaatgtgtatccccttatgataatatctatttctatttattcgctcatctcactagcacctaagacagtaggtggcatattatacatactcaatgatcatttattaaatgaatgaattaataaagagagaaaattactaataagagacaaaattaataaagaaaagatagaaatctttttatctagatttctagattaacagaggaggaagggaaggggacagagagagaatataagtgatttacaacacaaatctcaccaacagcttagaaagttcaattttatgtgtaactatctgttactttggataattctgagctagtaggatacatcctaactagaccacagaccagggtcatacttggaccaagtcaatcccagttacccaaacttcagtcagcttaacagctctctctcaggagtaataacctctaacaaaggtattctgaaagtctccaaataaaagaacaccacttttaggttctttgcttgatctcagtaaacatcctcaaatgggcatgaagagtgatcttcccccaattcaagttctggaaagacttaatgtgtacttccaagactgtaccactatagtgcctactaactggccaaggtacagtgtcaaaagccctaaagcacaattgctctaaagtttatgtgtgtgaatatttgttctgtaaggaaatgagaaagaaaatgatcagaaagaaaaatatttgagagagggaccaacaaaatgttactccccttaaattatttaggaaaacaaagtcaaggcaattattatgatttataaatttttttctgataccttttttattattattattatttgagaaggagtctcgctctgtcgcccaggctggagtgcagtggtgcaatctcggctcactgcaacctccgccccctgggttcaagcaattctcctgcctcagcctcccaagtagctgggattacaggcacccaccaccacacctggctaattctttgtatttttagtagacatggggtttcaccatgttagccaggatggtctcaatctcctgaccttgtgatctgcccacctcggccccccaacgtgctgagattacagatgtgagccaccgcacccggccctctgatgtcttcttaacatcacaattctcaaacttcagagcaaggttagcaggacacttgtaattttgacaatgcaaaagcagagagagacagaatatgccaatgcaatgcagtagaccacttcatttgattatgtgacttagaacactggcataatttggctcccattaagagttttctgaagtttggatacaatttctaagacactcttaatccacttcaactagaatgtacactatgaatttcaagccaccaataattcataatatctgggaggaccaggaataatccatatttataagtttcagagacaagatttgcattccccttttggtttctctgatgttctgctggctgtattttttgtgtggggatgtatgcaaggttaacttatgagcacacgctgtgcacaagaaactctgtgttatagaacaaggggaagagtcctaggaatttaagaaactatcataaatacagacatcatggccatgtaagccatggcttggcttgctgccagttctctgccacagttgcagaaggaacacagcgatagggcagttcctagatataatatctaacagatgagcaatctacataaaacatttatttctaagtttagaaaaccccaataaagccaataaattcgcaaatatctcccgaggatcagaggaaacaatagaaaaggcaaagtattacaattaagcatctgtgttataattaggaagataaaacataacaataagatagtcacagcccagcgcggtggctcatgcctgtaatcccagcatgttgggaggccaaggtgggcagatcacaaggtcaggagttcaagaccagcctggccaatatagtgaaaccccatctctactaaaaatgcaaaaactagccaggcgtggtggcgggcacctgtaatcccagctgctcaggaggctgaggcaggagaatctcttgaacccgggaggcggatgttgcagtgagctgagattgcaccactgaactccagcctgggtggcacagcgagactccatctcaaaaaaacaaaacacacacacacacacacacacacacacacacacacacacacacacacacaaagatagtcactaacacacagcagcatgtaagaagtgtcaagagaggagtaaaataaaaaattgctgtagttagaggagggtggttgtacaaggttttggttttgttttgttttctccaaagtcttcctacagcatgcagaatttaacctgcctcttgctgggatccaaagaggcagggagggcatggcaagaagaaccagaaggggtgacagccccaagtgcttgtatttcgttaaaaaattccctcttctcaagaaagaaaattattccttttacgtgagctactggattgttttgcaggctagagccattttctgctggattgggttttgaaatggtatttttccatttattttacagtatcttatgggggtggaaagagaagtatcagcaggttaatttctacctttcacagagaatctgctgtttacaatgtaagacaaaactaccgaagtatgggacacaattagggaagtcaggaacacatttaaataaactgatgttaatgaaaaaactgaattctgcatataattcccacttagaatgttaggtcccagcatcgcaatacatctactgacatgagatttttttttctcctcagagaggaaatttatgttttattatttatcattcctatgcttaagcttgcttattggatttattcaataggcatcatcttcatcatcttatagatgtgcatagaaaaggtgaagtaacggccgggcatggtggctcacgcctgtaatcccagcactttgggaggctgaggcgggcggatcacgaggtcaggagatcgagaccatcctggctaacacagtgaaaccccatctctactaaaaatacaaaaaattagcccggcgtggtggcgggcgcctgtggtcccagctactcgggaggctgaggcaggagaatggcgtgaacccgggaggcagagcttgcagtgagcccagatctggccactgcactccagcctgggcgagagagcgagactctgtctgaaaaaaaacaaaaaaacaaaaaaacaacaaaaaaaaaaaaacaaagaagaggtgaagtaacttacctaaagctaaacaataaatcagcatcctatattagaatcctcagtcccttatatttaccctagttggatatttggcacttaaactatgatgctttccagtaataagccaacaattttaataatgtctaaatgtttctctctccttcagttctgacagacagagcttatacatttttgagcacatcaatttgattgcatctcaaatacagattaatgtggaaacagtaataattattggagaaatgactgttggcagggcatttaaaatgcttaattctctaagctcatttcaggtatatactgaacagtgatatgagagtgacaagcagtgaaatatgtagaaaaagaaaggacatgaggagtttttcaatcaatcagtagtaatacaatcatctctttcacttattgagaacttactatttcaggaaacacaaatatattttctctagcactaacaacaaaactgtaagatgcagattattatatccatttaacagtgccaatattgtggctcagagaggttaattaacttgcccaaggtcaccaatctaataaatgatataaattgacccattgtttccaaccctattgatagtatctgacttcaggctctcatcatctctcgcctaccattttgctatgcctgtattctcatatgtatacctgtcactgttgctccatatacattctttgctcctgccattttgagtagttctagtctcctggaccagctatgctgtctcatgcctctgcacttctgcctagaacagtcttcctacttttctctgaatgagttccttgtcttccttcaagactcagctcaagagtctcccctctgaggtctttcctgatcctagcccagcagaggtgatcatgccctcctctggagccagtatatagccctgtttattcactagtttactcactagttatgtttatatgcatggatccctattaaagacttagagctccttgaaaacagtattcatgttttatctttgaattaccagcacataacacagttcctgaaacttaatgttcacaaaataggagtacctaggctacctttgttagaagtttaagctggacccaaagttgattgcagattgcagtcagcattctcaagaaccaattttctttcaatgctatagagaggattttttaaaattaaaaaacagagaatttttatattacattttaattaaaaattggatctgctactccttcatttgctgttcatttcccctgttacatttattaattatcaaatatattagttggttttaaccgctgcttgctcccttgtagtccatctgtgctttcttctcaataatgcattgaagtcataagtgctagatttattgccttggtgattttcatggcacaaattgcgatttcgctagcactgagcagaaggaagagctaataggcaaggcagaaaatgcctaatcaatatcactcctggcataagtttaaaaccctaaacccccaagcagattttgcaaagggctatacttaaggccataatctctagaaatgcatttactatagtaagaagttgagaatcactttctttcctaccaaattctcaattacttcacaagcctcctaggaaagcactaaggtctttgaataactcagctggcccgcaggagaaaaaaggaaaccgtgcaggaattagataggaatatgttatttccaagaagggccctttctcctaaagatacatccttttttctaaagataaaataaagtacttctacatcagcatagagaagaggatttctgaatatgagtgttaaaagacatcctaaggattagatatcagtcatgaaactgattggaggcatgttctaaactgggtagtctgggggatggaccacaatattatgagtcaagcaactaaccagattttgttgactagaagccacccacctcctatattaactacatcaatgaaattaagtgctcatgaggcattaactggattgctgaaccagacaggcatttctgctatagtcatgagttctaccagaagccacctgtgtgttctcacaaaaaagcaggtgttcacctaagggtcaggagaggcaagtgtgatcaggggaccagtgagcatcctggtataaagaccttcattactcagccttttaaactttgaatccctttaaatatccataggtctacctaatttgagaaaaaaaaaaacttcctttattcgaaaccacattgctaatgtcctcaagtaaaaagaaagtgtctaaagtgcaggcttagcaccataacacaaatataagccaaatagctgccttttcatttaatacactatgaagaccaagcaatcaatataatgattaggaaacagttccaatcagttattcaatgttctttcttggggctaccatctaggaaatttgtctcagtgcaaaaaaaaaaagtatagtcctatcttcctggccacccccactaaagcagaataacctgatcccactgtgttatgtttcgttgtctacctcaacacatttcaacaatgtgctaattttaactacatttgagttatatgtgaattgtttttattttttagaatttgtacattttaattttccttgagaagaagctaagaattattcagatactagacagtgatagcagtttcacaataagaacttgtgcatgtattaagcaaccatgtggctttccctctaccctatcaataatacatatatgtctcagtttcatgtcccttaataaataattaagaaatcactaaaataaacagccaaggcattcaaaatacattagttctccccatagacattgggatggttcccattacatactttttaagagtctgatttacttgcaaaagctacacatattttattaaaatgtaagtaatcaaagcaaaatttaaaagcacatgaaaagaataaaaataaagataagaaaaatctaatcagttctctattaggaagggagagggacacagtcaattcagctagaaatataatggtttccaaggtcaatgccagttcaaggaagaggttcgttgctttgcaacacttttcagggagaaggtaggatcaggagctccagtgtttccttataaacaagcacaaaatatgatatattaaaacacctatatttataactaatctcaaattcacttatcacttttaacttggtattcatatattcagaataataatagaagctcagagatttaagcaatctatcctcatatgtattgttccttgagttatcctcaaatggttggcaaaaatctacacctggagtgagaattccacaaatacttacagagaaggaaaaataataggaagaaaataccaaagatgctcctgttgggcaacagtcactaaccatgaccaagttaaaaatttttatattatctaattgactatcacaacatcatgaatacattttaaagctaaatctgaagtggagaaccaaatattaaaatatatattaatttaaatattgtttataattctactctaaatttcattcacagcagaacaccctcagccatgagaaaaaatcattttcaccctttagattagaaaatttcctgatcctacattagatttccttaaccatatatttttacaagattcatgatcagtcctgcctttccaatcttactacttgggtaacagatactttgataacttttataatggacacttaaataacagagtaaatagaatgagaaataataaattattgctattactcataaaagcataagattaagctttttcatagagaaggctgtatcgcataaaaaatctgcctagactacgtttataaattaaggttcatcctttccttcattgctgattttatatcattcaggttatagattagcagtataaatgataggatctaataataagaaaaccagtttaaaataattacatgaaactccttcatattatgttatatttgtgccttgtatgttataaatatcaagacatgtcaaaggagttaaaacatattctctaagtagggtatcctaatgatactgaagatcttaaccttgagcttcaaatttgctgtccaaatatggtctgaattatttttaatttttaattgcattcaatatctactttgaactgtgagtgaaaagcaaataattacattgttaatgagacaagatacactatcaagaataacacctcacattttttatgtagtttattttttaacttgttttgatcaaagccatagttgaaagaaaattgtctacatatatatgtggctgatcacataatagtaatcaaaaatatgactagtcttcttgtttattatttataagaaacaaaagaaatactacatcctatgaaataaagtaagaaaaaatgaaccctaatttgtaaatgctagatgcaactgtgaaaaaaaaaatgagagggactaaaagtaaaaaacataggtaagacactgagaagagctattcaccacatcaccctccaatattacctccaatcagtcaacgttagtcaccctcatataatctatgtgtgctcataaaatttagaagttgatctttattaaaatatcaacaagaagtattttattgcataagagctgtattgtcagacttacttttaaagtttatgtttgtgtcatataaaaatttgaaataatgagttagtttacctttacatattagctcatcccttattatgatattttcattacaaatgtaaatacatagacttggttataatctattcagttccctgccaatctttccactctcaagaattttcaaacttttactaatacgcaagcctgcacaaaccctgagaagtctttattctctattgaatttacaatctagagagatagattatgttaatatcaatgaaataacagcaatatataaataagaccaacctggccagcttaaacatgacgttatctatataaagcctcatagcaacagcagaagatctttccctccactctcatcatatcctacacataattccaccctaggaacatggtgtttaaaatggcttgcttgtaaaatcagggaattggtttcattcacccaagatctctaggatattcaataatgatggatggatatgatatggacagatgaatgagtggatagatggatagataaatggatgaaggggtggaagaaacagtatattttttttcatacttatgtggatataaatataaattttgaagaaattcatagcaatacctcatccctataaaatgaaactcatctgaaggattttctttaaaaaatgttacttgaactaaaacaggtgcaagatttttatgcaacctggcagatgcatacagaatatcacttcatttagttgggacagaatatcacttcatttagttgggagataatctcaaccaaagtctcaattaatttagtaatgaagttgaagagaaattcaatgcttatcagtaagtaatcatatcatttgaaagcctgtttggatgtcagctgcttgggttcagcaaatcctgaaatgctcctctgcaatatccaagtcctgccaaagcaggacaaactatttttagatgaggcatgtcaaaaacgtagtctgttttataaagaatgtgaagactacatcaatatagtaaggaagaaaatgccagttggaaagcaagtgggctattagaagtcatgagacacacacacaaacataaatgccaatgttcagggaaatcatatatagagcctctctgtgagaccaaaataccctatcagtcatagatatggagagttctttccaccagttgcttctataacaattccaaacactagtatctgttatgtttgtttgctttataatttttaatataatgtaattttcattctgccatacttatataaacctagaccaaaaacattaactgatgtagtgttattataagaccctccagtggactgttgtgactacaatttccaaggggattaaaaaaaggaaaagaagaatgagatgttttcatactgattagcaactgcacctcattgcaccacagtatgaagaaacggatttggaaacacagcaccaagattagagaggcttttgagccatagtttcaatttaggtctcatcactttacctggcaatagtaccaatttagcaggcactgggctgtgcagaaagatttacatgtaaatgaacacactttggggcattttgctttgcctcagttaaagagaaacatcacttttcattggcactacaaaaataaaacagaggttaacacagaagggtccagggaagagtccattagtggaaaagctaatttggcagctgcatcaaactcctggagatcatgagcagtgcttctaggaagcactaaagaatttgaaaaacacagatattgtggaagttattagatgataaagtgtacacataacattttgcaatttatagggggaaaatcaccaaattaagggatgattatcttatttttaatattcttttaaaaagttttatacatttagatacacaattcataccttctctaatataaatatattaaaataagtttaaaataaaataaagttttaaataaaaataataaaggatttttaaatagttaaaatcaaataaaaaataaagtggatctcaaacatcataatgcagtgccatgtgcctcatcattagtgtggatttctgctcactcattttagccctctacctctaagctaatgtcataatggcctggatccttacataattcgattttaatagattatctcagtcatatagttcctataaagcccagtcaccgggggatggaggtttgtgatttcttctcagactatattaactaacccttactcttttctttcattcattcaagtattcattcattcaataaatacacatatagtgcttaataagtataaggaatcatgtgagacaatataaggcatggagaaatatgattagtcatagattcttgtgctcaaaaaggttatggtctaatatgagataaaagatctgtgcaaataaagacataatctaaaaacagacatataataatatcatgtggaaataccatgataatttaaagagaaagaaagcaagaacaagagtgagagagtaagtgagtgagtgaatgagtgaaaaattgagagatgccaaatggggagataagaaatgcttttcctacatggaatcctctgtcttctgcttgctaggcatgtattggaatggcttatgttccatccagaacccttcaggacaagaacttggcatatggcccagagaaggcattcagcaaaccttcactgaaggaatgagtgaataaattaacgaatgaatatttctctttggttttgtagacattagcatgtgaatttataaaaacaatgcatatagccaatccatatttattttttcttgcaaaactgaaacaaaatgcttcataaaacacaaaatatattcaaaagtggccacatcatttaaatagttaagattttttattgcaaagataaacggtgcctgcattacataagactctccctgttacttagatggactaggggcattactgaaagacaaatttgcaagacacccataaagctaccaaaattcagaatgttttttccttactctaaatgcattttgatgcaaggagaactgtgacctttcaaatagaactcttaagtttttttcactttatattttaactttgcaggatttcactataatgaagtttttgcacaaataccactaaaagaattattattatgttcctgcaaaaaatattttgtctctcattattctcgttacagacacttgaaaatctgcaaatttatattgagttcctgccttattatcctatactgtcagccctccatatccataggttctacatccataaactcaactaactgcaaattgaaaatatacaagagaaaaacaaacaataaaaaataacaatacaattaaaattaatacgaatagaacaatacagtataatgactacttagatagaatatacattgtattaggtattatgagtaatctacaggtgattttaaatatatgggaggatgtgtgtggattaaatgtaagtactacacaccattttatataagggacttacataaacctaagggaccccccataggttttgctatcgggagtcctagagccaatcccccatggatactgagggaggactgtacttgtgacctcagaatagtaactgttactttagttggcaatttagctcttaagaaaatataaaaattaagtaccagggcctggattacatttaagaattataaaggttattttcaaatgttaggtgtttaaatttaaagatagacaacataaattcaggctcttaattatgtgcttcttgaaagtgctttcttaaaaaataatttactagtagaatcaagataattaaaattaatgatccaacagcctgttgtactcacaccaattaaccattggaatgctaaagagttctaggagatagattgctcttcgaacaaataaatcagtttcaaagtaaagtatattatctctgtgggggagtctataaagtaaatattgaatcacttctcagcaatatggactcttgccaataaatctcaaaaacaacattattttcaaagaaaaaagatggctacctcatttggcacacataaaggatgaatgatatagttagtcgaatcagccaatcagagtatacatatgtgtatatacatatgtgtgtgtgtgtgtgtgtgtgtgtgtgtgtgtgtggacagaaacacatatactgtatttgtctcctaggccccccatccattgccttcctttactatcttgcaccatttgtccatccctttcacaagcctataattttgccagagagcagaaattgtgtcttcatcatgtttgttctccatttcccagtcctgtacttctgcagcacctgcctagctatgttttacataaagaaaaaattcaagacaagtatagtctcatatgaaacaaaataatcaaactacagattaattcaagtttctttttgcacattttgttaaaaagaaaagctaacatattttaactggaaaatatctgccaatttctaagtcaacacagggatctaactttaaaaaccccaaaggtcttcctgaacatttttacacatatatgtatccaggagtatacttaaggttcctgtccccatcttgagtgttttcgagattggactcttctttctatgccttgtattggtcaatatgtgtgtagtaagaagcagagaactctgattttgagctgtcactatcttacccacatcttaaatccatcataaactacgtttctttcctgaagacccaatgtgcaaagaagcatcataaaactacagtataaacataggaaatcttaatgttcacactaatggaaataagagctaaatgttgagaattagtgttacagagaatcagatgcctatattgtgttcacctctctaggttctaaggccagtaagaattagatagagtgatagataagcaacaaaatgtagtggttaagaaggcaggcaaccacttaggcaactcactagacgagtgattttatacaaattatttaaactatctaagtcttccttttctcaactgttagtcttagaaggcttaaaataggcaacctctgtccagcatgtagtatagtacctgtgctacatagtaaatgcttaatgaatgaaaataatgaagagaatattagagacgtgtccaggccacgcatcaactgacagacgcaacaaatgcccacagcttcttcaggtggctaggcagagtaacagctgcagaaatcctaaagaaactaaggtagaacctgcggtaacatctaggccgtccctgacactttgccagggacccaagctgcagtgtgataattgcttacactatttatctcatatagcacttatattttatcaactgccttaacacttagaaaccaaaatagtgattagtgacaaaattttcaagctgggagtcaagccggtagaaaggtattttcaatcaagagtttcttaatattactcaaataataccaaagggacagctttctattttgactctaagtaaaactaccagcctgtatataaaggtcaagcttcataggacaaaataaacgttgctagccaatctccaaacacacatcaaattgcgcataccttagcaaaacccaaagctagttatgaaaatcagcttatataaatgaaacagatagtagaggcatcaaaatgaaaaagaataaagtcatcatcaagtgtattttttagaaattaaaacatttctttaagtaaattgagaatttaaagacagtgtgatacatacacaaacatacatgcataaatatatacatgtatatatttaaggaatatatgtaaataatatatttaaggatgccaatttcccagaataaagtatactttaaatcccacttctttccaaagacaaagaataatgcttcagacatgaccaccccccaaaaaaaggaaaacaaaagaagaaagtatttactattttctacatattgcttacatttaaattaaaaatatagctaatttcctccaggataaatttataaatgcccagttttattggcaattctacagattagggagaccagtcatagtcactaaggtgaaaaaggtaatgatactttgagccgagatagtggtaacagagatgagagatgtgtgtgcctgtcattgatgtcaagaaagtaactggcaaatcatgggacatttggaacaagagacagggagtcaaagtagatgggcaacaagtagattaagctgacttaatctaataagtattccctagaacaaaatagggaccaaggaagaggaaccagtttgtattcagagataatgagctcagtttgaaacaaatttaaagacaaattagagaaatatcattaactagaagaagactgaaatgcctatttcttattttatatgttagtaggtagaaataaactcaactgaaaaccccttaagtttagtagatgaaaaataaaagtaagaaaatacgcctctgaatttcaagataaaatgcagaaaaacatttcgatagtgacaaggactacatctaaaaaactgaatttcttcattaagaagtctgtttctttcactgtatgcagatgatcaaaaatgatatttacaaaaaccctaaactatcatcttttcaacaacctagagagttagaaaacttactagataacattcagccttacaaaaatgggaagatttcccctgtgatatatgaggagagcatgagaattctctcaatgagtagagatatttatacatactaaaatctctattcagacataacacttaccaagcaaactagagagagaattctagagaaggaaaacatggcctttttgttattccttcacaaaagaagactgtcattttctgttcttcagagtattttgtactttaaaaataaccttttctatccaacagaagagattcttgagtgaccttaaccaaattatgagaaattcatatgaatgttcatatatatacaaagatatttgtacaaatatacctagatattacttatatagttaatatgtggtaaaaattattatttttacttaatcacaacttagaaactttaaaaaactattcttatcctttataatcacaaactcaaatattacatatgaatgggaaaaagaccattagtaattagttatttttaaccatctaactttgtactttttatgtgaaaggtacatagcattgatgttgatacgagacagtgatatgagacttggcacatcactggaaaattactgctagggcaaatatcattgatgtcaagacactactagtgtagcagaatcgaaattattcctaagggaatttcctaaataatgggtcagctactactactcattattacaatagcatataacgattttcttagctaagagtatacatgataatgctttctagagagtaagtttttatacccctgaatctccacaattcatagccttaagaagaattacctttcttggaaaacggtgatttagaggattaaaagaaaccagaagtaatgataaacaggagtttagcagggtaaattcatggagagaaacttaattctcagaaagatatgacaagaagattctatggacactttaaatagagccttccaacaaaagatctggagaagcaaatgccttattagatttaaatttcctattgcccttccctgagcctattccaactagctagttcagacacttagggtaactgtttattttatgaaataatgtatttgggtaaccttcaggtaggttgactaagtcatttattgtcaaaatgggacgataagcataaattgggactgtactgttgaacaccctaatctcaggagagaccatgttaataaaaattaggtaaaaatggagaaatagagagaggttactgtgaaaaaaagaaaagaataaaaggacccaaagtcacttgatggttatgtgaagagaatggaatttattgtgagttggtgacaggaagggatctacaaggttgagtcaaacagatttgtttttttaatgccagctggtagcctctccattactacccagcgaccagtcattttttggtgcaaggacataccctcccaacaaaactgaaactcccccccaacaaaagattgctgaattcacagtcgttgcccaaacctctgcatcaggtatttaccctggtgtgaaaaataccatatgcagattttaatttcttatcattttagatttagtttatttgaaacataaataggtttcatcctagtcacactcctttttcaaattatggcactaacacaaattgtcatttgccatattctcaaacaactgactataatttgaaagggacggataatctcttcatggaagaaccaaagaatacctcttaaggcaataccgtgatgtcaggcagcaggtagtgcactgctacttgagcagaaaatgtgttgcacactcagcatctgacttcctactcgaattaacttatgtaaaaatctaataccctaagctgagaaagtaatcaacatatgatgttgatatagagaagaaaagatattacaaacaatatatgtaatatttttcatgaggaagacttgctctgacaaagaataattttctcattataaataattagaagcaaaaatatccctcccttacaaatttagataatagagactatttttatttttattacatttaagaatcattgggttcctaaatggatatcctacatggatattctaacgaaataagtatttccagatagcatagccttttaatgtcatctcattaaacagtgaactaggtcttttaaattgaagtaaaatttattttcattctacatattttaaaatacatgatagcaattgtatttaatgtaaacatctagtaaattattatttatagtaattgggggaacagtgtataattaaaaagaaaattactggccatattctatacctaaatcacttggtccttccactgatatttaggttcttcatattgtcaagcatggtgcctcatatatcacacagtttcaataatttttatccatctgattagccacaaaagaataaacataccttgtactacatctgtatacaatacttataaattaaaaattgaggaagaaatgacttaaatttaaccaaatattttatatattaaaaaattatcttacttgacattccaataaaattgtcagtgcaaaatattcataattcaacaaagacttacctgaacacaatttgaaaaatttatgagtaaatgtacacacatgtgcatacatataccatatcatgtatatatccataggtatgtatactatatttacatgaatcttatatagatgtcatgagtatgtaaaagtggtccaaaactgatgtatcaccaaaatttgcattttccatacctgatttaaatgattttgaaactataagtaattggctttaagtttatacatatatgtgtatatacatatatgtttatatattatatatgtatctgtatgtgtgtacccctatatatacacatgggtatatatccaatgctaactctcttaaattttcaaaatcatttaggtcaacctgggaaaaatctactgtgatgctgtattcagatatggctagctgttacattctacttactgatacatcttactatgttattttattgttaataagatagaatcaactttaaaatgcactctcaattacatggaaatgatatatgttaaacattcacgttgcttataagttccatcctaatttcagaaataataaaatgtgaaaaaatgtggatttatatttaaacagtataatcatggcataaagtatttcaaaataagacatatccaacagtaagaaactcactaaagaaaataatatgtgggatttttaaaacagatcatcagagctaactatttaattgataatggttcaaattaggacttgcactctgcataccagtcagtagccttgatacattaaatcaagcaggaaattgtgtgtgcacacacacacacagaataaatgtatcatggtttattatttttcataaatcatcaccatagaaattacaaattattcacagtagagttaattctaagtaagccagaaatgattctgcatatatgaggcataagtttccatgacgaataaggacaagtatataaaatcctacagatatatgacccataacacattacagagcactgatttcccagaggataatgtaaaactcgtgtacccagtaacagttctatttttgttctcttctataactcaaatctattcatgctgcacatttacttttacataaaaatgtattttagttatctgggctatttcatctgtgacaacaagattcttatttattttaaatggaagtatcctattttattcttaagcattttctttacgatctttcagtcgccttgaccattttttaaagtatgtgatatctttcattcacgcatcagataacttcatgttttaaatcttaaaaatccacataaataggaagagttactctggaattttcatttaataagctggattacatttctctaagaactaagctatatatattttatatgccgaaatattcatattataagcaaataatcttaaaagaagtgattagttttattttttatttttttgattacttttattaaagagataaaaggtaatatttgctccaggaattttcactgaagtagaaatacatgtaagtagaactgtagggatggaaacagaagtggcaaagacggttctaatgcatggagagaaggggaaagaatgtaaagatgcagttaataaaaaaataatacctaggccttctatttttcttagctttggactctaatctcagctaagatcagaaaggaagttagtctgatgtgctcaaacaaatatacattctatctgttcaccaaacaagaatggcagaagcttttatcctccagagaattcaacagcatgaattagtaattaggatattaaaccaagatcaggactgaaggttcctgaaatctgcctactttttaggacaagtttttatcttattgaaaaagaaatgggaactatctctagactttgatatctgattatatttcaggctcccctttgtctgtaactgtgtttcccttctcaccatggtcatgcttgctttttccctcacttttagaacttgctttctttagttggcaagggagtcccttcctcatgtatactactggttccttcaaactagcatcatcctttgatgctttttggactttcataggaaccatagatttttcctgggaattctctatgctcatctaaattttagatatatggaccaaactacagacattaatattttaaggaatcttcatgataaaataaatattaagaagtcatgggtaagaatagccagaatggcttgtctagataattctcttctgcaatggttatcgaagtgtggtgtgtggattaatagtccagcatcatataggaacttgtaagacatgtggattccaggacctataccagacctactggatgaaaaacttgggtggcagggggttgactagttaaagaagtgggtggtgatttttgtgaatgctaaagtttgagaatcactcttgttctattgtatcctaaccaaataataggataattaacactaataataataataatagtgtttatcagttctaaaaacacaattattttcccagttagcgaaagcaattttctgactgttccaataaatcttttatcattttcagaaccatgtaggctactacttatccaaatcttctagtaaagaattaagcagtttcatcccaggatttaaaactgttgcactgatctcaccatataggaatagggggcattagcgggataatatagggacacctgggccacagggccacagatataaccatggaggttagtcaggtcagcacttcagtctctaaatctttcccctaaagttgtccatatttttataactgacttttctcatgtcatttttccccagatacctttatcaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccaggggttgctaccaaactttgtaacctcaaggacaaaatgaggaagatgtgttcattgtggactctaaaaacaaaacaaaacacaaaatcccctgttcaaataaacaaaaaatccaagattgattcatgaaataaagaagacatgaattgttttaagtctacactttgtaattagctaagttgtgcagtattttttgacttaaacagagtatgaccctgaaaaataaaagaatctttttttttcaaaactcatcctacctacctgtaaaaactgtacaaagctaatgtatttttcatattgtaaagtttcaattgtagaaacaactggtatgtacagtaccataatttaattacattttactttaaaaactttacacatttcagtttctaaaattttaaattaacaaaaattatttcttgtgttattcagagttactcagttttgtaaggactgttttgttactgcttttgtgcccagaaaccttgactctaaaattctgtgctgtgcgaaacatgcacgatttttattatgcttactgcgtagaattttatctacttgttccagaaataatacattaaccaaaaaggatttaattgttcagacttgtaagaggttcttcaattacataggcaggtttttcttaaaaatgaaaaaaaaatcaaagatttttttaacagttctcagacttaactgttgccttgaattacagcctagtttctaagcagtgaaatgtaatgataaagagggatattttaacatatttccgaatgaatgactcattatttcattcttttgagtaaccattgttaagggttgggggaaagcatggacaaaacatcactggaaacaaaggctgtaaccacagcaacagactttgtgatacagttaaaaggtgcagctgccagtgacaaataaaaacttttgttacatctcattattttcaggccaaggtgggagtatagtgcataataattgtacagtagcaatttttatcctaattaacccatagcggtttacctaaaagtaaccatcagtcagtgcaaaatgtgcctggttcttaagacaactttttatttagaactgtgagaccggtattttggaaacatttcaaaggaaacatatgaatttgttttgcgttgtgcactacatcatttctctcctgaggaagaattttaaacatgtacagctcattcaatatagatatgagccatggtggagaactttatcactcaagtagacggtaaacatccttaatatgttctaaattgtttatattgctatccataatgggattcacctccaaattatcaaagaaataactcagagtaatttgacaccagcccagatcatatattgattatacaattgtattataaagttcattcaaatcaaattaagaaaacctgagtctttagaagctgaaataatcaacttgtttgtgctgtttgcttgacataggttattgtttgaaaatattgttactttatcaatagtaatcatgcattcttgtgtttttttttaatggaaaactgcaagtttcaattactgttgcactagaagtgctttttatgttgtcattttatattcatgccatcaaaagtagattgacaatacatcaatctaacaggggccaatcaaaacaatgaagaaaagaataactgaaaacaatgtcaaacttttaaatttttatctcttccaaagaagttatatctataaaatctagttttatgcaggtttgtcacagcaaatgtaaaagcggattcaagaagaatgaacttaaaaactgtggagcaaatttttgttgaaaatatataaagtcagaaagaaaaaagatgtaaatgttggaagaagcaaattctattactaattcaaatgaaactaaatgtcaaacacagtacttgtgtcaactatttagcatcccagattttgtaacatattttgcataaattatttgctcttcaaaaatttttgtcattttaaatctaattttaatctttatgttttccattttctaatttccttgcaatgtattattcttattcttaattctctacattgaaatttggctttacgtcgttagcaaatttataaagggttataaagctatgattcgtgagtctaaaatcaaatgcaaaattttatttattatgtaaaccaaaatgtcatttgcaagttttctcattagaagttatccttgcaaagatagaaaaagaagaattaatttgtgtaaacaagcacaaattaacatatttgttaataaataggtttatctactaataaacctatttctagacacattcaaattgataatgatttttagaaatgttaaggttccaaggagtcttacaagtgtatgcccttgatttcctgaaggaaaccactttctttcttaaatattttaaattcatctaaagtgaacgactataaatagaagcaatcaccttggaaccacagctctgtgcaaccaaggccctaagctacaccaaatacgccaggaattttgagacttctcatctttaaattcaaccaaaagggtctttagcaagaaaaaaaatgctggatgatgattattattatttttgcttaatttttattttgccatgtccaggttaagggtgagggtggtgacaatctgaaagactgtgtctggaatctttatcacatatttccaatttatttcagtttttgtctaaaacttgcatttctaacctatcttttccagcatttgataatctcccatttcctccttctaacccccattcctatgtctcccttcctgtctattcctcaccgatttaaacaactgaaatgtttacttatgtttggagctgaaaaatggaaagtttcacccagcatggttacaataacagccagcagctgcagcaaaccataaagttatgcagtgttttgaagttcacaaaccacattttacataaattatctcattttgtcttcataacaaccctatgaagacacattaatctcaaagaaattgagctcttaccccaaaacacagggccaataattggtgcagttgaattattctcaaaatttacaggctgttagtctttccactgtactaaaagatttctttctctgatcagagcaagagaacttccagagataatggatagaatgaaagaatatatatctatatatatttgacatgttgtttagtaatccctattttaattcaattctccatctgtaaaatattagctaactgaattatttctgtgttctactctgggctctcacattaaaactctgttcaaaaagtttaacaagtcacatatttcttaacatacaagttcgtttgtgaatgtgcagaacagatgctcccaagatgtggatgcatgtaggccccgaggtacagacataaaatcaaggaagcacaaggaaagaaaccccaaggaaaaaaccaaagaccttctaaattgagactgcataattataaaagagatccatagtacagggttgaacacatgttcaacactttgtcaactgaacacatgttcaattcggagctaattgggaagacttacataaaattctttttctttttttcttttggcaagatttcttcttaaaccatgaaattttttttacttgtaataatagagaacaattttctccattttcttataagaaaaataaaatataatttatccaaattgatgtatagaacctaaaacatatgctaacttgcaaataatatattttactgatcaactcatttttgtcaagtctctatttctagtccctcctgaatgttttggaaaaccacaaaactatacagattaatacaaattacatttttacaaggaaagaaaacattcccaaatttaacactcaagactaatcacataatcctattttgaactcagatctctctgactccattgactgcttagaaatagtaaaatctttttgaaaaaaaaattttctaaaataaaactattgtatatgagagtaaaaatatatttgtttttgattgttcctgactagaagacagatatcatctctcaaactaaacactcaaaataagaaattgaattcatgaaaaccaatacctgatgtgaattgttgttattcaactgtataaaagaaatgcagatgttctgggtatgtcagagcatgcgaaagaagaagttatgggactggcaggtatttggcctcaggagaaaaggtgaaaattttccagaatagatataataacatcttatattggcacagctcttaacagtttataatgctgggtaatataacaatctcctaattcatcaaaaagtctcaaggtgcagatgaattggtcttgcaataagaaagagcttccaactcctcccatgaccttcccaattttccccaactgtctctaaatagggaggcgccaagtacaaaggacccaggagcaatgctttcaaaattctgatttaccccaaaggtagggtacctggacaatcaacaattgggcttcattttatcatcaacattaatgggaaagaaatgtttaaaaatttaaaaccaagcaaacacacacacgcacatcaaagtggtgatgagtcttttttgaaggtctctcatgacttgcattatagttttattgtgagataggaggcaacttatatttaatttatttagggtaaatttcacattttaaaaagtccaccattgacttttttattctatgaaggacagtgatcttacagcagcagagtgcctcaaccatctaggacttaggctactaagtttcttcctcctagctctcatttataaattttgtgttatatgatatttgtcttcctgaaaaggtgagtgaaaatttattttgtgtaaatcaaataatatttcaaatgtatcaagagaccttgtgataaaggaaccttgaaattgctttttaatctaaaatattacctgctaatttatcttttttaaattgatttccatatatcttgtgttattataacacagcacacttgtactacatggtttaaaggttctgcaagacagtcttttcctcagtctataggaaatgacggtctgattccaggttttgagttggtcagttgagcagtttcagtcatttccacttactgactttatctggattaatgtggaaaatagtagtaagacaacatggatggataaatttgacaaataattttatttgtttaaacttttgccacctataatatccttgaagttactattaagaggtcaagttgactccaaatcccttgtgtcaatactagatttactgaatcagaaccactgggatggatcccaaaatatgcattaagacatgactgaggtgatactaatgcatgctaagttttgaaaaatagtgctcaaatgaatttatttttcctaaatcattcaattgctttctattctaaagtaaaattgtgaattcttgtgctttcccatatcaatgtgaatctagttttctaagcctgactgaacatttttcttgactgaggaaagcataccaaaagacaactatatataaaatgctcaggttgcttcctgacagactgttgtttatagattttattccccattaactctttcgagaggcatatctgaaaagtcttaaggcttctgggttagttacttgttagttgcacccatgaatataacaactgaaaagctggaagtggggagaaaggcaggaagtaaattatgatgtagcaggcactatgccctcctctcatttttaaatcattttaggaaagaagtataaccactattttaaagaaaggaaaataaggctcatagtaattaaataatttgccaaggctcacacagtggggttgaagattcaaatctagatttgttaggctctaaggatgtgctcctacccccatcatagcacattttcaaaagtgagaagagattataatcaacataatgaggcttatatatattattctgaataatttatacagaattatttattctgtattcagaataaattcttattctgaacacagcagaaaaagaatttgcctatttccaaatagaaaaattatcttacactgtgtagagacttccttcaatatcctaaaccagaggcctaatggaaaaaacaacaacaacaacaatattttcttgaagttttatacatggttccctaaaaagagtagacatttgaaagaaaaatccttcaaaacataaatacccttgaatattgatgtcatatttttatttccaatcatcttagcccttttataaatttacagccaaaattacagccaaaattacagccaaaattgataaagaaatatcaataatataaccttcaactggctgaaaaaaagaggtcaggttgccaattttaccaaaaactatatggatgaatggtcaataaagtcaccaagtacaaatgacaaggtggagaaaaacaccaataatctacagtcgcaaactgtagcaatgacatggcttgagctacagaatatttcctgtgagtgattttaaatggcaatattccttataggagtattataacttacacagatgatatgggatctggaagcatactacatcaaaagaggctgaaagataacctttataataaggcagactctacttgtcctactcagaatgtaatatgtagtttaaatataaaataaatatcatttccttgtttcattacttcgtggagatggacaaataaaattattttttgaaacttatttttaaactcacatcttgaaaaacatcttcctcagtctcagctattcacaaatgattcttaagtagactctcgactccattagtgtctcaggagctttttattaaaccattgagttatctcttctatctctccctgaactccacaagtgcaagtaatcccattggtttaattacattagcattttactccatcacaggatctgaacatatagcatccatgaaaaacatacttctataatacacacagcattcaagagccagtaaagcactctgtaagtcatgcctcctactaaaaatgatcacgtctataactgtgataaaaactaggctataaatttaaaacaataaatccagcaaagaaagaaattctagcacactggatctaatatcattgtgtcttctcattgtggcaccattaccaccatacagaaatgttatctgaaatatctagaataattctgattgtggacaacaaagatgctcctggtatctgggttgaagatgtggtaaaaaacaacaaagaagacaaaaattacacataccaaggtaagtgaagggcatgtgatttattattaaataatctgccagtaattttaaaaactaagacccattattaaaatttacaataacatttatgccatcaagtgtcatcataaaggctaatgtggatatttggaatataagagaaatgtggtatttgtgatggcaatacatattaaatgatagatagatagatagatagatagaattaattctaccaaaagagagactattaagaataaaaattagtccaagaactatttctattatttctctagagagaaactgaatagacagagaaaaagatttaaactaaatgctacatgttctttccaaggtcaaatttgaaatagtccaaaactataaactcttgaattgctgcttcaaccatatgagtaattacattaattcacatacaccttgtcaaaacctgatgttgagaaatgaattgtaattttaaatatactccatctgttcttgctgttttacatcaatgatatatttgctttcaattacagatccataaatataatgccctaaacagtctgatgaaaatgtggtgaaagattggtcaccgctgtttttctgttctaccataaggcaattatcagagtggaatggccaccacaatggggagctggaaatatgatttttaaagtcctctctagaggtcttattttatattcacttataaattaagaaaattattgccttgaggcaaaagcctgagagcccataccagctctagtctgactacacttacaccagagaggtctagggaaagacactgaacatctctgaacttgcatattatctggagaaaagactgagatccttgtgatgtcaacatttttccgcctttggatgtgatggaaacttaagttcagtgtattggacatccttcaaaactccctgccagtttcctctttaacaaacttcaaacctgagtttcttgagccaccattggctttgacacgcagctatttaataatgaatccttgttacacttcatcattttgtggaagaattacacaactggggttgtagcccttagcggcttttcccttgcctttggatccagttatgggataaaatgtgtgaacttgacatgacacattggtactaccacaggggtactggaagaagagccttctaacagataaacattttatgtaatataaaactgaaatgtagtttggggccacttctttttaacttaataatctgatatagttttcagataactgcatgcttttctgccactgagaatataaatactattgtctgtaatgaaaacatggttttgttgtcatatactttcgctttctgaggacagatttcagacaactgattgtgttctgtaattaccaaaaagaatgtctatttagtttcagaaagaatggcttaatgccaaacactttaagacaaaataacaactaacacttactgaatgtttacttttctaagcattttacgggtgttcattcagtcaacattaatatggcaaacagaattaataataatcctatgaagtagatactattgtttttcccttagaaagataagaaacggatgcacaaagcaattatataacatatagctattaaattgtgcagcaaggattcaaatccagttgactgatatattgaaaaactgacccctctaactgctcatttaaggtccactgtatagaccccaatgctaagttcaaaattctacctatttaaggctatcactgaagacattttttcaatataattaatgtgtttattacatacctaatatatgcctcttggaaggtaagaaaattttagagatacatgagtatatgacatagtccctgtgcccaagggacttacagtcttagcaaagagaaaagacatccatattcaacagaaataaaattcaagaactaagtttaatacctgcaatcataaacagcagttaggagaagataaaatcaaagttaataagtttgttgggaatatctcaaggcaaaagtgataaatgacatagaacttcaaactagcagtgaattcagatgggcaagacaaagatgagagggcagtgaagggagaatattatatttttatttactaacatctattattccaataggatttgttaaattcatgcttctctggaagagaaagaccaggctcaatttttgtcctgattgcctaaaagctcagagccaaattaaatctcttggcctttctaggcaagcctacatatttcccacatttttctgaactctaattctctttacatttctattttatcttctttgaggtgggggaaaagaatattaatcctttgtttaaaatgttatgtcagtttcaataaaatgttcatacaacattttgaagactgatccaggcaatggcattaatttcaaataattatgtgaattaaatcaaacaactttttagaagctaataattgtaacatcctccaacaaaatactgtttggcacaaatgaaaacacggcctttagattgattgactttttcttttcaacctttttagtctttatgttagtattggtgaatattaaccagaatttttatttcaaagagtaaaaataaaaatcatttttgattgctacattttacaaacaaacaaactacagtagaatattattaaagaccatgatcaaaatcatttaggtgatagtgagacagccaggtgtgagggggtccctggcaaaactccaaacaggtctgcacactgggaaggtgcactcgggtgcagtcacacagaggttccagtccatttgcagcaaggaagagcctggcccctcctcttcctgtgtggaacttgggattcaagcggccaagcaggaagtgctctagcagggactctggccttgcggagagtccctgtttcccccttttcttccttttcacccaataaaaccctgtcttactcaccattcaaattgtctgtgaacctgaatattcctggccatgggacaagaggcctatctttagctgaaataaggaaaagtcctgcaacaatagcaaacagaccagtactagaatgtacatttacttataattatttttcactagagtgaaatatttttaatttatgaatgcactgacattaaagaatatgcagaattatttctgccttaaaagtataaataattgtcagtaaagttgtcatttaaaaagtacagtcaaatatatatatttctaatctgaaacatgatacataagaagctactttagtttttttgaatttttttaagttgagaaatattctcttcatcaaattctggacaattaagttacagttacctctgtgtttatttggtaggtacaaattttcattcacgggtatttgttcaatgtgtcttctatatattttatactatataatgatattttgatatttttaattcaaatcaataaaataagcatttattcatttttattatggtattccagtgactatgatgtgagacacagtgatcaaatgcttatagtgaataaataattgtgactcaatgtgatatttctaaaaatgaagtctgtacatgatgctgtgaaatgattgggtttgctgaaaatcagaaaagacctcacagagtaaatgctacttgagaaactttaggtttgccatttataaaactcaggtctgtctacaggctccacatccagatcctaactaaaatttagaagtctttagatgtctgtggatattatcatctggaaaactgggactctaatagtttctgagtctagtattttccccatatagctactcagttttttctagtatatatgtcaaataaaattttgaaaaaattaccccttcccacaatctttgcaaattaatcctcaaatgaaaaggatttaatttagctattccatgataaataaaaaatatgcaattttattgaataaacttaaagtaattaataaattcaatgtactgtcagaagttttctgttttgttttgtttttaaaaatgtccattaaaatgctacctatgtgggttaaaaagcctataatacaatttctaacttcaggaatatgtgacaacatgtagaaagggtatattgggctgtgcaatttaaattttcatcacctacaggttatggcataagactgatatgaaaatgaatgagaattaggttatatgtagagtcttttgtcttttgttctattactataaaatatttcatttaaaaagtagggaaaaaattactaaggtggtgaatttgcctgatataccaataagcacagttgttttggaagttgcttggtaccactgactttttgcttctttaaataagtatttctttccttagcaaacacttctctttatgagaataccattactctcaaaagattccaatgtttattttgtgcttatggcactttttaatttaaattttcaagaatgcactttgcattaagatgaaccaaagtagtattagtgaattcagcaaccagttcaaggcatagttttctgattttcctacttaagaaaatgaaggccaggcgtggtagctcacgcctgtaatcccagcactttgggaggccgaggtgtgtggatcacgagatcaagagatctagaccatcctggccaacatggtgaaaccccgcctctactaaaaatacaaaaattggctgggcgcagtggcctgcgcctctagtcccagctactcgggaggctgagacaggagaatggggtgaatctgggaggcggagcttgcagtgagccgagatcgcgccactgcactccagcctgggcaacagagagagactcaatctcaaaaagaaaagaaaaagaaaatgaatatattttaattttagaatttcagaacatgtccgtattaactcgaagaaagttatcatgaataatgctattttaatgaatgctgagggaattgtgcctaatattctaaaatactcttgagaattatgaagagtgtgcagtatggcaaaggcagccatgagaattcccaatatataaaatgtatactgtattcaaataattatttctcaaaagtataaattttcactctagatagttttctacagggtggcacatgctatgtggtagtaaatgagcctgtaaaactgaactcattagacaataactacttctattaaatacctaaaacacccttaatgtgaatgttttgaatttatttttatatgtgtagagtctataatttgttagtgactataaattaaattataacaacctttagcttttttaagtttcacaattgttctgtattccaattaagaggctcaaaatctagtctgggaaactccacttggcttacaaaaaaaaatcaatatgctttttatttcatggggctctgggattgttaagattagcatgaaatactgacatttacactcctgagtggactagaaggggagcaggatggaatgatgatggcaagtaattggacaattggacagtttccagaaaggctttaagaaatactattaaatctccatctgctgattgaaaattccaggttcataaggtataacaatagctgaaatacaagccttagatgatctctatctttcctttgcaggtttgtaccccacctactttgcaagaacctgtgacaattttttaattaaaacatctgcataattaaacattttaggctaatgatgacaagaagacaggccatattttattacttttgttgaactgcccagtgtatattacatttgctataaattaattactcaaaatcctgccttgaaaatatctgttataatttttaaaaaaagaaaataaggaaaagagaagaaatagattaaaaattaaattagggtcttacacttataatgagatggttctaaggaggtaagacttaacctaaataagttttcgttcctttgaattagtggaataaatacatcttaaatttctccattccattaggacagatcacaggtgaacttggtgagggagtaagcgaagaacagttagagttgcagggtcctaaatcaaccacagggagaataatatattactctgcttattttactcttcctctcctcttcacgtttatgtcttcttcagtatttccttctcagtttgagttttatatagcatatgacatacacatatgtgccaacacaatgtgagtgacaagactggaagaggaaaagcttacattaatttatcttgaaaaatgaaatgtccaattatacaacattatagagtgctaatagctcaccaaataacataaataagattatatttcactcagtgccagacctgacaaccaaacctaggttccaaagtaagcctttctttttatcaatagattgaatatactagaggttaagaaaattcacataaggccgaatctcctctttaaaaaatcctttggcatttttcataaaaacagctctttgcccgtggctcaatttaggactttcacaaatcccttgaataatgaaggtcttggttttacatgactgtttatgtgtggtattctatgaaaggtccaaaagcttgttaaggacaattgctaaaaaaattaaaatatatcaagattatttttgtcaaaccaatatgtgttagaaagttatctattgaagtgtattccatatacttaatataatattattataataaatggcaagataaaaagaaatccactacaggatattcccatttctctccagagtcatggtatcaacagataacacgccagtctccccaggataccactataatttaatacatgcaaagtatccatctaatttacctgttactgatgaggaaattccaaaagtaagcttctcatcatagcaaatcctgaagaactagcatttaagctatttcattatggggtgaaaaaaatcatcatttagaaataaaagtaccaattagtaacaaattatgtacaagtcactctagcacagtgtatttcaatcacttcagtaatttttagcctcccaaaaaaaagtgtcagaaatgaggcatgaaaagctattaaatgaatcattcacacgttgaatagatgttgtcgtcagtttgttctctcaatggaaataatgaacaactgatttatttataactggtcattatgataatacaccttcatgttccacccttttcaatatattatggatatgttataactgtcttattttatagctgatctaaaatcatatgcttccattaaaatttcttcttttccaggctttcccttaattttaatgttcctttggcttggggtgtaattaaaatgtttttactgacttggttcccttgtcttttttttccttccaattttctgtctttttgcctggtggaatttatccatatcttaagtgtatgtaactagagtctgaaatatgaattttaagtagctgcagaatacatttatgtaatcactataaagtggatcttgtcagcacttatttagtcaagtttaccttgttttccttctgagataaaggtaagcagaatggataaagtaagataatggaagctgatttgtatttcagagaaaaaaattcttggtcttaagagtcaaggcaagaagacttcattcgtttttcattctttttttttttctaaatttcagagcagagaggaacatttcccttgaatgttccagttctaacactgtaattaattttgcagggttacattcaacaatttgtatgttttgctgcataacactctgtatatgcactggactctgccctcaatctgcactgcaggtttatataggaaaaagccttcagggattttcttctacatttaatcaaaactctttttgagaaatacatccatcacattatggaatatcattttttaaaaaaaaacatgtgagtaatgtacttcagagctaggtctggaaaaaagattcccttgggaaatggttatgcttcatccccagtgagtactagaggcctgtaacacaacctgtcttctctatacctttgctcagaaacccagaactgggttacattcgctatcatggtgaccatgttaagactcccatggagtgtcccagctttctcctttgtaaatactttttatatactttttctaatcctgttttgttaatcctatatcatatgtcttttgtaatatgttctctgaaattatttagagagaagtaaaaggtagaaatgaggaaataaaccagagatactattctttaaaagaattttttttatttttactgaaatggtggcattatcttaactttaggatgctaatttttttcttcctaacatcatgcccacgtaccattatctcatccctgactcatcttttaaaattttagttcctttatttgcaatttacatataagatgtgtggaaaaacccacagatacacactcacacagcacgccactcttctcatatgctgttgttcagacataaagatcactaagcaaaataggagataacatttcaagactttctccactaacagaaacatattctcaggtgatcggttagagtccaacaaggtttattttcaaaagagtcagcaagcgttagaaatgaatttctcaacaatttttgtttttaagagacagggccttattctgccacccaggctgcagtacagtggtatgataatagcttactaggctgggattggaggggcagacaggcagctcagaaaaagagatttaggctatcagagaaggtggaagaataaatgtttggatataattatcatggcttattatctacaaggtggaatttggctaactttgttaataaaacaaggtacaaatcatttaatgacaacctatagacttttagcttacatttagaaaatacttaaaaagaatttttccagcctgagcaacatagtgagatccccatttctacaaaaagttttttaaaaaattagctgggcatggtggtgcacacctgtagtcccagctactcaggaggctggggtgagaggatcactggagcccaggagtttgaggcttcagtgagctatgatcacaccaccgcacttcagtctgggtgacagggggagaactcaaaaaaaaaaattcaaaacagatattagatgcaagaaaagaaaaaaaattaatgtatatcaaaatattaaattctgttcccaattattatataattcctatatcaccaactttctttgaaaattaaagactgaatttgtaccaatgtactaattatatatctataattggtatatttaataagttaaaattttggaatataaggcctctacatttacattttaaaaatattcttagacaaggttctggattatatttcaattctgttcaaagagtaaaatggaaatgtaaaaacagagatgtctccttaacagagtgaaattaatttacaaatctaagcaatataaaaacatgagtaaaaatctaatttaattgaattattaatattaaagctagtccacacaaaatgtatttattctggagtctctgtagattttttttattgtttttcctgctgccatcaacttttgttatactataaatatggatgtaactgtacctacataactaccagcacacacctaaaattaaataagaaattttaatccagtagttcttaatttcttttctaatcctaagtacttaaagatataacacactattaataaatcaccatagtgatggttcttaaaggtgtgtgtgtgtgtgtgtgtgtgtgtgtgtgtgtgtagcatgtggggaaggtgtcctggagaggatacaaccttctgtgattttcctctgctaagaatcagccctgaagggtacaattcaattacctctttttttaaaaaaatctcagatcttggcttgggtctgaagcatgaatcatgtggagtttaatgcagctttgggtcaaccctgatcaagaagaccccaggaagagtgtgggaaaatttaaatttggataccccagaaatgggattatgtatctaagaatcctatatagcatgtcttgtcgtatgccatttgtgtcagctcagaacttccacagttctttcacaagctcagatcatatctcttggagccactttggtccctacacaccacagattccatctctgggctaatatttgactaacttcaagattatgtcaacactgtctatgcctcatgcaaaagcctcatggaagcaattaatctaacaacagtgcaaacaagacgactataatcacccaggtgatcatgaaaaagaacatgagggaaataaaaatgagatagacagattctggaagcatgctgtagatattatgtttttcagtaacagatttggggactgttgtggggttgggggaggggcgagggataccattaggagatatacctaatgctaaatgatgagttaatgggtgcagcacaccagcatggcacatgtatacatatgtaactaacctgcacagtgtgcacatgtaccctaaaacttaaagtataataataataaaaaaataaaataaaataaaataaaattgatgaacatgggtgctacatgatacaagtatcaaaggaatttcagacttgagtaattctgaagcccacaaaattagccacaggatttatcttttgttcttcatctactagaggaatggatgttacaaaccaatacaatgaaattaaaaataaaaataaaaataaataaacagatttacaccaaaacttttaaagaaatttgtgataggaaatggttaagagggtggggagagagggcaaaagttgggtcttcagatcctacaagcagaaaggggctctcttttaggtcagagctgatctttagttgttttgtaatgacatttcatctgacacttcctaggccaaatatttaaatagacacctctaaagaagtttagcaatttgatcctctctgcttgctcatttatattatttctttaagttacatttatgctcagtattcctatgcttcataggtatttgacaaaaaaatttaaagagttattttttctttctttgtttttttctttttctctagcttgctaaagaacaatcagccagatccaactagatgagtcaactattccccaggcataactcctggggtcatatcaattgcatttgcagcagtggtataataatttactataaatgtcttaaattacagcatttgaacacgtgccaggaaataatacttttccccaaagcagatgaatcatgaacctgaaatacataatgcacctcaaaggcatttaaaattcttctaaggagtgacttattcagatgatagaatgttgaccatttgatttgagtggtgaccttccaaaagcaatgaatagcatttcaatgattttcaaatgttattatcaaaaataaagtacgatagatatataaaataggtaaatatagaagcttctctagtaatgcctcccttgggaggtagggagcctgggaaccaacttcaataagaatcttggcttctctgcccttagtttttgtagaagggcccttctcatatgtagaattttgcctctccaaaatagctcagatatctgtgagggagtttggttgaatttgagagtctgagagcaagtgatattagataaagtttatataaaggctacagtcaacatcacagaacaactcagtttatttagaacagccagttgaaataaatctaaggatcgtagcacctaaccatctggaagtcagttttgaaaatatatatatatatatatatataatatataaaatatgctttatgattttgtttatgtgatttaagtagatctatgagataagtaaaataaaaattaaaaattctatagctttactttatatgtgtataaacacacatgtatatgcatatatattgttgagtctactaaacagtgtgcttctagatttattcatgcattcaataatatttattgagaacttactatcttcaagacactattagagatttaaaaaataaattagatatagctgatggtgtaaaagaggcttaaatgtgattcatctcaaaatcatcagaataaataagacagaaaattttaattactggtagtaagaaacaaagatgatgaaaacctaagccaggctgccatgaattgaacaacagagaaaaacagccctgggtctgatcagtttgaccttcagcaatgtcagctcacttctttgggattctgcttctttatctgaaaaataagggaaatttaaccatgtgatcttcagagtcccttctggctccaatatttaaaaaaaaaaacaactatactccataagtatgatttaaaccagaaggttcaaacctcattcttcacttgcgatagcttcgctgatgaataggaatgtcagccaacattccatctcctttccctttcctgttccagtttgatggaggtaccagctagcaataaaatagcattgaggagttgggactcacaaaaagaattgtatccaaaaccacaatactgtgactatggaattattgtttctttaccctaacatattaaaaatagctgatgaagaaaaacaatgaaaagaagactgtaaacaagtcgaatttcagaaaatacctgggagacaagtgtataaatattgtttgaaatttttttaaaaaatgaacattcaagtatttcattcagaattttttaaatgtgcaaattcaattataaagccatggtgatcacaagatacaaggtaaagttttattattaatttgaaatgtcttggtttgaaaaaagtttgatagtaaaatcaaggttaaatgaaatatcatgaagctgtgcaattaggttaataatgaggtgcctcagggatcagtgctagcacaggtgttcagtatatttattaatgacttagaagagttctgaataatatggaagcacatttggatgacttcatagatatttatagcaatcaaacgggtaaatgactgcttttcatgaccgattcaagagcaattatttaacacattacagcaaataatcaacaagagcaaattaatgtgaagtgggtggaattacccaagttttcttagcatgctaatagctaactgaaatagttattgcctttcagacaacagtgggcgcatctaagacatctgtccagtaaacagcactttaggaaaaaagcataatcaataaaggttggaataaagaataatgcaaaagaattatctaaatcaataattattgctgaaaatttctacacaccagagacttgctctactgaatggcactgttggaaaagagtgtggtttcccaaaccacatgctaggattatctggtgtcttagctggtgattttctaagtagttttccattatcatccattcctctccgatatccattcactggcattcccagatgcctctcaggcaggaataaaacttacaaggacatgcccttctcacttctgctttgctctgttctaaaggatttcattgatattaacttttatgttgaagatctcaaagctttggaaaaattaaaagtcatcccttttcacaagaaagatggcataacactattcaataatagcatgaactctattatatcctccccttatcccaaagttaattattgtgcatagaaagaaaacttaaatgtagcatcatttcagttataattcattcattccaaaatattttctgagtgcctattttatctaaagcacagtagtaatagaataaaaatgatattaataaaaatatttggagcctgccctaaaaacttagaaagccatgtctcccctctcatgaactaagcatttctcaatcctagtccatataaactacacataaatgtcatcaattatatcataatttgaaatatatgaaaattaataagaatcagaactgtttatgtagaaatatataataacatttttaaccaaagcatcattttccgctgccatttatcttttgtaccagagaaaatattatgaaccctgaggtaaattttctcatatgaaatataacttagatacttccccaaattttagagaaaaatacaatttctggactgtttgggactaagaaagtaggccaatataactggagtaaagccaaatactaatgaaaacatcaatgtgtgttcatattagctctacaaaataaccaaccagcaaatccactgacagaatgaagatatgtgtgaagtactgagagtgagaatttttctttttctttttttggaagatttggtaaagcatctctattctctatttatgtccacctgcaaatttcagatgtaaacatctagagtaatataccatgatcacataagaattcacagactttcagaatctcagtgttaaaaggaaactcagacgttaaccattgtttgagctatacatcttctctacatcactggacatactactaccggagataaaaaaaacatacacacaaaaactcattaattaaagccaaagacttgcagcgaaaagcaaattttcagcaattaagtaaacaatgaacctctgttagaacctcaaacatacttactaatgagatttaccagagggtctggaattatctatttaaaatataaaattacaacttggagaacaattcacttatcagaggtgtgacaattctgttaatttttctttctaaatcttttagtatctatgggtttttgtgcagtgtgatttaaatataattttagtaagggaaaacaagtagtgaatgagaattcattaacaggtggtcaaatgcaaagagtctatcaatcatgctggtatttttaaacatcagcaaatttaattccatctctgggggagtaaactcattctctaaggtatgtgacacatcgtatttatttttaaaggacatttcagagtgttccttgattatgaaatactgcaagtatttcctgccttaggtttcctaggcagacaaaaaggcaggcagaatccaccactgcaaatcagataattctaaaataaccaaatagtgtttctaaaaatgagaacatttccatatcttagctctagataaagagatttgtcatggtaaaaccaacaaatctgaatcagaccttaaactatgaaatagcacacaagagggatgcagaattttgtgctgaattacaaagagaagtcagatctgcaaatccacaatgacataataattaaataaatttaatcagcttttactgaattccagtttttaaatgtcaggcaattattatgaaatgactttttctacttgcataatccattgtgtattatatttctaccctgaatcaagtgaatgacttgttagtttgatcaaaaattatcactttatactacgagggaaagcaaccatcttatccaaactacatggcattagactgtataagcttcctttggtgaagcaagatatatatattgattttatcatacacatagactcttcaaggtcaaatagcaagttgaagggagaagaagtatcctgaatgaccattaatgctcttctataccatggcttcaaaatcttaaaatactttgcatttcacaagaagttatgtggcatttgaaaaccctctgaaatgaaaagaaatttctgatccccaaatggagtagtcaagaaaattgagcactttccagaaaataaaagactcaatatttcagggcaccctcctgcatgacaaggagagttacaaaagagaaaagccaacaaaaacatctcacctactgtatatatcttgtttattgcccattttcttgatgaatattataggaacatacagactgataagattcccttaccgtacaaagaaaagttatcctgttttgtaatgcgtaagtctttcctaaacacagagactgaattttggttgttattctactacgtggagaaagaactgatgttggtgaaggtgagttgcaatattgtaccattaacgtataaataaagcatgcccattgctggtagttatcccttcccaggtttcaaataggaactgggattttaaatatttcagaaataatttcttctaagtctctattgtcattgtatctctttcaattttaccacaccaatgatattcactgagcaagattccaaaacctttataaaagcattcccttgaataacaccttaaatcttactctgttctaaatttttaaactaataatagtttatctgaactctcccaactggtcaattctgtcataaagctacataaaaaccatcttccgtattgcagattatttttgaccaatcgatggatgaaattttggctattcttgttaacagtgtctcagtgtaagcattgttgtagttatcagctttgtaagaagtttatggaaatgacagaagctttggacatgtactcactgatagacaccagaataaatcatgaacaaaaccaatttgatagagaatcaagggagtcaaactgtaaatggtaatggcagattacccagtgcatgggtgagacaatggcatccaaagagatggttagcctctatatacctcctccatagaccatgtaatctgaaactcctagccgttagattcattcctctaagataatggctgcaagataaactactttagttgaaagtatcatgtttggaacacactattgagtagtataggataactttcagtgccccgcagtgctggccacagtacacgtaagttccaaaaaatcattcacaacctcaagtgttcagagggtcaagcaagtactgggcatgaaaaaataaacaggcaagtgctaatgtcaattgaccagcagcctcaatgtctgcaaaacaatagagagcagtgtaaactgaggtaagcccttgtcccatctaaaagggacaactaccactgatctccagagaactgttgccaaacagggatataggtccatatcttccaggttttctagagaggtaaaaaatctgaattttttatgtgaaatctctaattttcaaatgttagaaactaatttaattgtgtagcacgctcttagccaacattattctgagcaaaaaaaaaaaaaaaaaaaaaaaaaaagctgagggccagatttggccaacttgttggcaatttcctagaatgccagtcaaggacgtgaagaagggagattcagttgggatgaggatgagttctagactgtcaattaagagaccaggtaagggctatagatagcgtctttcctaagggaaaggataagcaagcagactctacatatgaaaacctaaatgcagtaagccacttgttatgaatagtacattttaagaaaatgtacattattcatttttttaaaaaaaggtctttttaattattttattttctaactttgtctttaccctttgtccaaaaaaagatttacaataacataacaaagtcttcaatagaataaaagtaaaaataaattatgaaagacctagaagaaatgatgttagtaatagtaacctaaagtacaccaaatgcacgctgaatacagtcaaaagaacaaaaatctcattagccattaatttataaaatggattattatctgcatggggcgggggaagatgtgtccatttgcaaagtctattttcttttttaaaacatacaatttggtctgtggtgtggatgaatctatcttgttcataactaatacagtaacaaatgctgcatatcaaaacaaaggagcattattacttattttgactctctagattatttgtttccagatttaaaaagcattaagggatgtctttgtgagccaaaatagagggcagaacagatcccttcctacttaggattttaatactcccttgcctgaaagggaaagatttttcaataataagaaaaggcaatgtgagttacaggagcatcggtctgatgaggccatatacaggatatcttaccatcaatattcctacctaatgtgtcagaattgtacagctcttttttaaaaagccacattaataaaaataagcacttctaccaagacaaattgattgttgtttgttgttactctaaaggaaaggaaaaaaatagggctgcagcagtatcagcaggtaggtattagtgtattctagtctaatttcaaccccaaatccatactattaaatacaatttggaaaggctcagctgttagaggatcagagtatgtgcagcccatatgtaatgaagaaacactcctgtaaatcagtgaatgagcaccatgcattctgatgaaccaagtatagaggctgaaattttaagtaggcaaaaagctttctctccttacccagcattcctgaataaaactgataagctacagccctagagaccaggtctctgcatttaatttgtttaacaaatatttattgagtatctgcttgatgtatgctagtcctggaaaaaaattattccaatgaacggccagttaattcatgccaactaaatagtatctattctatgtgcatagctacaaaaatagcagagtcaattcaccactgcagcataatacaattacaataacagctctagtttattaacaccattatttaattttattttgtcttataacaaaaaactttttactttaaatcattaacagccacaacaaaatgctgccagatatctgaacacattttctttaacccatctacactactaaacctaaaattgtacacaataaaattccaccttgaagtaacaaccttggagcattgcaaaatgttcaattataaaagataaagtaaattttcatagaatggtgtacttactgagaaagaaaagcatcacacatacatcaaaaagatcttcaatgtcaaagaaagaaatcaaaaattttggtccttgtaatcttgaattaatcagataatgtaatgcattagaatgctttcttctttctactccagtatttcaaccaagtaggttatactgtttccaatactacaaatatgctatcttaagggtactaaacacagccctgaggacaaggagagaaaaactagaatctagcatcaaatcttctgtcaattacacatatacacatacacacacgtgtggacataaagtgtaaacttcagactagcctcacctgaaaattagttagaaatccaaattctgaggccccagcccaggaactctaagggtggggcccagaaatctgtgtttctacataaaggggattctgatgcatgctgaaaatagaaaatcattgctccaaaaataagaaatgatactataaaatgttcagacctctcaattccaaaattgacataatgtttcaaattttaaaaatatgaaatgctactcaagctcatagctgttacttatacttaattatgattaatgggagccagtcttctcgcttcctctagttctctctctcctcctgcgtgtaggggtgtgttagcggtgtgtgtgtgtgtgtgtgtgtgtgtgtgtgtgtgtgtgtggtctataaatgactgtggaaggttctatgtaaacactctttactcccaatcataaacaaatctatatggaaaatattacaaaaaatcaatttctagattacatttgtcacatggagaataaccaatttctagtcacttgtcatgggtgcataacctattaccagaactgattcacggtgaattgactagctatgtcaaaaggaagatctgcagtctacagagaaataatccatttagtgttcgaaattttacagtaaaggctgccaaaataacagaatttattacatatttttacaggtatattaagctataataaattcgtcattcctaaatcaagataattcatttatagcctattcaaaacttacttaaattaatcatgaaacattaaatgcaaaatgtttttttcttcacataatgtcacaaagtgacatgaactaatttgccaacatgttttcacagtattgttattctgacatatactaacatactaaccaaagattatcaccaataatgttggcattcatggctaaaggggcagtaataattttatatctacaaggactgaattaggcctctcagacaggaggcttgggaaaaatcatttttcaagttaagccaggtgagtctgtaatcaatgaccagagctctgctggaactgcagtgcctcgaaggaatcaagttaagttatgagctacagaagaaaatattgattcttgcttttacctgtttgtttcacaaactagaatagaaataaatattactaattttatgttgtaaatatttaatacgttttttcaatagtcactatagaatatgtaaggaaaccaaaacaaccacagttgaaagtcctatgacattagcaaagctcaggaacttggcattttcccagtgatgatgaataaaattaaaatactgatttcagtgacctgagtgtgactgtcatttgtctaaaatatacttattataatgtagtaagaatgcgcccgggaaaatacgttattcccccaaatctcattttttaaaaaattcattttataaaaaaatgaatcattagcaattgatgttctttccaaatattttagtgcccctaaagcctaaaagtgtatcctagaataaatttataccattcctcaaacttacatctatgaatattaaacatttattgcttgactataaaacttttctccagactatgtcagtatctccacttataaaaaattagggaaagattaaccaaatagaactgaagagaatagaatctacagtggggttgtaccgtaaacgcatataacttacacaacttcaattatgtaagttgagaagaaagcaataatgccaaagattggtctgccaatttgtatggcctggacagagtgtgaaatgggaagtgttaatccaccatgccctcataagcacaagtagccctgttgagggtgattatgatatttaaaggtatgtcttgtcatatatcacaacccttgaaaaaaagtcaagtatttctgatgctcaactagaaaaaactggctattgaacttactgagacatagtatattgatccccaatatgccctttttaagagtactttatgcttggtttttcacgttctgttaattctggaatctaacctctgaatacagtgcaatgttttcctgtggatcaatcatatcatgaaatgcctttcacagcaaagaaaaacaaaagtgtctttcagcataaaagacattgtggaaaagagaagaaatactaattttattatgtatctttcatgagaggtttcaggacagcttaaaatagtaaggaatctctgacatagcttcagaatgatagacaaacaagacagataaaattatttataagaatacaaaattaggccaggcgtggtggctcacgcctgtaatcccagcactttgggaggccaaggtgggtggatcatgaggtaaggagttcaagaccagcctggccaacatggtgaaaccctgtctctactaaaaatacaaaagtcagctgggcgtggcggcgcgtgcctgtaatcccagctactcgggagactgaggcgggagaatcgcttgatcccgggaggcggagccaagattgtgccattgcacttggcttgcagcgagccaagattgtgccattgcactccagcctgggcaacagagcgacagagcaagactctgtctcaagaaaaagaaaaagaatacaaaattataattgttactcagattccatctcaaagaaaatcttcatgccagcactttcttcaatatatctcagccacaaggcaaatatatgctgactaaactctactttcaaagtgtggttaagagataggtggtggttgagaaacctcctaaaaagatccatatacattggggtgaattcatctttgtccaaaaatgtaaccgttgtaccaaatgtaacctaatgtaacaatgagacactctgagccttgctggatggtttaactagacaggtgttctgggaagccacataatgacaaccaagtaaatgaggaaccaaactatgcactgtttgggagttttcagattttgtttttgtttttttcttctgttagggagcagaaccctctctaacagaattcttcactgaattccatcaaaccttttaatacagctacagcatatattttctgcctgacaactcaagtgagtaaacactaaacactcatttctatgtatttctttatttcctcatgaagaaataattattttcccgctttattttgatgtattttgtacatttgtatttagattttaacccatgtaaataaacatttatgatacaaccccactgtagattctatcctatctagttctatttggttactctttccctaattttttataagtggagagatactgacatagtctggagaattattgacttattatacacttcatttttaaagctaatgaaaacaataataattcagtacataaataataaaaggagttccaaagtttgtgcttcataggagaaagaccattctcaagccctactaatcaccttcacttacataaaatgaacatcatcattccaggatttaagctacatgtcccaagtcttctttccttctctagcactgacctcgcattaagatgattgagagtggaatatccattctttccaggaaaagatgaccctataatcagagatgtggtttgatcttctgcaatgccagcaaaacaatcagacttcatatcactccccaacatctgagtcataacattgagaatataacaaaaataacattgtgtgggaagtaccgagattcctgtctaggtacatctgtaccaggtacagtcaagctccttttcagtctctccttaggacctaatctcaccctcactcattttttacattatatctgtaacaagtaataaacatttcttctacactctgacttagagttattattcaaacttggtaggaaagaacttgagattgtgatcagagactttataattctgtgtgtgtgtctgtgtgtgtgtgtgcatgtgcgtgcacatgtacatgcatgtgtatcaaaaagagcttgggtttaatcgttcacattaattaccccacatctttactacccatgtttttcctcacatgtcctcaacttagcaaatgacactaaccaatagctcaaggtcaaaactctggagtcattcttgactcctcctcttcatcatctcctatatctaattaatgttcaagttttataaaattcacatttaaccttgtgatggttaattttatgtgtcaacttgactggccatagggtgcccagatactcagtcaaatattattctgggtgtttctgtgaagacattttagataagattaacatttaaagttatagactgagtaaagcagactcagtttataattttaaatgttaatcttatctaaaaaagattattccaaaaggatgtatggtttttctaaaatcagtccttcatagaaagcccaattctatttctacttttaaaagtaatttatttaatttctacatctctcaactgggaaacaataattccaaaataatctgatccttttttttttaaagaataaccatgaaatattcttccccaggttaacaaaactagtagcccacctgcaatattctcgatcacaagcactttgcaggctgcactatacagagctacttgggtagaaatattttccttttgttcctttaacagctttacccctttgacaagattttaaaacaatcaagtttaatttttccaatttcttcctcagtattactttggcaaaggtttgggcattaagtgaggtagaaatcaataattctccaagtaatgcttgccccagaaggtgtccacatgaaaataaataggtgtcctgagcataaaatattttttataaatacctatttgagggaaacaaaaatcttaatgcctcaagtatttaagactttttaaaaagtaaaagaaaaaaatacaattcctcatttaatggtggaataactacatctagtaagatttttttccttttccttctaaacatagaaaattaatacaagttgaaactaggctaatcatgaaaaagtgtaaattaaaaatgtacattaatttaaaaattcttctgaccacatgaattataaaagactgcaaatataagggaggaaaaaagaactgtgaaaattagactgctcactcatttgaaaccctttgataaaaagcactctatcttcttcggactgccacccctgtgagggaagggactgtgacattttgtattaatctctacatagcacttgcctctgtactatgcctgtgacagtatttcataataaaaaattttcagattttttcagtggaaccatgttcattaaataagaaactaacaagatgtgtttgtcatcccaattgccttggaacattaaccatttcatttcaaatgttaccactttgcttgctaaatttacttattcctctaagtttaaaagtatctcaaatcctgaaatgactttataatttagctgttaattttctctagccacttgcttttaagttaacaacaattctgacactatagcttattaaccacaaacagttatgaattaaatcaagtataatgtgcaattaaaactcagatgcagagtcaaataggatttccccacgtctacataagaagctttgaaatgcatacaataatgacacatgaatcattactattatagagatgagaaaaatgttgaatactaggattttacaatcaaacgagcacttgttatttactagatagtaaatttcaccatttacgtttctttacttccttatgccctgtatgaaaacacaatagaaacgaaagtgctaagtgaagtctttcagtattttaagaagtagaaaaccttggttgagacctcactccattcaaacatttagcaaacatccactgatcacaatctgtagtcaatcactgtgctactgaaatatgtggccaccatgattgtgacagttaaggaaccatctgtaaagaatgattcttgcctggtatttctcacttattctgaaaaataaatcttgactagaagagagttatctaggatccatatagaagcatacttagatattttctgatatataaaatgaaaaagagaatgtcttgcaaagaacagaaattaaaagcacatgaaggacactgtctttgaaatctaccccccttccaacatcatgcttgttcaagcacccatcaccattcctttaaagaaaccctcctttaaagaaacctcaggagggttcctgcctcagtgttgctcctctatgaacctccttccactactaagagtgccatctttctaaaacctgaccagaacatcacggtgccttaagccctcagtgtctctttcccatcaactagatgaaatccagtctccttggtttgtatgatgaggctctttgtgatctagatccacttatagggcaggcagggagaagccaccctctatgagggaggtgaggaaagagtaacccataacttttgctatctcaaaaggttgctgaccctaacaccatttaggcaaagctggtcaatggggagatattggatagactcacattagaagtcactctgagaaattactaagactccagatcataattcccaaaatttaaaattagataaaccttctgaaatggacctgtgacagataagagtgtaaatctgaagaaatatactcaatacaagggcctaacgatttgttgaagagatcttttcaatacattgtgtagcttatgttggaagcctttctaaattaatacattttagcatagttatgttgagcatggaaatgggaactagaacggtttataatcctgtgatctgagcttggagcatcaatgggtcctggcctggaacctgtcccacagcagaagatgaggacctggtagacgatatccaacacagcactacatacaaatggaagcactgacagtaatacagacattggataccctttcttcctctgcttgaattgcattaacttctggcattttggacaggcatcaagaaggtaagtcattcaagaaggtgaggaaatgaatcaaggatggcacaaagataaatatagggcatgcagagtctagagtaattgattcaaaaaattaaagaaacttggctccattttttaccttatcctgcttatacttgcaatacctctgggcattatttttcactcttcttcccttcctactttacgcttaccaactcagaactcagaatacactatgctctcccatgtctcctcgttatgctctttcctttgcctagaatgctctaggaagccttttctgagccaagagggttgggttaggtacctttctttggtgtttccattgtattctgaggatgtgtttatatgatacaatttattcaagcagcttatcctctatatgcctctatttcacttgtaaaatggagacaataatagcatatactccataggattgttttggttatcaagcaaggtaatatatgtgaaaccatttaaacaatatctggcacaaataaacaactatataagtaatagctattgtgttattattattattaaaacacattatgcttttatcaggtactatgtggcagtcattatgccgggtgttggtagaccattggtgaacaaaggaggcttggttcccactgcagtgatgctatataaaattactcattcttcagtatgtgtctccatgcctcccagtgtcagagatcaatctttgtcattttttgtgtgttatcagcacctagaagaggatttatcacagagctgggcatataagaggtgctcaaaaattatttaaaaataaccccagaaagtcctgagcagaggaaaaaaacatgtggcttgtagacatgcaacagcattaaactcactgaaattatgtgtggctgggacccaggttaaatgagaataagtgaaagaaaatgcagctgaagagaaggaagcctagatcacagtgggcctaatactatgagaaagagtttaacttagaatgggaattcagaaagcattttaagtaaggagtatcatactcatatttccattacagaaagaatggaaactgtgaaggccaatgattggaagaaactgagactagaggtagaaaataggatggtatttgcagtattctgcataagatgtgatgaaaatgtgatctaagatagcatcagtgtgaatagacagacaaggatagagcaaaattaagacaataggtctgataggccaataggatacagcatttgaagaaaagacagaaatctaatatgactcttatgtttctagcttgggtgctaaatacattgcaaagcattaagtgagatgataatatgagaataaggttaggattgatgcgacaaaatggagatcaactgctgaattttaggcatatggaggcatctatgagattaagtagaaatctaagagtcggtaggttatatgcacttaggtatcaagaaagaaaatggaaagtggtctttgctggacaactataaaacctggtgtaaattaagagatcgtgtttccagggagatgaaagagaaagttaatcatggattaaaaagtatatgtagatgtacaagaaatcgaggagatgtacaagaattgacgatcctttctagtaatattttagtcaagattatcaactcaaagtaaatgagagggatatgggttacgaattgaggtggttagtgaaggtttgagagaaatggaaaagaaggttatcaaggacacataaaatatattaggcaaggaaccaacctaagtgtccatcaacagacgaatggataaaaaaaatgtcgtatatatacacaatggaatattattcagccataaaggaaaatcatgtcattcacagtaacatgtatggaacttgaggtcattatgttaagtgaaataagccaggcacagaaagacaaatgccacacgttcccactcatatgtgagagctaaaaaacttgatctcagggacatagaaaaaaggaccatagataccagagactgggacgggtgagtgggggtgagggggtatgaagagaggttggttgtgggcacacacatacagttagatagaaaaaatatgttctaatatttgatagcagactacagtgactatacttaacaacaatattatgtatattttaaagtaactagaagagaggacttgaaatgataccaacacataaaaatgataaacactcaggtgatggagacctcaaataccctaacttgatcatgacacattttatgaatgtagcaaaaactcatatgtactccgtaaataggtgaaacattgtatgtcaataaaagagaaaaaattaaaaagcaaggaaaggatatatatatgcttgatacctaaatgcatagtgttctatagccttagctagagcatattgcctgatatatatatatatatatttatacacacacacacacaatggtagatacatacatacatacatatatatatatacacacacacacacacacacacacaatggtagatatatatatagcaacaatagtagagaaacacagaaggtaaatggttggactgatttaaagctgaagctttacaaagtcgtggtgaagaaatacaaaggagcaaaggaatggagggagctgcatgcctagggagcatccattgctgagaattatgccacatagagaaaaaatgtagttagaagaagggattaacaggcttaagggaaaaaaatgaaagaatcaggagattaaaactctaattaatttgaagagtaaatgcagcagatcaactcaaagaataagaaggtacgtcttggagtttaagatttcagagactgaaaattctaatacatggaaaagacctaacatgtaaccatatgaaggagagctgaaacttgcatttttgagcatctgtaggcattgtgcttggcattttacatatgccatctcatttgataatgattttctttatttagagagacaaggtcttgctatattgcccagaccggtctcaaactactggactcaagtgatactcttgcctcaaccttctgagttgctgagattacaggtgtgagccactacactcagcttgattcattatttttatagatgaaaagactaagtatgagtcaagttacatgatttgcccaatgttacacagttagtcagtagccgaactgggatataaactctagcctgtgtaattccaaagcatatactctttctagaataacacaccaactgctcaatgtgagaaggttgtcagggaaaaatggagcaaagattacttgaagtaagtaaattaaagaattctgagactagatggtggatggggtgattcaggtagacacagaagtcattcacctgacagctaaacttgaatggaacaatctattagttaattccataatcattgaaaaatgtagagaagtgataacgagactgataaatggagtatcccatgatgagctctgctacaggttggcaccatgatgggtgaagaacacaaaaaaaggaatgtatattactgcagcatatcatgaatgaatttcctaataaaataatacgatggatgctagagattttatggggccactctcacaaaccctctcattaaaagccaagttctgggaaactggagctggtggattcctcaattcctgcttgttacattgaccctgaactttgagcacccatcaagagagcaaggagactggaaatctgcatccattcagttttattaagcttgtatcctagatatctgcatccattcagttttatctagcttggatcctagcttgcactctttgtttgctagtttagtgataggacaaattaaaagcaactttaaactaaggctgagtcatcatcctacagtcttctaacctctaataactgctgaggagtggttagttcaggatatgggatatccagaagttatgagttccaaagaaggagggatttttatatgacagagaggagtcactctgtagacacagaagtaaaaggcaaggtgagtgattgcccactaccaccgctgagacccatgattcctagaaggtgggaacataggcagacaccattccatatggtggcaggatagagctatcttttaattaatagaaaaaagatagaggggtaatgttccttaaggtgttctggtttgttttcaagttgatatggttctggagaattatgggaagggttgggagatgaaaaacaaagggaggaaatatctagagatacagagaatgaaatagtataatgataagttcattaatgaatatgggtgactcctggagcttgtattttgttaggttgacacagatggcagggaataaaagaatggtggtactaatttcatgtgtttccttgtatctctgacataacaaaaatatagtctttcagctgagcataatccccgcttcacaatgagagtaaatcttttgtgtcacaacagacctgaccagatatatgcagtaacaacaatggacatacaggtaagtcacaatggctcatgcctgcaatcccagtactttgggagaccaaggttgaaaggattgtttcaaggccagcctgggcaaaacagtgagacctcatctctactaaaaaattaaaataaaataaaataattaaaggggtatggtggtacatgcctgtagtcccagctactcaggaggctgaggcaggaggattacttgagcccaggaattcaaggttgcagtgaactatgattgcaccactgcactccagcctggatgacagagtgagatcatgtgtcaaaaaaacaaaaacaaaaaaaccaatggatgtacatgttttggaagggtaagatgatcatatatgccctccacataccaacaccaaaagcattgatttaaatctcacactagtctcaatctcacaaatatctcagttttccttataaataataaaaaaattaactcattcaaatttcttttgacccaattatatgtttctactttactatgtatttgcataacaagtttcaagaaccacttaagaagcaaagcagtttatctttcttcttgaatcatgaatgcctcttttaaagttcacataatggttatagaatattctagtattcataaacaagatttggagaacaaggtcattttaacttttcctttattttttatttagccttcaatcatattcctttgaagcttttaacttttatgctaaacaacactgctgttctgatttgagagggtattttttgtttggttatctgttcatctgggtttttttgtttggttggtttttttaccagtcattacatattccattatcccttatattttctatttttagggtaatttctattttccttataccactattatataattatattctctcatatggtataaagatttatgtgtgtgcttccaaagctataaatcctaaaaagcagagagtgttgctgctacctttatttattccgctttcaggaaataaacaatagttacactatatttttaattaaatttctatgtaattagaatttttagaaagttaatttctccttagaaagtaaatttccaaaggagaagcaggtaaacgatagtgcacacaagagaaaataaaagaatgattgcaatattctaattacaagaacactagaaaaagagaaagagagaaggagagagagagagacacagagagagaagtttgcattttctatctcccaccagcttctggccatattttcaactagtattcctacattaaacaaaatcaaggaaaaatactctagaaaagtctttcaatttgaaggtaacataagcttcctccaactatactgaacttcctcaaaaaagaaacttgaatctatgaacccagcacaagaaatcttgccagggtgagaatatagaaagaaatcatcctagcagggggaaggaagagtaaaagccaaattgccttaagtatttggatgtaaataccaaaattacagggacaacatctctcattcagagaagaaagaagagaagatgatgagtattagttcatttttagttgagagagtagggggcatataaaaaggaccaggcaagaagtgactccaacctaaactccaacatcagagtagaaacagtcttcccaccatttcgtacttgctcctctgggtagctgtggctgaagatcaagggttggatgaggagaggcaggaggacagacccgaaacattcagaaagacagatgcccaggtcaacaggcctacagcagtaacagtaagtgttgcatgaatggcatttggcagagatgatcgctctgagggttaccacaagtctacagatagatggaaaagtatgttagctattgtaataaaagtttatatattgtttatatattgtttttgtcataagaaaatgattttgttgcattttctgtattaaaaaaatatcaaacatcttggattgctcttacacagttccgcaaatagattgagcctatcatgttttaattttgttaattttagtaatcttaactattaacctttacacttggaagcatgatttgtcatctaacaaagtgttttcctatagttactcaatttcatatcagaggcacaagataaggttgagaaattctgctcctatatatgcaagtcagaaaaagttttagttttgtaacaaatcatagcacaaaacccatttgaccctagccacctcaaaattgtctcattctcacaaccaattttgaagacacacatacatcttttctctccacataatgttcctttgtcatagccactgaatagcatgaactaacagcggtcctgaaattgtgtaggcttggtaaagccacctgcagaggaataaatatgtttaattaaatccttttaaaaaaagagtttaaacagtattattccatcttccaccctagccctgccaatgtagtgattatatgtctattaaaaaggagggcttgtatgagttatcatgacatgcatcactagattgtagataatagaatttagtatgtaatttattttatatatttatttaaatatataataaaatataatcccagaatacaaggtcctaaggttcaagcttatgcacaaaattgtgtcctttcttgggatatgccatcctccaggcatggacatttgcttacaaaataaatattgtatattataacaggaagagacttcaaaattcatgattgtttattttttccctttcagatgcacctccaagaagaaacattagatttatatatgtatgggtgtgagtgtgtgtgtgtgaaatctggaatggaagtaaaactgttaaaatccatgagaagtcttgaattaatgaagattcagaattaggaaacacagtacacatgtcccataaacaaagaagccagcagtggaccccttcaggtagtcatcaaagaacaacataagtggatatcagaaataaactttcccaggatttaacaaaaataacatttctcatttataaatcatactgttcagtagatcataatctgtagcaaactaaataagtagatccctgtcctctgaaacagaattgaaactgctgcctgagcatctaacttatctatactgctctatcaaatatttcttaatcagttttagcatttgtttattttctctcttctgaaacaatggctaataagtgcccagcactgtccctgacacaactcacatacgtgctcattaaaataaagctatttaaagtagacattgtcttgtcgtacagcactcctcttctaaaaattattcctttcaaccagagggttcaaatggcagctgccagcttctcagatgatttgcccataaatgagcacccaacccaactttctgggttttttgaaaaaaaatagtggccttattgttattgttttgtatgtatatcttagtgtccaccagcatccatgcattttcctctgtgggatatcctagagattttacagaaattaaatttcctaagtcatccatctataggggtagggacagtggacagggcactttaaaattatttttcttggaaaacagaaatgagcacggatcttagaaagctcttatatatttagcagatgtaaatctgtttaatataaatacaaaataaaatcatactcttaaagattttcaggtacaataaaaaagctacagtgtgaaaataaaagatacatatgtgatttttaaatttgacattatactttttcacaatatttcaaattcagattaaaacatttaattgattttatttatttattgtgatggagtctcgctctgtcgcccagactggagtgcagtggtgtgatctcagctcactgcaacctccgcctcccaggttcaagtgcttctcctgcttcagcctcccgaatagctaggactacaggcacatgccaccacgcccggctaatttttttttttttttttttttgtatttgtagtacagacagggtttcactgtgttagccaggatggtctcgctttcctgacctcatgatccgctcgcctcagcctcccaaagtgctgggaccacaggcacgagccaccatacccggcctatttttattttttaagatggagttttaagatggagttactgcaacctctccccttcccggattcaagcaattctcctgcctcagcctcctgagtagctgggattacaggtgaccaccaccacacccagctaatttttgtatttttagtagagacagggtttcaccctgttaacctggctggtctcgaactcctggcctcaggtgatttgcccgcctcagcctcccaaagtgctggaattacaggtgtgagccactgcgcccaacctaaaaaatgtaatagatttaaaagccaaatataaatccatagtttagtgaatattgaaataaggctataaataattttataatcagtgtgtttataaaacagcgtatcattatggtacagaatttaaaagttcagaaaaaaatgtaatgcttaaacttttgtcccaatagaaagcttccattaactcaaagggaaatctctgagaagtattaatgtttcctaatgaacattatggaatttctaagcctacattagacacttgcaactttgatctgtctatagagtgctttaattcttcaagcaattttttagaagtctccaagtgaaaatatattaggaaaatctcttactaaagaaatgcagtaggattgatgggatgttttatttcttacctttgaaaacatcccttatttctagcctaatatatacagacaacacatatctacatttattcattcaaattgctattgaaatagccataaaaagaaaatatcttaaaattggtaagtcatcacttctttataagatggttttatttgtaggtcaattttataaaattctctttttgagtgttatggttaataacatatttaaagatttaaatccatctgagagtttaaacaaattgccactatttatgattattttgtattagaatagcaaaatgggctgcattaatagtccagctctaacacagaagaagcattcgatttatattaataattacatataactggtttataaattatttgcatacatcccagatatatatacatgactgaaatttaaaataatttttttaaaaataaaaagacttctgaacccagatctactaattacatgtacaaagagagatgccctataagttggaagaaaaacaagtataatttaaaagacagctaaaatgtatgaaaagcaaacacgtttatttttaaacttcaatatggcccaataacaaagactgtgatattagtgaaaatggtaaaacaaagtcctttttggtactataaatactaatattctaaggacaggtcaagtcctatttggttttatgtgccacgtgaagggggaaataccagttcttttgttattccttttcctggtgagagagggccttcaaacggccaccacagtagcctgcatgaacagtgctttcttacaagacagcattgctacattacattgcatctttaggcctatttaatgggtgaggtgttgatcatatgccaagaaagacataaagagaatgaggaatgtacatagaaatgctattaaaatgatcccatgcttgagaagagaatcaagagctaagaaattaagaaaaacagtttctgctttgaaggagcttaaaataggacatcacctcaatgtagaggcatgctcccttgccgtctcaaagataatatttggtgatcagagccagaaaaaggaatctaaactacttgtttttgtagttagctctgtcatttaaccatagtctaattatccagctctatatattaccataaaaaaatctttaaatgtacaccatgtaacaacacttatcaacctaagaggaatgccaattaatgcttgcaaaggcactctaagattttttttttacaagcaagtgctatataacaacaaaatatctattactattctatctttccaaccaaagcaagttttgtcctcctaggattgctgggagcaaaataaacccgacgtcattctcctaagcccaattggcagcccagctgtgccattatccccgggaagtgtggtcatgtacggtaatacccgcattatgtgacaatgaccaagtcaaaattacccccttggaatagagttcagcctctgaaaatgtagaactgagaagacatgctgggttcaacagagtagccatagtgagggccatttttgtttgataatggccctaaattactgatatcaacttggcgtctaagactcagggcaaaagcagctattttctttctatggaacattcaccaaaaatataaatgcagctgccttagtcttgattttcttccctgtttttatgggatatataaggtcacgactataaatatagataaaatttatataaaacaccaaattaactggaaagcattttatatattctaaaatatatccagggtgtttttttttcttatttatagattttagaggcacataaaacctaggccccaagccaatttacagtttaataaacagctgcatagttgtgaattttctggtataaaatataccaaaatgataagaggctggtaattcagtgcattacctacagcaatagcttgatgcaatttttccatatgcttgatttataaaaacaaactcattttctggaaatggaagattaatcttcttcaacaaaattttctttatgaaaatgaaaaaaagtgttttctataccaagaaaaaataacatatattaggacgtagtcgggggcaggtgagaggaaaaaaaagagatattattggagaacaaaaactatatccataatccctttctcagataactgcttattgacttttttagaaagtagaacatagtcaaggttagtaaaaggtatattctcttctcctccacagttctgtctccctgggtttccttccaaaaaaaaaatttttttaatgtgtattagtacatactcacatgaaaaatacatgtgtgtatatatcaacttttgttttttcctattacaatgagtgaacctgctgggttaaaaaatacaggcattcctcagagatactgcaggtttcgtatcagaccatcacaataaagcaaatatcacaataaagcaagtcacatggatttttttggtttcccagtgcatgtaaaaattacatttactctatattactgtagcctattaagtgtgcggagcattatgctaaaaaaaatgtacgtaccttattttaaaaatattgctaaaggctgggcgcagtggctcacacctgtaatcccagcactttgggaggccgaggcgagtggatcacaaggtcaggagatcaagaccatcttggccaacacggtgaaaccccgcctctagtaagatacaaaaaattagccaggcgtggtggcatgtgcctgtaatcccagttacttgggaggctgaggcaggggaatcgcttgaacccgggaggcagaggttgtagtaagctgagatcgtgccactgcactccagcctggagacagagcaagactctgtctcaaatgtatatgtatctctctctacaaaatgctaaaaatcatctgagcctttagtgagttgaaatctttttgatggtggcggttcttgccttgatgttaatggttgctgactgaccaggatggtggttgctgaaggttaggggtggctgtggcaatttttgaaaatgaaacaacaatggagtttgctgcatcgattgactctttctttcacaaaagatttatctgggccaggcgcggtggctcatgcctgtaatcccagcactttgagtcaaaggccaaggcaggtggatcacctgaggtcaggagttcaaaaccagccttgccaacatggcaaaacaccatctaagccaagcgtggtggcgggcgactgtaatcccagctactcgagaggctgggacagaagaattgtttgaacccagaaggtggaggttgtagtgagccgaaatcacgccactcactacactccagcctgggtgactgagcaaggctctgtcttaaaaaaaaaaaaaaaaaaaaaattatctgtagtatgtgaggctgtttgacagtgtttcactcacagtagcacttctttcaaaattgtagtcaatcctctcaaaccctgccactgttttttcaactaagtttatggaatattctaaatcctttgttgtcatttaaccatgttcacagcatcttcactgggaatagagttcatctcaagaaaccactttctcatccatagaagccacttctaatccacgataactacgtcatgaaaatgcagcaatttggtcccatcttcaggctccatttctaactcagttatcttgctattcctcccctgctttaatttgtggtatcttcctccactgaagtcttgaaaccctcaaagtaactcatgagggttggaatcaacttcttccaaactcctgataatgttgatattttgacctccttccatgaatcacaaatgttcttagtggcatcaaaaatggtgaattatttccaaaagattttcaatttactttgcccagatctatcagaggaatcaccatctacagcgagtatcgccttacaaaatgtatttcttaaaaaataagacttgaaacttggaattattccttgacccatgggctatagaatggatgttgtgttagaaagcatgaaaactccatttatttctttgtgcatctccatcagagctcttgggtgaccaggtgcattgtcaatgagcaatattttgaaaggaatcttttgttctgagcaggtttcaacgttgggtttaaaatatttagtacaacatgcagtaaacagacacgctgccatctaggctttgttgtttcatttatagaggacagtgtgggtttagcataattcaagggccccagaattttcagaagagttaatgagcattggtttcaagttaaagtcaccagctacattagcatctaacaaaagagttagcctgtcctttggagctttgataggcattgacttctcctctctagttatgaaagtcctagatgacatcttcttccaacagaagactgttttatctacattgaaaatctgtagtttagtgtagccaccttcatcaatgatcttatctacatcttctaaataacttactacagcttttacatcagtacttgctggtttaccctacacttttatgttatagagctgacttatttccttacatgaaacaaacactgctggcttcagacttttcttgggcagcttccttatctctctcagtcttcacaaaattgaagagggttaggttctttctctggattaggctttgtggctggtttgatcttctatccagaccactaaaaccttacatcagcaataaagctgttttgttttttaatcatttgcatgttcactggaatagcacttttaatttctttcaagaacttttcctttgcattcacaaattagctagctttttggtataagaggcctagtttttggcctgcgtaagctttcaacatgccttcctaactaagcttaagcatttctagcttttgatttaaagagacgtgcggctcttcctttcattgaatacttagagggcactgtagggttattacttggcctaatttcaatattgttgtttcacagggaataagcaggcccaaggagaaggagaaagctggaggaatggctgttctctggagcagtcagaacacacacaacatttatcaattaagtttactgtcccccatgggcatgttccatggtgcgccaaaataattacaataataacatcagagatcactggtcacagaacaccttaacatatataatactaataaaggttaaaatattctgataattgccaaagcgtaacacagaaacatgaaatgagtacatgctgtcagaaaaatggcactggcagactttttccctattcctgaatcagttaacccaaaagagttgtttgatggggtagtaggtgtggaaaccttggtaataaaggaactaagctgacattattattttttaaatttttttagttttttttttttttgatggagtctcagtttgtcacccaggctgaagtgcagtggcgcaatctcgactcactgcaaccttcgcctcctgggttcaagtgactcttctgcctcagcctcctgagtaactgggactacacgtgcacaccaccatgcctggctaatttttgtatttttagtagagacggggtttcaccatattggccaggctgttctagaactcctgacctcgtgatccacctgccttggcctcccaaagtgctgggattacaggcatgagccactgcgcccggcctgatattattttttcatacggtatctattataaatatatatttgaaatatttttcactattatcctaagctaataataataggaacaaagttaccacatgtgcaaaaagctagatgtttagtcagcaaatatctctaatatttatttgcagttcttggttattaccatattgaggatttattctaccttgaaggttaggaaaaatgccacttcagagaaggtttgctaggagaaaaaatttcttccttggcctaatatatttcaattgttgtcaggtgttccaagtgtgaattactgggtattgtactgaatcatcttctatggatccatgtactgcaccttccaaccaacacctctaccccagcacccctccacacacacacactcatcagatactttcttgaaatttgcattaaaataatgttgaaatgacttggctcaaaagcattaagtgaagaacaagacttagaaaaagcaaacctttcattattcttctctgcattaagtgcctagctctctgtgaattgcaacatttttaagaacatatccatagtttgataacctatagatacatagaaattgtctaagtgctaattttccaaactaactgagaatattttaagtgtctatctatatacctctgcctctaggagagtagcaaagagattcaaatatgagcatactcgtattctccttgcttcaggaatctagacgaacatttttacaaaaatatatacacaacactgttcatgcatattatagccacacatattatagcactcacataaacccatctcagagaataaatgaaattgttcaaaaaagagagccagttagtaatcatttgggactctcaattatgggcaaataacgttcattctgtataaaggtaagtacaggattggtgggatttaagagagatgcttgcataggcatctcttaggcaatctgggtcagcttaggcaatctaggtcatttcccaaaatattaaagaaaaaacatccagaaatttctggaaacatcatgtactataatttatatacagtcatgcatggcataacagtgttttagtcaacaatggaccacatatacaactctggttccatagattataataacatttttactgggcctatatctagacatataaacagttaacattatgttaccattgcctacagtatctagtacagtaacatgctgtacagatttatagcctaggcccaataggctgtaccatatagcctaggtgtgcagtagtaggctataccatgcaggtttgtgtaagtcccctctataatgttcacacaatgacaaaattgccaaaggacacttttctcaaaacatccccactgttaagcaacacatgactatacatccacctctttctacatttaaatctttctccttgctaagtttaaaaaatcataaattgaccctgttcaaattgcaatttgtagtcttttaaatgaatacaacttaagtagattagaatgaatgcagcactgagaggcaaaatagcctgaagttttaagttctggaccagacaacttggtgaacttttacaagttatttaacctctgtgcccattttctcatctaaaagcctgggataataataacacctatctcacagaatggttatgagaattaaatgatgtataaagtttctaaaacagtaactggtactgagtaaatattctataagtgtttatcaaccacataaaataaatatttcactaaagcacaaaatgtattcttttcttccagggtcaaaatacactaatagctcttcaaatagcctgctagatctaacagtaattgatgaacacctttaagaataaactgagataaatgagaaaagcaagatatttttgtattgcaatattcagattgtttcctggtcttcagtacacgtgtaaactttcaaatcaaaatagtacattttacactacaattgtatttgtcttctgttgttttgctcttcttttctcataatcaggctcttttttttctagtcccaggaaattttggttcaacattgaactcaaaattacaaaaatgtgaaaaaaatgtgtaaacattactttcatagcagtttgctaatattgaagctgtatagattgaacatttagacattatttgcatttcttcaaagcctagtatcttattaggtaagcatcaaaaatatatacaagaattactcttgtttcttcaataacttcagaataaaagcagaaattaatgggatgggtgggccacatggttatcaccaggaagttattaggacctaacagcatctgaagctggcccttatgatgggaagagaaatggaaaggattcaacaacaactaaaatgtctgttccattaattatcacttgcttataaaagctatatatgaactagaaaaataaagaagatcccactggggaaaaattggatttaggacatacatacacacaaaaacccaaaaatacattgttcccagaacaaataaactgccattctcattgcatacagccatcctcctaaaaccaaatccagccttaggaaaaggaaatatatttcctgaatagccagcaacctccttgaggtcctcttgaatgaactaatatacttctccatgtgtgcccaagccagtgcagaaggaaaaggctgactctctgtcaccagtgtctcgtagagggaagtaatatgatcatctaggtacctcacataaattagaacagatggaagtatgagtttctctttaccagatcatggggttaggatggaatgactttgattctcccaatttaaatcctagcttgcctgaaaatgcaggcttgtccttactgtaattccttcttcagaaaaatatctttaatacccaataagcatagagaaatgaaaatactcagataagatgcatttactgacaaacatatcacatcaaaatttcctcatccagtgcactaccctcttcttacatgtgggagcaaatgtgacccaaggtgaaatctacataaagatgaaagtgaaaacacatagcaatttataggtaatttgtaataaagcttgcagtaagcattactgccaagaaatgcagtaaatccacaataggacttctatcatagctgtaagaactgggtttgtgagagtttatacatttaagctaaatttctcatatttcccattttggctcctcttatcttcagcatattaaataatgaaaaataaagcttaaatctaatcttcaaagtataaattgtcttatggctaaattcaacatccaaattcagccctccactgtgaccattgttaacaacactcaggtaatgtgaaaggcaagaaaagcaggggcctgacataaaatatatttttcaaagtaaacgcccaacataaaatttatccaatattcccagtttactctcaggcagtcatgatgcttacttattttacacattaatatagcttgtgaacatcactcatctactactactactaggtactagggacaatcatggcttggaaaatgcaattcttgtcttcttcaactataagtaaggggacagtttgagcagaaagtcaaaagaggccgggtgcagtggctcacggctgtaatcccagcactttgggaggccgaggcgggcagatcatgaggtcaggagattgagaccatcctggctaacacggtgaaaccccgtctctactaaaaatacaaaaaattagcccagcgtggtgacaggcgcctgtagtcccagcttctcgggaggctgaggcaggaaaatggcgtgaacccgggaggcggagcttgcagtgagccgagattgcgccactgcactccagcctgggcaacagagatagactccgtctcaaaaaacaaaaagaaagtcaaaagaaaggtggtaatatgaaacttctaaactaagagttgatttcctgatttgcatgtgaacatggtaagtagcttgtccaacatcacagagtaaatgctagagtctagaagttctctgagaacaccaaataaataaaagtatataaaatgcatagctcagtgcctggtccatagtcaatattcaaagaatgcagctcctgcgccgatcaaactctcttagtccaatttgagtgtaatacactatcaatcagcataccctggcattttgataatgtttttcgagtttgagaattataaaacaacaaataatgaggcattcttatttagaattttaataaataattcacactattcagaaattttacaaatcagaagatttcaatgcacatttattgaaaatcacttccctaaatcaaattatctaaaagagcttaccaaaaccactgagtatagaaaggttataaaagatcgatttacttaaggtcaattatgcatatgaataatttatctccagtgtttaatgttacttaatctaaggataaaaattatttttaattattaaacttggaatatcaagcaatctctctttaataagctaaacttattaatgcttaaatgtgtatttggaaattccatggaattttgatttgcaaacatcacatataaggtacttcaatatctacttttaatttgtctgaaatgaattaccttgaatatacttaagacatatgctgtatgtaggaaaaaaataaatatgaatgaatcagcatgtacagaaacactaattttaatcagaatatgactttattttggccatttgcttaaataccaagtagtttatttgtttgaggaacaaaatattcatctccactttaatgtaaatgcccttcattccacaaagatcatgttagtaacattcttgcagattctccaacggagaattaatccaattataatgccatttcaaatttaaggttctaaaccagaaaatatagtcaaaaagaatcacaacaatatcagagttgagatcattagaagtcttcaacagctgtaagaacattctcttttcaatgatgctgtataatacaaaacttgtgagagtttactagcccaaagtcagtgataaatagggtaataagacatggacagattccattatctgtatgcactcatcatggggagatgtaaggaggccaacaacacatcatgtttaacagatttatcagccttattttgagatttggtatgaggggaagaattttttaaaagatttacttggaagacttcattctcaatctacacggctatcctttcttttaagttcataaatggatagtaagaggtatgtccccaccctgagttccagctctacacacatcttcaaaaaactcttcttcagtagataatggaattttttcccatgatgcacagatggctaattcccaaggctgtcttcacacagatactttttcttcatttcctcctaaaactaaaaattactttaaaaattttttttcaagaccatgtttccaatagtgcttgtttttcttataaggtgagaagaaaggccttcctttggctatctccctcaaaataattcaattaggaatacagaacattaaagagaatccttaaatgtcaatatgcctttttgtttaattttcatctgtatgtagaaccacgagaagtatgccatcaaattttccagcactgtgcaaacttacagtgaataaaaaaaaataaggtaatgtattttattcctttattatttcaaaaagcaagacaacgagttaacaataacatgacaccaagtatcatatggaaaagtggaaaagtgcccaatcactttaattaggtttataaacaaaaatacaagacatcaagtcagataatcaggaacaaaacaagcttcatctccctcatatgacctcagaataatcagtaatattgtgtatcccttttcaccctggaaaataagtccttcaaattccctttctatggcttatataaagcctgatgtgctccccaaggtttctgtaaatcaccataggcttacatgctcagggagctaagctgcagcttctatcaaagcagttcagtttacggagtatcacagcattctgcagagcagcatccatatgtacaagtcagctcttttccatgactcacacaaaataaaacttggtgttcgaagttttgaggaaggaaatatacatgatagaatgcaaacttaagattatccattaaaaactcttgttcttataggccactccagccattcccctaggggataacatgctgtgtcatcccctttctgttgttcctttcttctccagtttccccctattctgccctccccaaaagaaagtctgaagccactagttgacaattgttgttttccttgatgtggtctttaatttagctccatattgtaagagtttataatctaaatcagtgtttgtcaaactttctttttagcagaggaaccttttgaaaagtgaaattgtacaccaaactctaacatatgactaagagagtagagttgctgtttgaagtggaggcagggagtgaacttggagacttcccttcagcctcatcatctacctctcttgtctaatggctcccagtcactcactgaaagatcaggtcttcatatcatcaagtttgaaaaatattgaactacatacagaataagaagaaactgccaaattaggtacttttttgtatttaagaaataagagaagatgaatcaaagttgacctaaaaattatgtgcccgttacactgggagaaagataacaccattgatagaaatcaataaattgggaaaagcatacattacgtttagtgtcataattagtaatctataaatgtggatttatttcataatgcaattagatgaaatgcatataaagatggtgacttatgaaatgacaaagaattctaaagcttatcataaaacttaagcattttcaaatgaataataaatggccatattcatcaatgcctcccagtattataattacacatttttaattaaatctctgttgatataggataagctaaattaaatttcaacatctaactataaagaaagggactatttataattacccacaaaatagcttctacttgttatactttgccaaagagaatgattatactttttcctatctttcagtaaacctttatatagcttatagctgtctttccagaaggaatctaagttttttataaattgaagacaactaacttatatgagaaagagaatgaaactaacgtttattacatgcctaccataggcgaggcactgtgctgatgcttttatattaccagttttcaattcacactacatactaaaatcgcccagcaatcttttttttttttctgagacagggtctttccctgttgcccaggatggagtatagtggtgtgatatcagctcactgcaacctctgcctcccagattcaagcgattctcctgcctcagcctcccgagtagctgggattacaggtgcccaccaccacacccagctaatttttgcatttttagtagagacggggtttcaccatattggccaggttggtctcgaactccagatctcaggtgatccacccaccttgacctcccaaagtgctgggattacaggcgtgagccaccacgcctagccaggaatctttttacaaaacattttgattcatgagtgtatcctccagagattcagatttaattggtcaaaggtgggggccttcacttgagaaatttttaagcctctcatgtgataataatgtgcagccaggattgaaaatcacaattttatatactttatctcatgtcatcatcaaaacaatctgaccaggtaattatattattccttttttcagataagaaactggaatttcagaaaggttgtgaaatttgccccagggcatagagaaggtatcagagttagaatttaaattcagagttctccgacagcagcgatctttctaacctccactttgtcaaattcaaaacaccagaattattagtgtgaatttagagtagatttctatattttattttactcctggcttcaagaggtggtggagtaaagtatgttttacgttaatttgctagcaaaacacaatattctttattgaactaattaagctgttactcaaaatgaagttgctttgtattttataacataaagtatggaatattttctccctttcaaaatgttcctttttttcataggtacactatttaaaaattattgattttagagtttcttatcagagataagaaggaaaatgcaatgtaaaagtattcaaggaacaaaaagtagattatatttgccaaccattttattttgtcaaccacctttaagggagaaaggtaatttcttataaaatataattatttgttaaacagcagccaaaattaaacagaattctcaattaaaaaaaactttgttttacaaactatatccaatgtataagtattttaaaatataaatacatttcaatattttatttaaactttaaacaagcctatacatattataagttaatttaggaatgttttataacttttacgataagagtaaaatgttagcatgtaatttcaactgtcaagctgaaaataaatatatgaataaccttcattctattacttttcatcttaaaatatatcgttaatgggcttttttttaagtcataccaaaggtgatattaccaactccctaaggacaacgaattctgctaaactagaattcatatttcagagaggagatggataacatctcacaattcaacttcagcaggagtcattaagtcagacacctatgtgagggctgtatttctcattgaattacaaatccaataagagctttgcctttgaattactagcactacaaagattaaatcaatatactgtgaaaaaaggaaaaacccttggatgcttgaagattagaataaaacgcatgaattttttagctcaaatggacaaccatagaagtcattaatcctactttttcattatacaaacccgctacacggcttttgcagaggtccccctttcattcttcacccctccaatcctatagcgactgcactcagtttaatgtcccaaaatgttcatatgagctgtatggcccagcatgacccctaccttgcctacctgcctcccagtctcatctaacactatatgccccctcaatctctgaactgaagccactcagttctttccagaattcacgggcactgagctcttttccccaggaggatgtctgcataaactgttatctttttaggaatgtgttttttcatcttcacctcctacttctcctggataacatctaccttatccttttggcctctaacatagagaggttttctacatcacctctttccctttaaattcaaattgtttcttttttttagcaccctgtatatttctttcatttctactccattcgtaattacgtattaatttagaggactactgtttatgtctatgttaccagtaggctgttggcttcccaagaacaagaagcatgtctctttagttcattaatatatcctcagcaccttttacaatgccaggtgcataacagaagctcaataaatatttatcaaatgaatgaattaactggatactaaggaagagaggtaaagagcagaagctctagagtcaggctgccttggtgccatcattaattcaactacaaagtggttgttaattcttttacctttaaagttagcattttaactagctacttagagaattgttgtaatgattacatgacaataagtaaattatctagtacaggccaaagaaatgttaagttatcattaataattaccaagatataatgtttcattaatgtattatttaaaatatacatgtatatactatgtatatgtgtttgtattaatatatgtgtgtgtgtgtgtgtgtgttgtacattcattcttcttttagttaccaaataatcctattatgtacattgggatatgttgtttattcattttacagatgaaaatacagattgtgttataattgttttatccatgattggcttccatcttctttatcagtactttttttctaagtttttctagcataaagtaaaacttactaagtttggcatcctgcattggtggtataatggttagcatagctgccttccaaagtttgtcatccctaggtcatttgttactgcgttcagaagtgttcccttctcttcaatttttagaagagcttgagaaggattggtattaattcttctttaagtatctagtagaattcaccagagaagctatctgatcttgggcttttctttgttgggaagtttttgattactgattcaatctctatactagttacatataatgatcagattttttatttgttcatgattcattcttggctaagttgtatgtttctagacattcagccatttcttctgggttatccaatttgttagtgtagaattgttcacagtagtcttttaagatcctttctatttctgttgtatcagctgtcatgtctactctgtcatttataattttatttgagtctttttttctcttacttttgctagtggcttcccaattttgtatcttttcaaaaaaaccatctcttagtttcaatgatttttttctattatttttctatgttctcttgtatttatttttgctctaatctttaccatttctttccttctactaactttgggcttaatttgttcttctttttctacttatttgagatgcaaagttagattatttacttaaaatatttcttctttttgaatgtcaacagtcatggaaacttccctcttagtactggttttgctgcattccatgagcttggtgtgctttgttttcaatttcattagtctcaaaatattttcaattgctttagatttattctttaacttgttgtttatgcaagagtatattgtttaatttcaacatacttgtgaattttccagtttttcttctgctactaatatttaatatttagtttcattcaactgtggtcagaaaaaaaaaatacttggtaagatttcaatctccgtaaatttgttgatacttgttttgtaacctaacatgtagtctatcctggataatattctgtgtgcatttgagaagaatgtatattctgttgtttttgatggaatgttctgtccatgtttttttagttgcattaagtctaaagtattgctcaagtctgctgcttccttattgatattttgtctgtatgttctactcatactgaaagtaggatagtaaaatatcctactgttatattgctatctagcttttccttcagttctgttaatatttgctttacatacttaggtgctctgatgttgggtacatatatttatagttgctgtatcttcctaatgaatcaacccttttatcactatataatgtcctcctttctctcttagtacagtttttgacttctgtaaaacatagtactataagtcctagttagagcaattaggcaagaaaaagaaatacatagcatccaaatttaaaaggaagaagttaaattgtctctgaagatgacataatcttacatgaaggaaattataaagactacacacatgcaaacacacacacacacaaatacaccaatgttagaaccaacaaaacgtatcagtaaagttgcagagtacaaaatcaacatacaaataagtatatctgccatgaattaagctcatgtgcaaacatgtgtaattactggtcttgtgtcatctagactactttaaaaaaggtgaaaaaggtcctgtttagttccaaaagggagaaggcagcccctcctgtatgagtggaagctacaaccccttgaaattaataattacaaatcccttaaacccaaggtagaaaaaaggagaacacatatctctgggcatcaataggaaaagactaggtcctacagtaaatatcttagtaaaagaggaggtttgtaaactctctccggaaccagtatttcagactttctatgatgaactaaatgtgccagtaccagagactctaggaaaaaccaggaatttgtttttgcaattagccgcgcatgtagcccagtctctaaatgtcacttcatgttatgtttgtggagaaactgtaataagagatcaatggccataagaagcccaagaattagtgcctacagagccagttcctgatgaattcccagcccaaaaaaatcaccctgatcatctctaggttctaaaagtctcaattattgaacaatattgcatagctagaaaaaggaaagaattcactcattctgtaggaggacttagttgtctggggcaaaaactgtataacagtaccacaaaaaaagcagttatatggtggagttcaaattacatagaaagagatcctttcagtaaatttccaaggttgcagactgtctcggcccacccagaattccaccgggactggactgcccccaccgggttatactgaatatgtagacatagagcctacactaagctgcctgaccagtggacaggtagttgtgttactggcactattaaaccatctttcttcctactgcccataaaaacaggcaaactcctggcttccctgtctatgcttcccgcgaaaaatgaagcatagccataggtaattggaaagatgataaatgacctccaaaaaaaaaattatataatactataggcctggcacttagacacaagatggctcatgggaatactggacccccatttacatgctcaactgaatcatacggttgcaagctgttttagaaatcatcactaataaaaccggtcaagctttgactattctggcctggcaaaaaactcagataagaaatgctatctatcaaaatagatgggctctcgactacttgctagcagctgaaagagaggtctataagaaatttaaccttactaattactgtctacacatagataatcaaaggcaagtagttaaagacatagttaaaaatatgacaaaactgacacatgtgcccgcataagtgtagcacgaattggaccctgaagccatgtttaaaaatcagttcccagcactaggagaacttaaaactcttataataaaagttatgatagtaataagaacctacttactgcttccttgcttgctacctgtacttcttcaaatgataaaaagcttcatcgctatcttagttcaccaaaatgcttcagcacaagtgtactatataaatcactatcaatctattacaaaaaaaaaaagtaacaaaaataaaagtgagaactcctactaataaaaaagtgagagcctcaaaggggggaaaggagggaagagagagaccctctcatattgttttatattgttttatactcagtacctgtttttaaaaaaaacaacaaggaagtaaaaccaaagacaggcagcccagagccacgcctgaaaccaggcctgggcctgcctggcctaaacccagtagttaaaaatcaactcataacttaaaaatcgatgttattcacagattccagacattgtatagaacaacactgtgaaactccctgccctgttctgtttctctctgaccgccagcgcatgcagcccctgtcgtgtaccccttgcttgctcaaatcaatcacaaccctttcatgtgaaatccttagagttgtgagcccttaaaagggacaggaattgctcactcggggagctcggattttaaggcagtagcttgccgatgctcccagctgaataaagcccttccttctataactcagtgtctgagaggttttgtctgcggctcgtcctgctacaaaggaatcatacttctggatttcaaaaaagattacaaagctacactaattaagacagtatggtactaacataaagacagacatacagaccaatggaacagaatagagagcccagaaatgaaaccacatgttatttatcaattaaaaatgaaattaaaaatgttttaaaaatctacatgtgtaaagtcaactaatcttcaacaagggtgtcaagaatacagaatggggaaaaggtagttccttcaacaaatgatgctgggaaaactgaatatccatatacaaaagaattaatttggacctttaccttacaacatatacaaaaatcatctgaaaatggattaaagacttaaacataagacctgaaactgtaaaattcttagaaaaaaataggggaaaaacttcatgacattggattggcaataatttcttgggtatgactccaaaagcatgagcaacaaaagcaaaaatagaaaagaaggattatattaatctaaaaattttctacacatcaaaggcaacaattgagagagaagacacaacctatagaatggaaggaaacatttgcaaatcatacatctatctgataaggagttaatatctaaaacagatcagtaattcaagcagctcaatagcaagaaaacaaataacccaataaaaaaaatggcaaaggacccgaatagacatttctcaagagaaaaaatacagatactcagagtatatgaaaaaatgtgcaacatcactagtcatcaggaaaatgaaatcaaaaccaggagatattaccttacatctgttaggaaagctattatcaataaacaaaaaaagatcacaaatattgaggaggatgtgaaggaaaaggaatgcttgtacactattgatataaatgtaaaatgatgtcacagctatggaaaacagcatggcatttcctcaaaaaaattaaaaataaaaatactatatgatccagcaatcccgcatttgggtttatacatgaagaaaataaaaagtagctggaagagatatatgcactctcatattcatcacatcttttttttttttttttttttttgagacagggtcttgctctgtcccccgggctggagtgcagtgatgtaatcatggctcactgcagcctcgaccacttgggctcaaacaatcctcccacctcagcctccctagagctgggaccacaggggtgtgccaccacacccagttaatttttatattttttgtagaaacggggttttgccatgttccccaggatggtcttaaaccctgggctcgagaggtctccctgcctcagcctctcaaagtgctgggattacaggtgtgagccactgtgctcggcctcacggcatcattatttacaatatccaagatgtttaaacaacctaaatgttcatcaccaggtgaatggataaaaaatatgtggtatatacatacaatgaaatattattctgtattgaaaaacaaggaaatcttgcactgtgacaacatgaatgaattcttgagaacattatgctaagtgaaataagctagtcacagaagaacaaatactgcatcataccacttatatgaggcatatgaaatagtcaaacacagagaagcagagggtagaatggtgggtgctaggggattggggagggagaaatggaaagttgccattcaacaggtataaagtttaagatatgcaaaacaatttagttatagagatatgttgtccaacattgtgcctctagttttcatttgatatattgttcacttaaaaatttgttaagattgtagttctcttattgagtgcttttgtcacaataaataaattaaaataaataaaagtagtaatctctgaagatcaagagagaagaaataacaaaaaagtaaaaatatgaataaaaatacacttctttcttcagttttctaaattatgtttgatagttgaagcaaaaattaaaacagtcttacgtgtttctcaatatacataaaacaaatatttaatatatttatataataaatgagtgagataaaattacataaagggttctacattttcctcaaactggtaaaatgtcaactttattaaattatgataattatgtgtatataatgccatacctcgataaactactaaaatagctatataaagatatatactcaaaaatactatagacacatcaaaaaagaatctaaagtgtattcaagtaactgacaaaaagtcatgaaaaataaattaaaaacagagggaacaaacagaaaacaaattagatggataggtagatagattagacataatccttaccacatcaataattacttaatatacatggtctaaatacaccaattaaaagacagaggttagcagaacagattaaagacctaactcaactacatgctatccttaagaaacttacttcacacatcatgatacaggtatattaaaagtaaaagggtggaaaaagataaaccatgcaaacattaatcaaaagaaagtagctttattaatatccagtaaagaagactgcaaagacagaaaattactcaggagagagggagacattacataatattaagagtcaatccttcaagaagacatagctagcctaaatgcgcatgtacttaacaacagagctataaatatagatgaagcaaaaactgacaaagctgaacggaagagtggacaaattcacagttatagctgtagacttcaacatccttctctcaacaattataagaacaactagacagaaaatcagctaggatatagaaaaattcaacaataccatcaaccaacagattctagtcaacattttatagaacaccttacctaacaacattatttttaagtttttcaagttttcaaatttgttttaaatttttcaacaaattctcaagaccacgagtgggacaaggaaatatcctacaggcagcaaaggacaataagggtaaatacatattatttttaagtgcccattaaactatattaagatagaccatatcctgggccataaaatagcctcaatatatgtaaaaaaaaattagtcacaaagagtgtgttctctgcgcacaatcaaatcaaaatagaaaattgattattgaaagacaacaggaaaatctgcaaaagagaaaacattccagctctcactgggcttgagtttttaaaaaaagaggcagagaaacagaaaatatctcacatcagtaatctaatcatctatctcaaaaatctagaaagaaagcatgaaatacacccaaagtaagcagaaagaagaaaataataaagaacacaaataaaattgaaaatgaaaatcgagaaattcaatgaaataaaaaagcttctctttgaaactatcaagataaaatgttaaaattctagaaaaattaacaaaaataaaagagaagatacaaatttttaagaccaggaatgaaacaaggaaatatcctacaggcatcaaagcacaataagggattatacaaacaactttaacatgtaagtttgacaagttagatgaaataaaccaattccttcaaaagcaaaagctatcacaactaactcaatatgcaacagataatttaaatagctctataattattaaggaagtggaattcataatataaaaactcctggaaaagaaatctccatccccagatggttttcttggagaacactgccaaatatttaaacatatgtaacacctgttctacccaacctttctagaagataaaaaaagagggagtactttccaatcaattttattactaccatgataccaaaaacaaagatattataagaaaactgcaaattaatactcttcattaatagagatgaaaatatttctaataaaatattaacaaatagaattcatccatatgtaaaatgaattgtataccatgaccaagtaagatttattccagggttgcaaggctagtttgatatttgaaaatcaatgtaatctaccatattaacaaactaaacaagaaaaatcatatgattatgtaaattgatgcagaaaaggcatttatctgacaaaattcaacacccatttatcacacaaactctccaaaatctagaaacagagaagaacttctatatcttgatttttaaaaatctatcaaaaagagatctaaagctaacattgtatttaatggcaaaagactgaaggctttccccctaaaataggcaacaaagcaaggatatcagctctcaccacacttacgcaccatatttctggaagttctaatcggtgcagtaaggtatgaaaattaagtaaaagacatacagatttaaaaggaagaaataaaactattcctactatctatacatgacataattttctatgtagaaaatcccaaggaatccaccaaaacgacaataataacaattcctgaactactaagtgatttcaggagggttgcaggatataagataaacatacaaaaatcgattttacttgtatatactaataacaggtgaaaattaaaattaaaaatataataacatttataatacctgaaaaatgaaacaattaggtataagtctaataaaacgtgtacgacttctatactgaaaactgcaaaatgctgatgaaagaaatcaaagatctaattgaatggagagacatcctgtgttcatgaactggaagacaacacagtaaatatgtcaattctcctaaattgatatacaagtttttataattcttataaaacctaagaaaaaaattttagacattaaaaattattgtaaaatatacatggaatgacaaagtagctaggatagctaaaaacaactttgaaataggaaattaataggaataactctaagtgatttcaagacttattatatagctacagtagtcaatgctttgtgatattggccaaggaataaacaaacagcccaataaaatagaatcatgaaactagaaatagccatacacaagtacagcaaattgatttttcacaaatatgcagaagtaatccaatggaggaacaaatagtgctagagcaactggatatcaataggcaaaaagtaggaactttgagaaaagtctcacacttcataaaaagttaactcagaatggatcataaatacaaaatcaaatgtaaaatataaaacgtttaggaaaatagcagaaaagaaattttggacctagaactcgttgaaccattcttagacacaaaaagcatgacacataaaagaaaaaatagataaagcttacttcattagctacaaactgcaagaaaatatttacaaaactaatatctgaaaaggtctcatatatagaatgtataaacaactcttaataattaacagtaaactactatacaaaaaatcctattagaaaataggcaaaaaacatgatgagtcatttcactgaagagtatgtacagacagcaaataaacacatgaaaagatgtttgacatcactggctattagaatgaagatcataatatcactacacactgattagaacatctaaaataaaaaatagtgaaaatatcaaatgttggtcagagtgttgaataactagatacattgctggtgggaatgtaaaattgctctggaaaatagtttggcagtttcctaaaaactatgcatcacataccataacctagcaatcacacttgtgggtgtttctcttagagaaattaaaatttatgactacacaaaaatctgtacccaattgttcatagaagcattatttgtaatagccccaaactggaaaaaacagaatgtcctaccatagtcaaatgtataaacaatggtatatcctaccatggaatactaattagcaataaaaaagaataaactatcaatatatccaacttggatggatctctaaggcattatgctgagtttttaaaaagccaatctcaaaaggtcctacactgtgtaattccatttataaaacactgtataataacaaaattatagaaatggagaatagatttgcatttgccgagggttaggcacggggcaggggcaggtggtaggggtagggaggggcaggtgtgattggaaagtggtagcacaagggagatatttgtagtgatggaatatttctgtatcgtttttgtgttggtgattacacaaacccatatatgtgataaaactatatacataatttatgtcaatatgtcaatgtccttgttttgatatcttgctatatagttacacatgatgcaacctatataggaaactgggcaaagggtacaaagaacctctctgtgctgtctttgctacttcctttgaatctataattatttcaaaattaaaagtttttttaaaaatttagtttctagtctttgagaggtattcctgggacgaaaatgagagaagatggataggctttcccatatagcataaacagctgaactaaaattaaaagcagttatcaagtagattcagtcagttttatttttacaagtgttaggtttaatataaaagtcagaaactaaataaaatgaacagtcaatacttctaaaggagttgtcaaattagaaagagcttgtttctacaaaagacaacataattatcacaaatagtgattatcatatctctgctatgcaccaaacaaaaattatttttctcttcccagttgtaagccaactgccatactaaccgtcttgccaactttgtattttctttgcatattccttttctcctgagcccccagtactgcacttaaaattgccaaggaggaagggagacttagaaactgcaagaggctaaataaacatttgcctgtgactattccacagcataaattatataatcactaggtattcaatgattctaatttaatactgctaaagagggcaggtgatcataacgcacattttagaaatatcaattgtgggtcacctgaaaaagtttcagtcattcttaaatgcaattaccaatatcattataacataaatgcactcagacaaaactaaactcattaaaatggaattctgcaagagtgtaacttacctagctttcttggttttttttcacactggacactagaatctttacccttataattagataaggttcacccacttcagatctctgttataagtgtttaatttatatacactggtttaatttttaacccgagacttaaagaacatgaaagatttgcagggattaactaaatctattctttgtaatagaatccattaataattttctctacatctttctacctactaacatcagttttggattctttctaataaagctgtaactaacaactcttgaccattatggctaaggagacagtctaactcatcctagaataccctctaggctattccctacatttgttgttagggtaattcagatcctttatgttcttctcaaagtaaagtctttgcctaaaaaattgtatagtattatgattatctattattgtgtaagaagccattgcaaaacctaatgtttaaaaagcaacaacttctggccgggcgcggtggctcatgcctgtaatcccagaactctgggaggccgaggcaggtggatcatttgaggtcaggagttcaagaccagcctggccaacatggcaaaaccctgtctctactaaaaatacaaaaattagccgggtgtggtggcacatgcctgtagtcccagctactcaggaggctgaggaaggagaatcacttgaacccaggaggcagaggttgcagtgagccaagatcgtgccatggcactccagcctgggtgacagaacgagactccatctcaaaaaaaagaaaaaaaaaaaggcaacaattttttattctttcttatggttctgaggtttggctgggctcagctgagatttgacacatcaggtctctgagcagctgcagtcaaagtttggctgcagtgggaaccatataaaattttgaataggctagacatacaagataccatatttacagtgctggcagttaatgcgggcttttggctaggaatgcagctctatcaaccagagtgcctacctaattgttatctctctgtgtaggctgggcttcatacagcctagaaattgcattctgaggggaaatgtctcaaagttgagcactccaaaacaatcaggtgaaagctaaaagcctttttataatctagcctcagaagtcctagaatgttacttctgccatatttagttggtcaaccaagttattaagtccagccaagattcaagaagaaaagtattaaactctatctttttgatggaggaaaagcaaagtcatgccagaggagaatttgcaaaatgtgaaatattgttgtagctatcattagagaatacaatctatgacatatagaaaatttcattcctttccaatatacaagtataaaatgccacttgcttattttactggataaccctaggaatgacagcatggtgaggtagctctagatatccctgacctaagtattctctctcctttcttttattaccccaacagtagcatttttaaagttataaaaatatagaggttatcggccgagtatagtggctcacgcctataatcccaacagtttggaaggccaaggcaggtaaatcacctgaggtcaggagttccagaccaccctggccaacatggtgaaaccccatctctacttaaaaaatacaaaaaaattagctgggcattctggctcacacctgcaatcccagctactcaggaggttgaggcaggagaattgcttgaactgggggccagggattgcagtgagccgagatggcgtcactgcacttcagcctaggcaacagagtgagactccatctcaaaataaaaaaaggttatccaacattaaaaacatcatgatgtagccaaattctattaataccagatgtacaaagaagagctggtaccattcctacagagactattccttaaaattcaggaggaggaacttttccccaactcattctacaaggccagcatcatctggataccaaaacctagcagagacacaacaaaaaaagaaaacttcagagctatatccttgatgaatatcaagacaaaagccctcaacaaaatactggcaaaccgaatccagcagcacatcaaaaagataatccaccatgatcaagtagacttcatccccagaatgcaaggttggttcaacatacacaaagcaataaatatcactcatcacataaaaagaacaaaagacaaaaaccactattatctcaatagccacagaaaaggcttttgataaaattcaacacccgttcatgttaaaaacttctaataagctaagtattgaaggaacatacatcaaaataataagagccatctatgacaaacctacagccaacattatactgaaagggcaaaagctgcaagcattcccccttgaaaactggcacaagataagaatgctctcttgccacttctattcaacatcatattagaagtctaagccaaagcaatcacgcaagagaaagaaataaagggcatccaaataggaagagaggaagtcaaactatctctgttagcagatgacatgattctatatgtagaaaaccccatacccatagtcttagctcaaaagctccttcagctaataaacaactttaacaaaattttagtaaacaaaattgacttacaaaaatcactagtattcctacacaccaataacagccaaactgagagaaaaatcataaaggcaatctgattcacaattgccacaaaaagactaaaatgcttatgaacacagcttaccagaaaggagaaagatctctataacaagaattacaaaatgctgctcaaagaaatcagtgaagacgcaaacaaatggaaaaacatccaatgctcatagataggaagaatcagtatcattaaaatggccatactgcccaaagcaatttacagattcattgctatcctatcaaactaccaatgacattctttacagaactagagaaaatgattttaaaattcatttggaaccaaaatgagcctgaatagccaaggcaatcctaagcaaaaaaaaacaaagctggaagcatcacgttacccaacttcaaactatactacagaacacagttaccaaaacagcatggtacaaaaaaagacacgtagaccagtggaacagaagagaggcccagaaataaggccacacatctgcgaccatctgatcttttgacaaagctgacaaaaaataacaattgggaaaagactccctattcaataaatgatgctgggataactggccagccatgcacagacgattgactctggaccccttccttacaccatatacaaaaatcaagtcaagatgaattaaagacttaaatgtaaaaaccaaaactataaaaacactggaagaaaacctaggaaataccatcctggacataggaatgggcaaagatgtcaggacaaagacaccaaaagcaatcacaacaaaagcaaaatttgattaaacctaagagcttccacacagcaaaggaaactatcaacacagtaaacagacaacctacagatgggagaaaatatttgcaaactatgcatctgacaaaggtctgatataagaaacttataagcatctataagagacttaaacaaattgacaaaagaaaaacaaccccattaaaaagcaggtaaaggatatgaacacacttttcaaaagaagacatagatgtggccaactagcacataaagaaaagctcaataacactgatcattagagaaacgcaaatcaaaaccacagtgagataccatctcacaccagtcaaaatggctattactaaaaagtcaaaaaataacagatgctggcaaggttgcagagaaaaggaagcacttatatactgttggtaggagtgtaagttaattcagccattgtggaaagcagtatggtaattcctcaaagaactaaaagcagaactgccattcgacccagtaatcccattactgggtacatacccaaaggaatataaatcattctatcataaagacacatgtacacgaatgttcattgcagcatgattcacagcaaaaacatggaatcaacctaaatgtccatcaatgacagatttgatgaagaaaacaaggcacatattcaccatggaatattatgcagctataaaaaataatgagatcgtgtcttttgtgggaacgtggatggagctggaggctattatccttagtatactaacacagaaacagaaaaccaaataccacatattctcacttataagtgggagctaaatgacaagaacttataaacacaaagaagaaaacagtaaacactggactcttcttgagggtggagggtgggaaaagggagaggagcagaaaagataactactgggtaccaggcttaatacttgggtgattaaataatctgtacaacaaactcccatgccacaagtttacctatgtaataaaccttcacatgtacccctgtatctaaaaaaaggttaaaaaaaccacaaacactatgatggagaaggcaattctgcatagtgctatgctgtctaccatggcagccactggccacatgtcgctattgaacacgaaatatggttagtccagctacactataaatgtaaaatacacatcaaatttcaaggacttataactaaaacagaatgtaagatatctcattatgatgtttatattgattgcatattgaaatgatgatattttgcatacactgacttaactaaaattaatttcacctgttccttttactgtatgtagctactagaaaatttaaaattatctatttggctcacatattattgtagtttgcataatatttccataagatagtgctggctaataaaataaactgaatcatattttccagtatatagtaccacaaaaggtcatggtttttgtaccattaaatggttttcaggcattttaattgcttcttgctaaatcttatgtgagacatataagcatattcaaagtaaatattttggtacttctaggccaggcgcagtggctcacgcccataatcccagcactttgggaggctgagacaggcggttcacctgaggttgggagttcgagaccagcctgaccaacatggagaaaccccgtttctactaaaaatataaaatcagacgggtgtggtggcatatgcctgtaatcccagctactcaggaggctgaggcaggagaattgcttgaacctgggagtcagaggttgcagtgagccgagatcacaccattgcactccagcctgggcaacaacagtgaaactctgtctcaaaaaaaaaaaaagaaaaacaaaatatattgaccaggcctggtagtgcacacccgtagtcccagctattcaggaggctgtagtgggaggatgacttgagcctggaaggtcaaagctgcagtgagctgtgatcacatcactaccctctagcagcctgggtaagagagcaagaccctgccaaaaaataaaaataaaaacaaaataaaaagataaattaatatatttcaatggaaattgatttatgaatataagacagccaagatgatatgagggactcataactgattaacattgaagaaaaataggcaaaaattaaaattcagcttgttttagaaggaaaaaaatattgggagtttatcaaatatttaaaagaaacacatttgcaaactaatggccagtacttagtctcatatccttcctttctttcttccctctacttttcctccaaactgaacttcatatatttcctacaacaaacaacctatgtgattcctgctctgtgcctttgcacaggctcttacccctttctggaattcccaactccctcaactgtctaatgagtacctacttctccttcaaaagccagcttaagagctttctctcctctgaagcctgatccaccccaggggagttaaccacttactacttggtgctcttatagtacttagcattcatcagtattacagtttttatcatgttccatttcacgtacttgtctgtttgattctccttgacaactaagactgcagttgttagtactttgaaaccaccacttcttagcacagtgtttatagaagaattatgtaactagaaatgcagtaacaccaatagcattttaatttaaattttacagtttagctatctgttatagcccatacaaaatctgtcagaaaaatgtgttaaatctctctcaaaatccatcatatgtattcttgtgtttattatatatatacatatgtataatacatacatatatatacacacacacactatagtcatatagtcatatagtttctaggtggccatacctctcagtttgcttgagatgccttttgtagatcaattaaggtctgttgaccattttatgaatctttgtctctcagaagtaacgcagttttggccgggcacggtggcttacgcctgtaatcccagcactttgggaggccgaggcaggcagatcatctgaggtcaggagttcaagaccagcttggccaatgtgatgaaaccctgtctctactaaaaaatacaaaaattagccagctatggtggtgtacacatgtaatcccagctgctcgaaaggctgaggcaggagaaccacttgaacccaggaggcagaggttgcagcgagccaagattatgttactgcactccagcctaggtgacagagccagaccccatctcaggaaaaaaaaaaaaaaatgtatcccggtttggataacaaattacatgtttctcctaataattttctaaacattaccaatagtaaattaaattctctgtgaagccaaatattctgactatagttgctaacacaggataatatttcattgttcaagggctataaaaacaaccttttgatttttgctattaactgttgtagtgaataatgtggtgcttcacccagatttcctttataagggattcccttttcagctggaaataccagctgtgatggctcacatctcttttcctcactgggaacagtcctcagttgcaggaacctgcctcatccaaagttacagagctcctgggatgatatgccatcaatgattgacagttgcaggaattctaagggtccattcccccgtttcaatatgagacaattctgaaaggccatcccagctccaacactccccataggacagctaagatttccattgtaagttggcttctctgccaatctgcctttctttatatgtttccttatatgtttattttctgaaagactgtcccaacaaaacttttttgtactcaaatttactttcaagtctgttctagtgtatatgatctaagacaacaatcactcttcattctaccatcagctcccacctaggaactctactaggctcaggacccttatatttcgtccaagttagaactaatacttcatgccaggattcttgattcttactatattcctgtcatttctaccatttgacctagttttattttatgtaacaaacaactctgagtaaagtttaatgttaaaaaaccatagcaggaacttctaacatatgaggaatgcctaaacactagggagtaaaggaacccacttcttgggaaaggatcagttggaacaatccacaaagtgaatgactgacctgccccacaggtattagaaatcatggctgcctctgctggaaggcaaatgacaaagggctctcaggctttaagctctctggccaagaggatgtaacctttagggactttcacctctgtattgctctctgcttttcacctctgtattgattgctctctgcaagacttaagttttgacactttggaatattctccattactttatagttacttttattttacaaaaattatttcattctcctcctgtgctctggctctatctgattagtttcccttttattaaaaaagataaaaatggctgcctactttttattatttcagcttttcttactagttccgcaatcacatagcttgcatttctgtaggattctcacaattaatttttattattaagagagattagtacattagagcacaaagaagagatatatgagaatagtctgtttcctcaatagaggaacccagatgcctccttttccccaatgagcactgcacaagctcctcttaaaccccaaagtggatattctatgccagatctacgtgacaccaaacttaacttgtcaagaaggatttggaatcattatttaacagtcatctatggaattaaggaacatttagtagaggaataagactaggaacccagagcagctcagaaaaataatagctgaaacaataaagttatttccaaaacaattcacatatgcaaatacctgtgtaatacttagtccttaatttaggcacagaaaagaaatcagagaaaaaaaaagcattttgccaacttaaccagatccccactatttattatttctctcaactcccagcttgttgaatcatcagctcctatattccagcttcaatatctaaatccagcctctttcattgggatgattcctttatatcttcttggactttgactttatgctctaatcaatctgaccttggttgatatctctgtttttggcatatccactcttgcacagacctatataggatactatttatttcttttaagttatccagatatctgtaaactgaaaaacattatctctaaccaaatcaaccactcaaaaatcagttaccactacataataatgaaaacggttaagaatataaaaatgtaaagcatctagtacagtacacttgaggtgataatgacaattctcatatgcagtccatgccaaaaaaaaaaaaaaagaaaggaagggagggaggaagggcaagaaggaagggatggagggaaagggagggagggagggagggagggagggaaagaaggaaaaacataggctgaaaactgcctttacatttttagaattttaattctaacctgtctcttgtattcaaaaagccattgcatattgttcctcccaactgttttaccatatcatcataggaaataaaaataaattaattaattaaggctggaattatttccaaaatgcattttcaggagtgagatggaggtctatacaaaaggaaaaatcccataacatctcttttcgtgtaggctttatatgaattttcagaatttcccaagacatggaatgcattaaactcaagacacacaataaaacaggtttctgaataacaaagccagtccatttgattctttattcactcagcaaatacgtaatgagaaccaacaatgtgcttccacataaaacaccaagagaagaaacaagtgggtggatgagaggtccagaaatgcaaattagttcctgcatggagctcagatctgacttgtttactctagcagcattatctctcactcagttctaataatcccctatagtcatgtatcacctgaatattaactttactaataattatatgtcacctatctaacacatccaacccaactacaacaatatgatttcaacccagtcccagaaaaatatccatgcttggtgttatcttagaactcaaacatgatggctgcctacctacaattctattttcaccaattacagaaagatcaccatgtaaaaataattgatttcctgaagatcattcctttttcacagggcctcgttgctctgccccatttataaaaaaattccttaattatgttatacatcagagaagatgaactaggtctaaccagtcatagagatataacaaaatcagcagaaatatcttagaaatatatatatccctaagttttaaaagacaaaagctatattttttctgatcctaaatgtttcctggagtgtatttttaatgaataaaaatcctgttctagaatagggctggatgtggatccaaatgcagagattaagataaaaaagaatttatttctggatatttacattgatttccagaagagatttaatgctttgcaaaataagaccttttataacaggcagtccattgtataaatgtagtagatgcttgaaactcatttcagttaatgtcagagaggctgtttctccattacatggcatatacaacatgcaatcatttcattcactctttcatccaaaaatacaattcagctttttctaaattctatgcattgtgcctgaggcttgggataaaactaaacaaaacagacatgtgatctgcctgcacagagcttaaagtgtatgagggatgctgtctataatggattcgaaatgaaaggattgataatgattccaccaaagagactagggaagactagtattgatataatgttgtgagtctcccagagatgtccacattcaaattcccagaacctatgaatatgttacctgacatggcaagagggattttgcagatgtaattaaggttaagggccttcagatgggaggattatcctggataatctgggtggctcccactaatcacatgagtcctaaaaagaagagaatctttccaaggtgtggtcagagaaagagatgtgaggttggaagcagggtcagagaaacatgacgttgctggcttagaagatggaggcagagggccatgagccaaggaatgagggtgacctctagaaactggaaaaggcaaaaataatggactcttccctagagactccagaaaataatgcattcctccaacaatttgatttttactccagtgaggcccaggtcagacttttgattacagagctgaaagacagaaatttgtgtggtttaagacactaagtgtgtggtaatttgttacagcagcaatagaaaactaaccaaacatatatacatatgtatccactcatataaatttaacaggacagtatatattagggcaaacatacataatcaatagtgttaagtggttgtctgttttgtccgttatagacccatctcatctcatttcttgctaatttcttcttaatgtgacaagacattgaacttattgaacgttgagattccattttaaaaaatgatcaagacttgctgatctgtttaaggaactgaatttatttagactcagaggagtcatatggttgtgtggactgagcctgagacaaacataagctgcattcatttctcattgcggaactgctctggctggacgcaacagatttgcaaaatttaagccaatctctgaagtccccttcacctaaaagactcacaggttttgatgaattaatcactttcagttttcatgcttatcatcaagcatttgctccatcagcacagctcaattacaaaagctactgactgatctgaaaaacaactgggtccaccaaaggagacacagtattccttaaaatagaaagatgaggacttaagtattagagccatcccaagtctttgagcaaacggtgagcaaggtttgagttcagctagttccagaaaaatgcattccctttcattaaaactgatgcaacagctataaagaagcattatttgtgatagaaacctggagtgacagtaaacctggggatgagatacaataatacactccacagttttccaggttggttcctgctacttaattacacttaattacaatattcattagttcagtccaatttgctcagtttaagaaaaccataaaatcaccattattttgatgtgatatgtgtttattatacacaggggcagcttcagggacctgctactgcacataggatcccaattttagacaggggtcccaggcttgggttttcatgctctgctaccacagtcttgaattttttaacaattttacctgtgaatctgtgtagtccaatgcagcaatgaagcacatgtcttggctcatatgcagtcctgcctccgagtgacttcctgggataggtcctcagccacctgttctcccacccagtgattactgccaccctttattccttgtgggggccttggcacaccctggggtgggtcagggtcatttggtggggccacagatgcctgtgagggtctgcagtcactttataagtacctctatactctagaaatctaacattaaatagcaaataaaaataacctttcataggtcatagtctctcgtgacctatatgtcacgagacatatagtcactttataagtacctctttatatagtcactttataagtacctctttatatagtcactttataagtacctctatactctagaaatctaacattaaatagcaaacaaaaataacctttcataggtcacgagagactgtgtaagaaagctacagttcctttctcctgctttttgaacaagaagcctcacattttcattttgtattaggccccacaaattacgtggccaaccttacctatgtatgtgggtaagtgtgcacatgtatatatatctgaatttgtacctataaagaataaaataactttctattttagataaattgaacttacaattttataatttctaggaaaaataaatgtatatataactttactatattttatctgtaaagaggaaaataataattgtaacagtttgcatatcatgaaagaaggcatttcaataaaatattatcttctaagttttttatgactgatgaattaccttgaaaaatctttaagaatatattatatgctaaaaatggggatattctagcttcaggcattctaggacatgtcatgtctaggacatgacaatactaaaattttcttattaaagaaatctaccttacaactttgatttatcgacaggtgagagatttctggtcaggaaccaaagtcatcaaatattaagagtatgaagatacatcaaatgtgttgaagggtcttcaaaatgcaccaaataattttagtgcatttcaattattcacataattgaacaatctcaaatatcttaaattcatacctgaaaagtcataccctttgtaactaatcattctcaaaacacacctacatgaatcttgaattcttctatttataataatgcagatgaacaaaatattgctattataactttcattttgtttagctctattatttaaggaatcttcataatcaatatataattgaaaatatattcaagatttttctcttcactttataaatattaccaagatttgaggggaacaatagttacagacattccatagatgaagagatatgtatttcatatatatgtataaatacagtgaaacaaaatggactttgaaacaaatatttttgccctaaatttagacatttacaatatttctgatagctaaaacttcaaaaaaaaaaaaaaaaaaaactagacactgtcacatttgaaaaagattaagagctgccaaaactacgtgggtgcctgtaatcccagcactttgggaggccaaggtgggagggtcacttgagcccagtagtttgacaccagtctgggcattatggcaaaaccccatctctacaaaaactacaaaaattagctgggcatggtaacacacctgtagtccaagctacttgggaggctgaggtagaaggatcatatgagcccaggagttcgaggctgccattagctgtgattgcccaactgcacttgagcctgggcaacagatcaagaccctgtctatctccataaaacaacaacaacaaaaaaacataacaacctgcatgggctctttacacgccttcaaacatagctcatgatccctgtaatatcactgttattggatactaacttctaatggcctttcattattcactaacttgatcctgagcaatctgcccctctctttatcttctttatatttcttaaattgatgtgcaactctagtttcctttctccaatcctgattcccttcttcaactaatagtgagatacttccacaaacaaaacaatcacctgtaaatacccttctggttctgatctcatccctagaaattcccagggttgttgttccctgtaaataaccaagcagaactcacttagaaaatcaacctatgtaaaatcacatactcatttgtaatttaccctattttgtatacggaaagtatctcagcctatattcaaagtacaagggaagaggggctagggatgggaaggcaaaccagtcacctacgttgttcatgtactctgaaagcagatcctgaagagcctggcgaatggcgttgcattctgcgataatccgctctcggtgtaagtccctcgtacatgaagaatccgccagcagagcagccccactgataatggcttcaaggcgtttctctagtgatggtcgtatttcctcctcagttactgtgagtggattcaggacaattaaattctaagagaagaacacatttgtatggttagagctccatggcatttcacttttatgaaaaacaaatgttattttgtttttgcatttagaattcagatgtgataataaagagaactgtgttttactgcctcggctggttcacacataatgctatgtagtgattattattctgataaataatgaaagtgatgcaattatgagcttttgttctagcctcagacagacctggattcaaatcttacatttctccctcatgcaggtgtcatacacttgctgagcctcaacctcttgatctataaaagcagaatattaatgttgcgtgtgttgtaaaactgttgtaagaatgatataaatgcttaatacactgactggagcatattaactgttatttacaatagtaacttttatagactgcactgtttatacaatattttcatgtatctcatcctgacagcaccatgaggaagtaggcagcaaagtattaataactacacatttcagctgatgatgagtgaggctgaaaggctgtcttacccaaggtcatagagcaaataaacagtgacgttcagacaagtatccatgtctttcaataccagatttaatattattttcattatgcctcactttaaatcataaactttagttaactttaacactaacatatcaaagtaaattctgaattttaattatttaatttaaaacaaaactgcttcttcctgttgatctattataacttccagctatttccagctattagaacctgacacggtatttttaaggtttccattagacatatcttcaggtaatagaagtcgagataatctacagcctcttaagaaaagatggaaggtatatgctgctctaagggtcttttattaaaatactccaagagaggaagtctttccaagattaggcataatgtgagaattgaagaaagagatagtgtagaataaaagctctctgaagaacccttaacatgaaatgcaatcacataatgatcttcagagtgtgaaattctgagtgtgaatctacacacaaacacactgtgaagatattataagatcttcctagtatataatcttatgtataagattatagatatgtatatgtattttatataggtagaggtgtttaagtatgtaaataagtatatgtgtgtgtgtttatatataaaatcttatacttatcattgtgttacattacattctgataaatatttggggattgaaagtagccaggatacaattttaaaagccacaactgcagagtcaagctaggaagaaaaaattattatagaaaaagatatagttttaaaacattttttttaaaaaaacagcactgtgtaatgttcccttactataaaatgtgaggggttttgagtgagtttcttaatcctgagtcatgagtgaactcccattcacaattgctacaaagagaataaaatacctaggaatccaacttacaagggatgtgaaggacctcttcaaggagaactacaaaccactgctcaatgaaataaaagaggatacaaacaaatggaagaactttccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacatcagcaagtcaatcctaagccaaaagaataaagctggaggcatcacgctacctgactttaaactacaccacaaggctacagtaaccaaaacagcatggtactggtaccaaaacagagatatagaccaatggaacagaacagaggcctcagaaataaagccaatctacaaccatctgatctttgacaaacctgagaaaaacaagcaatggggaaaggattccctatttaataaatggtgctgggaaaacgggctagccatatgtagaaagctgaaactggatcccttccttacaccttatacaaaaattaattcaagaaggattaaagacttacatgttagacctaaaaccataaaaaccctagaagaaaacctaggcaataccattcaggacataggcatgggcaaggacttcatgtctaaaacaccaaaagcaatggcaacaaaagtcaaaattgacaaatgggatctaattaaactaaagagcttctgcacagcaaaagaaactaccatcagagtgaacaggcaacctacagaatgggagaaaatttttgcaatctactcatgtaacaaagggctaatatccagaatctacaatgaactccaacacatttacaagaaaaaaacaaacaaccccatcaacaactgggcaaaggatatgaacagacacttctcaaaagaagacatttatgcagccaaaagacacatgaaaaaatgctcatcatcactggccatcagagaaatgcaaatcaaaaccacaatgagatgccatctcacaccagttagaatggcgatcattaaaaattcaagaaacaacaggtgctggagaggatatggagaaacaggaacacttttacactgttggtggaactgtaaactagttcaaccatcatggaagtcagtgtggtgattcctcagggatctagaactacaaataccatttgacccagccatcccattactgggtatatacccaaaggattataaaacatgctgctataaaaacacatgcacatgtatgtttattgcggcactattcacaatagcaaagacgtggaaccaacccaaatgtccaacaattgtagactggattaagaaaatgtggcacatatacaccatggaatactatgcagccataaaaaatgatgagttcatgtcctttgtagggacatggatgaagctggaaaccatcattgtcagcaaactatcgcaaggacaaaaaaccaaacaccgcatgctctcactcataggtgggaattgaacaatgagaacacatggacacaggaaggggaacatcacacactggggcctgttgtggggtgggaggaggggggagggatagcattaggagatatacctaatgttaaatgacgagttaatgggtgcagcacaccaacatggcacatgtatacatatgtaactaacctgcatgttgtacacatataccctaaaacttaaagtataattaaaaaataaataaataaaaaataaaatgtgagggtactccaaaaagttcacgtaaaaagtggagttaaaatataaaaataaaaaatgtaaactttatttctcaacgtaagctccatcaagttcaagaaatttatgcaagtgatgataccagctatttagtctacctctaaagaactgaaggttctgggaattcaactatgtcaatgcagtcttttttacattattaactgaagaaaaataggtgccctttacaatttttttaagattaggaaacaaaaaggagtcagaaggagccaaatcgggactgtaacatggaagcctaataatttcctatgcaaatcttgcaaaattgcccttgtttaataagaggaatgagcacaagtattattgtgatggagaaggactctctggtgaagctttcctaagcatttttctgctaacgctttggccaactttcttaaaacactcttataataagtagttatcattctttggcctcccagcaagttaacagacaaaatgtcttgagaatcccaaacactattaccatgacctttgctcttgactggtccaattttgcttcgactcgattacttccaactcttggtagccattgctttgactgtgctgtgccttagggatcgtagtggtaaagccatgttccatctccttttacatttctttggagagatgcttcaggatcttgatatcaattgtttaaaaaatttctattgaaagctctgctcttatctgcagcttctcccggagcaacatttttgacactcatcaagtagaaagttggctcaactttaatattttagtcagaactgtataagctgaagcaattgagatgtctatggtgttggctattgtttgtgctgttaattgtcagtccttttcaattaagacatgaacaagattaatttttttcccacaaattgatgtggatgttctgccaccttgagcttcatctttgacatcatctcatcccttactaaaatgagttacccacttgtaaactgctgatttctttgaggcattgtccctataaaccttttataaagcatcaatgattttaccattcttttgcccagtcttcaccacatatttgatgtttgttcttgcttcatttttatcagaattcacattgctgatagaggttcttcaaactgatgttttatctttctcagtgcctcaaaataaatcccattctgacatgttacaacaagttagtatgagtttattttggtggaaaaaatgttgaaatccatgcatagttttttataatacacattcttcatgaactttttgaaggccccttatataatgtaaaatgtaaactagaatatagatctgatataaaattggttaaatatcttaaaagcatgcaggagaattcttcctttcctgactgttttcttcctatttttctttttttcttttctttttttgttttttagatggagtctcactctgttgccaggcttgagtgcagtggcgcgatctcggctcactgcaacctctacccccaaattcaagcgactctcttgcctcagcctcccaagtagctgggactacaggtacacgtcaccacatccagctaatttttatatttttagtagagagagggtttcaccatgttggccaggatggtctcgatctcttgaccacatgatccgcctgcctcggcctcccaaagtgctgggattacaggtgtgagccatcacggccggcctttttttcctttttttctatgcctctattgagtctctccatttttctgtcttacatgggcaaaaaaatttttaaaaacatgaaaggaaattaactttacaaaaagcaaatttaacatttctttttctttacccagtagatattatttttgatgaaaccataatccctacaatggggctggccatcagttaaggcttcattcatctaagtcttcctccttatttcatttgccacttttaccacatctttctttggcccactcatttagtacaaactttccactacaatgtttcataacaaaaattaaaccatttaggccaggtgcagtggctcacacctgtaatcccagcattttgggaggttgaggtgggcggatcacaaggttaggagttcaagaccagcctggccaacatggtgaaacactgtctctactaaaaatacaaaaattagctaggcatggtggcatgtgtctgtaatcccagctacttgggagattgaggcaggagaattgcttgaaccgggacccaggaggcagaagttgcagtgagccgagatcacaccagtgtactccagcctagactacagagcaagactccgtctcacaaaaaaaaaaaaaaaaaaattaaaccatttaaaacctttttggaaatgtacttccagtgtggcatcattaagaaaagactatgcaggcaatagaattgctctttaattgctctaatgtaattagaagatgtgatagaaacagtgaatatgtctccagcattgtgacaataggaaaaaactgattacatttcaaatctgtttgctgtaagtactgcaagaaaaaactgccgtgatttttggcagttctggcttttttgccatgttctagctgtgatttcatgttagtaaatagcctatattgtagaattaagttcactctagcttctgctctacaggttcattcctcaaactatctcagcatttggaattttacatgcttgacttttaagacttccgattcttcaagctcatctgaactcaaaccgttgtctgttctgacatctgacacctataggcaggtctcttgattttgcctgaaacaactgtcctactattccaacctactaaagttttcactaaccttgtcactgaatcaataaaaaggcaagaattttttaaagtaaatcaaatgtcctgtgaaatggcactggatttgtttaagaccaactgaaataagtttttacctcttccgatgcacaatagctatgttaaaacagcatttcagtgtgtttcatggcattaatcccatgaaagacaatcaataggatattgttttttcaggatgccactccattgaaatagaaaatatttttccttttttaaggttccactcaatgtatacttacctccttaataatttgattgctgacagaacattattttttaaatataattaagagtcccaactccatattcttctattatattattttgtttaaaagagtaagtatagctagaaatttagaacccaggtcttagaagcagatagcctgggtttgaatcctggcgcatagctataaacaaatatatttgtattgatatcatcctctatatttttatctctctctggagagcttataatttatttgattaataaatttattccttatttttcttcctaccacttcttttcaaaattaaagactttaagtaacttacccaagatcactcagctagtaagtagcagagggaagagtctgtccaaatctgtctacttccagttccatgctataactaccatgcaatgctgcttttgttatcttatttaaccattaccaaccattttgtggggtattatcatcattaatttatacatgtgaaaaccgagagtgagcaagattaagtaagttgtctaataatccccttaaaagagaagatataggattcaaatccaattttatgtaagtaccaaatccatacactttctaccactctggggaaactgagatgagaccacctggcaaacttcttcattcacctgagtctcattatgtttttccactcatttcttctcctccttgtcttcaaggaagacatagtctttctctctcatcattttctttctctctctttatctctctctctttctttctctctctcttatctcccctttgtttctttcttttttgaaaaaaatttgaggaatgtctcactctgtcacccaggctgagtgcagttgtgcaatgatggctcactgcagccttgacctccccaactcaggtgatcttcccaactcagcctccgcagtaactggaatcacaggtgtgtgccaccccacccagctagtttttgtaatttttgtagagatggggtttcaccatgttgcccaggctggtctcaaactcctgagttcaggcaatccacctgccttgacctcccacagtgctggaattataggtgtaagccactgtgcccagtgttcccctttattttcaaggctatcttctcctcatcacaaaccccaagtactcttcaacttttccttccttacattctgagtctcttaaagagcctactctgtgccaggtactgtgctaggaattggtaatagaatggtgagcatccctgccctcctcacagggctcacatctcagaacttaacactattaaccaagaaaatcacaaaaatacgtaactacaatgtggatgtgttgtataaataaaaagagtagttagttaagcacagattgaccagacgtaagtctggacaattaaatgcagaatcaaaatggttaaaggcaaagtagggctaagcacagtggctcacgcctgtaatcccagcactttgggaggcacagatgagccaattgcttgagcccaggagttcaacatcagcctgggcaacatagtgaaacccgtttctacaaaaaatataaaagttagctgggcaaggtggcacatccctgtattcccagctacttgggaggctgaggtaggaggatcatttgagcctggcaaaccagtcattcacagaattcttagggagggatttagatccatagaacatggaattgaaagctacaggtaatcttgatgacaaagatgtagagaaaaggggaatccttgtatgctgctggtagaaatataaattgatacagctatcatgaaaaacagctggaggttccttaaaaaattgaaaatagaactatcatataatcagcaatcccactactgtgtatatatccaagggaaatgaaatcagtatatcaaagagatatatgtactctcatgttcactgcaccattattcataatagccaagatatggaatcaccctaaatgtctaccaatggccaaatggataaagaaaatgtagtatatatgcaatggaatactattcagcctttaaaaagaaaacaatctgcagggtgcaacgagtcatgcctataattgcaacattttgggaggctgaggtgggtggctggtggctggtttgagtccaggagttcaagaccagcctgggcaacatggcaaaatctcatctctacaaaacatacaaaaattagccaggcgtggtggcgcatgcctgtagttccagctactcgggagactgaggtgggagaattgcttgagcccaagaagtcgaggttgtggtgagctgtgagcatgctgctacactccagcctgggtgacagagcgagaccctgtcaaacaaacaaacaaacaacaacaacaacaaaaaaaaaaacagaaaattctgtcatttgcagcaagatggataagcctagaagacattatgttatgtgaaataagccatgcacagaaatacaaataccacatgatctcacttgtatgtaaaatccaaaagaatctaactcggacacagagtggagtggtggttaccaggggctagggggcagggacaggattcaggagatgctggtcaaaagattcaaaattttactttgacaggaggaataaatacaagaaatctattgcataacttggtaactatagttaataataatgtactgtgtacttgaaaattgctgagagtagatattaagtgttcttaccacaaaaaaataagtatgtgaggtagtgcatatgttagtttcatttagccactgcataatgtgtatgtatttcaaaacatcatgttatacaccacaaatatacataatttttattcactaatttaaaaaattttaaatgaactgctaaaaaacagtctggatgtgatcttatccagattttatgttatcaagtcttcctgaacaggcatcagcattataattatacagctagaagcagaaagactgaaacttgaaaacaagtcaaagagaagacaggtactttacatctgagtaaacaaaaaaactgcatcaaaggtagggaagggatctgtgaaaccaggagaatacatatttcattcatctataggagttttaaaaaatctgacactatgacggaatgattaaaattaaaataaattgcaaatatcaatattttaaaatacaaaagatgtataccacccacagaatggaagtatgagaaccaattcaaatagtgatgtggggaatgtcttatattaaatcatttaatggagaatatgtagtttacgtaggcattgctgatcatttttctttttggttgtagcctaaaggctatcttccagaaaataacttataaggattattttaatcaatatgacttacagtgaaagaaaactctatggcctctagaaacagaaataattgctacattttgagaagactgagatcatggctctacatgtatttgagtgaacaatgtgggatgaatctatatataatagcttgaaaaattgccagaatatatgataaaataaaaaacagaagtggcaggatgatatatataatgatatcatatatatttttaaaacgagcacacaacaacactttgtattttctctgagtgcatatgtgtatatgagagcctaggaaaaggtctaaaggaaacataccaataccatagcaattattattttggggggaggatgagacaagaacccaaactggggtagtaaagttttaattttttaataactaggcttcatttcatattacttataaaaatacaaagtaattaaaaattcaaattcttaaattttaaaaaagataattatggaccaaacgtttattactcttttagattcaagtattaatcaactaattattttggaatcaaatagacaaaatgctttctttgtttaccagaatgaatataatattatttttaaattaatcagttgcaagaatttcaattttattatgttaggtttacactgtttaaactattacaaatatgtttggctaatatatgtcttttaaaaaataaagacatcaagagagtgaaaaaacaagacacagactgggagacaatatttgtaaaaggcatatccgataaacgatattatccaaaacatatgaaggattcttaaaactcaactataaataaatagcctcatttttaaaaataggccaatgaccttaacagataattcacttaaacatatatacagatagaaaataagcatatgaaaataagcataagtcataagggagatgcaaagtaaaacagtaatgagataccactacacatctattagaatggccaaattccaggacactgacaacaccaaatgctggcaagaatgtggagtaataaaaactctaattcactgctgataggaatgcaaagtgataaagccactttgaaaaacagtttggcggtttcttacaaaattaaacatattgtcccactctcaccatttccacttaatatattcctggaagtcctagccagagcaattaagcaagaagaagaaataaaaggcatacaaatcaggaaaaaaagaagtaaaattttctctgtttgcagattatataatattatgtatagaaaacccaaagactcaaccaaaaacctattataactagtaaacaaatccaataaagttgcaggatacaaaaccaaagtacaaaaatcagttgcatttctgtatgctaacaacaaactatctgaaaaagaaagaaaacaatgcaatgtatattagcatcaaaaatataaaccacttagaaacaaatttaaccacagatttgaaagatctgtggttacattaaaaattacaaggcattgatgaaaaaaattgaagacacaaacaaatgaaaaagtaccctgatgttcatggattaaaataattagtactgttaaatgtctatattacccaaagtgatctatagagtcaaaacaatctatgtcaaaattctaacagtattcttcaaagaaatagaaaaaacaatcctaacattcatataaaaccacaaaagaccacaaatagccaaagcaatcttaagaacaaaactggagggatcacacttcctgatttcaaagtacattacaaagctatagcaatcaaaacagtatagtactagcataaaaacatacacaaacaccatttgaatagaattaagagcccaggaataaacccacacatatacagtcaactaatattctgtaaaagcacaatggggaaagaatagtctcttcaataaatggtgctgggaaaactgaatatttacagacaaaaataaaataaaattcgacccttatctacaccactcacaaaaattaacttgaaatggataaaagacataactgtaatgcctgaaactgtaaaactcctagaagaaaacatagggtaaaagattcttgacattggtctcaacaatgtctttttagatgacaccaaaagcacatgcaacaaaagcaaaaagatttaagtgggactacttataaaaatcttcttcttctgcaaaaaatcttctgcaaagcaaagcaaacaaccaaaaacatgaaaaggcaacacacagaaagaatgggagaaaatatttgtagaccatgtattcaataaggagttaatatctaaaatatagtaggaagtcataccactcaataacaatataataataataatccaattaaaaataagtaaaggcgctgaatatacatttctgaaaaagaaaacatacaaaaggccaatagtgcattaaaagatcttcaatagcactgatcatcaagggaaatgcaactcaaaaccacagtgagatattacctcacacctgttaggatggatattattaaaaagacaagagataatatttgagacgatgtggagaaaagggaacttttgcacactgctggtgggaatgtaaattgatacagtcataatgaaaaaaagtggggagattcctcaaaaattaaaaatacaactaccaaaagatctagcaattccacttctgaatttatatctgaaggaattaagtagcttgaaaagacatctgcactcccacattcattccatcattatcacaatagccaaaacatggcaactacctaagcatctgcagatgaatgaatgaataaagaaatggtcatatatatgtatatatacaaccacttacaatagaatagtattcagctataagaaatgaagaaaatcttgccatttgtggatgaacctggagggcattttgctaagtgaaataagccaaacacagaaagacaaatacaatatgataccacttatatgtaaaatcaaactgttttgattttacataaatcataaaaacagagtgaagcagcagttgccacagatgagagggtgtgggaaatggggagatgttgaccagtgggggcaaactttcagttataagataaataagttctggggatctaatgtacaacatagatggtaattggtatgttaattaatatgattggggtaatcattacacaatgcacatgtatatcaaatcatcacattgtgtacctttaatatataccttctttgtcaattgaatatttaaaattgttttaattcaaattttaaaaactaaacataattttcctaaaccttttaagtcggagtacctgtgcaggtttgttatataggtaaacttgtgtcatgagggtttgttttacagattattttgtcaccaggtattaagcctaatactcattcattattttcctgaacctctccctcctcccaccctccaccctctattaggcaccagtgcctgttgtttccctttatgtgttctcatcatttagctcccacttataaatgagagaatgcagtatttggttttctgttactgctccagtttgcttagaataatggcctccagctccatccatgttcctgcaaaggacataatctcactctttttatggctgcatagtattccatgatatatatgtatgagattttctttatccagcctatcattggtgggcatttagtttgattctatgtctttgctattgtgaatagtgccgcaatgaacatatgtgtgcatgtgtctttatgacagaacaatttatattcctttgggtcaaaatgaatttctgttttttaggtattgaggaattgacacactactttccacaatggttgaactaatttaggctcccactagctgtgtataagtgttccctttgctccacaacctcgccaacatctgttatttttttactttttaatactagcctttctgactggtgtgagatatctcattgtggttttgatttgcatttctctaagatcagtgatgctgagcttttttaaaactatgtttgttggctacatgtatgccttcttttgaaatgtgtctgttcatgtcctttgcccactttttaatggggttgtttgaaaaacaaactaaacatactttacaatataacccagcaattgcacttcttggtatttgcccaaagtagtcaaaaacatgtccacacaaaaaccttcacatggatgtttatagcagctttattcataattgccaaaacttggacgcaaccaagaggtcctttagtaggtaaatggataaactgtggtacatccagacaatggaatattactcagcactaaaaagaaatgagataccaaaccacaaaaagacatagaggaaacttaaatgcatattactacatgaaagaatccaatatgaaaatgctgcatcctatgtaattccaactacagtatatgacattctgaaaagggaaaaactatggagacagtaagaagtcagtggttgccagtagttagcaaggagggatggaggaacaggcagagaacagaggatttttaaagcagtaaaaatactctacatgatactaatggtggatgaattttattatacatttttccaagcccacagaacgtacaacaccaagagtgaactctaatataaactagggattgtgggtgataacaacgtgtcagtttagttcatcaattgtaacatttgggggatattgataatggggaggccatccatgtgtaggagcaggggatcagaacacaatgaggggaatctctgtaagtttctctcaattttgctgtgaatctaaaactgctctaaaataaagtcttaaaaataagaaaaaaattagtattacagaaaagtcttctagtctttaatactaaaaggctgaaagccttttatttaatactaatattccctataaggaatctgtactccatgaaaggttgctgattttatatcttaggatgggaagaatcaaaatgtgtctggaatatctggtggccactaaccaaaatcacttaaaattagcagggatgatagcaaaagaacaaaggagtccagtccatttaaaggggctcctactatttaattcctgataaattgagtattatttagacatattgagtctggggagccattaattcataatgctactcaaaaggtaaattatgaaaatgtttttactaatgaaataaatatggatacttatctttaagaaaattagaagaaaataaagacatatgatctaaaatagcagggctctcttattcagtggagctctggagtcagaaaaactgaacatgaattttggccccctactcacattgggaaagtggtttaagctgctgaagcctttattccatccctggtagaatgaggaaaataaaatctacacctaccatacaggactttacttaatgtagctttataacatgttttaatatcgggggcggggggcgggtaggctccacctcagtggtctccttgctaatgttattttttgcatttaaatgcactaccatctatacctgatgaataaagccatagacccatatgaaggaagcagcttttcctaaacagaacactccaatataccatacagatgtgtatcgttccaccaatatttattaatcatccaatatatttcagattctgaacaaggctgtgaccatgccttaccaggacatgtagaacttatacacagtcttaaacaagctgaagcacaaaatcaatattttggttggaaaaagttttctgtattttaataacatgatggaataaatgctattcatcattcacatactctatattctctgatgggattgacctgatttacactgaaaatactaaaaatcttacacctattctccaaagtgaaattgcctatcaaatgagatgcagctacaattataatcaagtaccaacattcttcacaaaaacacatgctatgcttcacgttgagagcagcagaaataataagcacacagcataagtaatgtttctcaagcaactatattatcaatcttcagaatgagtgataaaaatggaatgaaatttttccttatgattaccaatagaaaatgctattgagagagctcatagactcccttttgtctagtatatttcctgttttaatgcatttctacttaatctaaagaatagaagctttagatataaaaaaaattttaagaaggcaaaatgtgaacaataaactaaattagcaagatgatcaatacaaattatttatagtactttggtacattagtgtaatctacacatacaaatctaaatacatacttagctatagtaagtcaaagagtacataacttgcattttgttgtgtatcaattagcacaacagaaaaaaagaaaatattttagagatactcaatatacttatcaattaaatataatacatacagactcctttaaaaatcttgtaagtaatgaacatattacatttaaatggccctaatactgtaatgatggttaaaccagaacagtgataaaaatttcactcatctgatttcactcatttcacctaaggtagtaacgtcttctcctaggcatatttctgtcagttaagcaaaccagcctatgcacagcaccacacatcatgaattctttcagttttttatctttttatatcaataatatgataaactttgaaggattctcctactttcacaatctctgtataaaagaatagtaacataagcacctccaggaatctgttgattttgttgtgatattgaatattatattgaattaatcttaccataatattatagactgaggcaatatatattaatgaaagagtccttgtgtgattatctgtttggaaatatgtgtttacatgtttgtgttttacatggtctgtatttaaaatgtgtaaaaaatcctaaaaatatagacgcaatggtgattaacttattctgtctacattgaacttagagaaaatacagatgatttttatacacaataagattgtcattaaaactaaagtatatgccccaatatttttaagtatattaaatcttaatttctcagtaacatcatgtgtgtcccaccttctatgtccatgaggcttatgattccaagcctaaatgacaacaaatctgcaaaatttaaacaaacatttgaatagttcctgtcatttccgaggtttatgtcaattgttattcctgtggagttctcccagaaaacaattcatcgacaaagaagaaaagaaaaggtacacagggggcaagtggaaaaaataagtaatcccaattgtgctctatttctgtttgattctacctttcacttctgtctataatgatgtcctttgggagaaatagcaggttaagtacaagccctggattcatgggtgaattgtgcatagtagagcattaaaaaaaagtagctgatatggtgcagtcttaccttgcaactgtaaaattctcaaagtcatatctgctgtagaattccttaacaatgatgagtgtgaaaatgactgctgggtggtgacagtttctcaataacagcatccttcagatgttcttgatgtggtccctgaggtcttccccatattctctagagcactgctgtttaaggattgtgggtattctgaacattttgaaattacaaccaactaaagatgttcttggtatgaaaagagttaaaaatctgctcttttcctggagtttaatatccagttaaatagaaattaactcaaatgtttctaagtcattttccagttaactagggcttaagaaaaaaaaattgctgtagtcactgtgtttaaaattttactttaggacgtattagcctataagtgccacaaaatcatcattttggagtctacataaagctacattgtcttggtaagaaattgcaaagaaactgtattgactctaaagtacactctggagtactgcccaaaagagcaatctatgttgatgaaaattttctgtatctacaatggtcaacacagtagctactcaacatctgaaatttggatagtacaagtaagaaactgaatttttagtttatttaattatgattaatttaattttaaattgaaaagccacatgtgagtagtggctactatattgaacagcacagctcttaaagttgattttcactgtattttccatatgagattatgtcatgatatgttgtgatatcctttaggtatctaggtggttgatggttgattgattgtgattaaaagcactatttccctaagcaagtgggtatctttggagaaagcactggtggaggataaaagtttaagctgttgccagtcacgaaggtcttactttatcaggtccttttccctaacaactagttgagaatgagttagactaaaaaagaggcagctccagagaatatgagtcacagtgtggaaggacaagaagcaagtcttatgtggctaggatatagagatactgagcatcagtgggaagacagggaaaagatactctgagaaaaaagaattctgagaaggaaaatggaaaggacaatcaaaggcaacattcatctatttcacagtttaattcattctgctctgttttatatccttctctttttattaatgaaggatgttgctggtgctgttctcatagggtgtcgatgcaagactgaaaatgtcagtccctggcttaatatcctttccaaattgagaagacctgtagaaaaaatcaactgttcgtgcattttacactgtttggatctttttgctttgctagttatgtaatgacatacacaaaagttggtcagaaaaatgttaaaccaacatcattccttctgctatgctttgatatttatagtctttaaagtttttaccaaagagccttattttttcccttggtgctttatcaatatgatttacatttttcatcctattaaggaacaagaacatgtgcaatataaggaggagggggagatggaggaggagaaaggaaggagagaaagaggagggagatgtaaaaaaaataaggtaaagggggaagggaaagagaaaaggggatggaaggagagttgagaaggggactgacaggatagaagaggaggaactgggaaaagagagaaagtgacaaaaaaagaaagtgaaagtaaagaaacagtttgctaaacactcttgtgtcattcacactgcaagtaataaaaccaatacgcttctgtgtttcatgattcaagagaacatttaagtgataaagggataactgtggaggtacctgacaactttgccaaataaaaatccagctttcatcactatagaaaattttaaatggctacaagttttttttgtttttcctttttgttgttgttgttgttgtttttccagatggagtttcgctctgttgcccaggctggaatgcagtggcgcattcttggctctctgcaacctccgcctcccgagttcaagcgattcttcttcctgagcctcccaagtagctgggactacaggcgcatgccaccacgcctggctaattttttgtatttttagtagagacagggtttcaccgtgttagccaggatggtctcaatctcctgacctcatattccacccacctcggcctcccaaagtgctgggattacagacgtgaaggtttttgtatttttataaagtgcaggtgttcagcatgtcccttcctgaactttacaatattcacatagctttggcaaatgggatgcaaaacaacattcagaatgaaattaatgttgaaagagtagtatcatctacataactagactatttttcaagtagatattgacgttatgcagtgggatgtgctattaaagagcataaactatatcctttaaatttaacaatacataattccatcaagaaaaatcccatcactgaacaccgctccagacttttcttatcaggatattataaaacactagttaactactacgaataccaagcaaaagtatggtaagaatactttgccccttttctttgcagacaggaaaaagcaattgaatatgaaggccaaaatctctgagaaggagtgctttatctagagagacaagcaggggcacatatcacaatagcgaacaggagagatatattgggtcctgatgaaaactaatataggaagaaattggctgaattttttctgtaccctgtatgagaaatgattaaatttaaagggtttttaaattaacttacttgtgaccttgcctgctattccatatttgaagatctggtggggggaaagtatgtagaaacttcaaaatatgctcaggaatgcatgaataaaaaaatagaaattcttactattgataaaaagagaagagaatccaacttctcaatttaaggggacttttaaaataaagaaaggcagtttaatactccctaaagaaggcataaaattcctatagaaccaagattcttggttgatactgcctctgcatcagcaccaaaaattatccctctaaacatcggtggttccaaggaggctccttggtaaattgtagcctgcctgaatgaggtaaagtgatcccatctccaaatcaacccataccaggaaggccaggaataggagtctgtatcaagtcaaaattctttaatgccttcccatgctcaagccatgacctgcaaagatgcccacaagtcatataccaggtagacaatactgctcagcctactgccctttcctcattaactccctaaagcccaaaagacagtcacgcatgcacttttctttccgtttcacaaaaacaactgtaatgtgaacaccatacacattataccttgttacaaatattttaagccctatatttaagttagaaatattaagacttagaaattcctaagtattagaaaatatcaactaaaacagactattctcactatcttcagtttgatgtgtctcagtatgtgtttcctcctgttttttcatcaaagggtcaattgaccccaacggatgctctctctgtctctgggtcactcatctgtttggctgtatctatttattacattgcttcatccatcaccggagttcctactctgcattgggcctccctccctgtccataagactgactcaacactcacatgactaagatagtaatgtgaggaaaaaaatattgtcagactcattctaggcattgaagaagcaagccactatgcctgttagagacagcatggtttccacgtgaaacaaataggattagtctacctcctataatgcaactacctttttcaaaactcatggatattgtcaggctgcttaacaaatataacctccagcagctgcagagcagatccatgcatctgtacagtacatgtttgcacatactccttttccatctgcaggacatgacatatgccaattgattggcttatagtaggcttggagaggagtcagagtattggcaggcaccttatgtctattcttttttttttattatttttttattattatactttaagttttagggtacatgtgctttccattttttccttttactctgaagcttttagacattgctcttttggatcctgcctaccaaattattcatttaacttcaagtgttcatttgtggctaacgaagctgagatttttgttaacatataacttgcatttagtccaaactgattagatgtcaataatcaacctaaattatcaggctttactttaattgcaattatatcctccatttcacatgtttaaaggtgagttcttatcaggtgatgggaactaagcagagtccaagtcaacctgaaagaaaccaaaagattcatccacgatcagctacgtgatttggaaggctcagtgcaatgtggaagtataaggtaccttgttcaaaatatattcagaattttaatatagcaacctcaggtaattaaaccaaatatgagatccttccatctgtgagacacacccatgaagagagccctggatttgtcaaagaaaacataagacatttttgccatttcttttaaatgttaatcacgcttatgataaaaactaatatgttggcaatattttcttcaaagtcaatagtatcttcatcaaaaatttctttttagaatttacaaagacttctttttccttttcgattggtctcagaaaacaagctttgaggttctattcataacataaagttcaattcagtttcaaaaaataattgcccgatacccttcttgcctttccaaatcttactgtaaatacaaaagtatgaaaataaagcctgtaaattatagatccatggctagatttggaaaaccctaaatcttaaacttagcagtgaacacctgacagtaacaaaagccataagcgctcactctaggaacagcatggccactgaacaatgttctccataataaagccataatcaacaccctacaaagcaaaatactatactatgatccacactactaaccatattttatcaaactgtatcttaaaacaaggaactctacaacttactaccctccatctcttgataaaagtaaaaacagattcctctaaattaaagctggaattcgcaagaccaaactaataaaaactaataaaaattatgttttactaatttttaatgtaagaattaataattctcataggctacttctcttttcttgatttcaccttactctgagaacatgtctaaaataaacatcattccattttgaacgaagtgctttatccaacagaccgatcatgctagacagaaagtttgcaccaggtggtagaaaaaaaagaaaactgtaatatcactttacatagtaaatgtaaccttccaaaacaaatttttattatattattatgatggtacctacagccatataaaaagggaactctggacatatctgctttaaaaaaaagctagataatcttctgaacttggaataattttaaccaacattctttaaggaatacttatggaaataattaattgcttattttagtttacataccatgtatacttgtgttaaaatgatttacctcctaaaactaactccaaaaaaaggtatttgaatactcagaagcttgtatctctttctttttggctgtctcccttgttccatttcctatcttacttctcccaattcagtttatcctctgatatggtttgactgtgtccccacccaaatctcaccttgaattgtaataatccccatgtgtcaaggacagggccaagtgaagataaatgaatcatgggggcagtttcccccatactgttctcctggtagtgaataagtctcacgagatctgatggttttataaaagggagttcccgtgaacacgctctcttgcctggcaccatgtaagaagtaactttgctcctcattcgccttccaccatgattgtgaggcctccctagccatgtggaactgtgaatcaattaaacctctttcctctataaattatccagtctcaggtatgtctttattaacagtgtgagaacagactaatacgccctcctactgaagatatgatgtcaccattcttccaagcatagatccattggatatctaagctatcttgggccacttccagtcactacaactgtcagttcttttttcatacctatccctctcctttccattccaactcctttacattgggtttttattacactttacctgaaatattataaaaatatcttgatttttcttgcttccattaaaccatgcaaaataatctacacatcattactgattaatcttccacaatacctgtttgattgtcccttccatgacaaaatattcctcattaacaaagtccaaatttcttagcttggcattcaatatggttcctcaaaatctggtttccaagccagattatcttctcacctgttgcagatactgtaatacggtattaatgagcttgggctggaaattcccatttcattactacagaaaaggtgtagtgatgttacctgcaggagtaattgagggagttccaagtcttgtgactgctggaatatggctggtaatacagaaaaggagtgatattagccctctctttaaaagaagaaaatatgaacttaggaattcaacttcctaagaaggaaatgggcttttattagaaggaagtgataaagcaaatctcttagacctaaaagtatttttttcccagatatgtactatgaaatgtcttgattcctgctgatatggtttggatacgcacgtccccaccccaaatctcatgtcaaaatgtaaccactaatgttggaggaggggcttggcgggaggtgattagatcatggaggcagagttctcatgaatggtttagcaccatctccccttggtactgtagagtgagtgagttttcatgagatctgcttgtttgaaagtgtatggcacctccccccctctctcttcctcctgctccagccatgtaagacatacctatttccccttcaccttccaccacgattgaaagtttcctgaggctgcccagaagctctcgtgcttcctgtacagcctgcagaactgtaagccaattaaacctgttttctttataaatttcccagtcgcaggtattcatagcagtgcaagaacagactaatacagctactaataagaaagctgaatttatgggatctaaaacaaagtatgttgatctactgattaatcaaactgacatgacagtccggaaacgacccaatgggttcttcctgcccactgcacaaagccaattcactaagaccacagcattgcaataaagattttaatagacacaaggtcagctatgccatgtgagagatggagttattaccaaattaatctccttgaaaattcagaggctagggtttttcaaggatagtttggtgggacaaggagtcagtttgggtggggccacatgacagatgggcaggggtagactgtcctcagaaatgtaaaaacctgaaaagatatctcaaaaggccaatcttaggctcgctctgtaatagtgatgttatctgcaggagtaattgcgggagttgcaaatcttgtgacctccagaataatggctggtaattgtttatgtctacaccttagcagaattcaggatcctcatctcttcgtaacctggtggtcttttattagctttacaaaggcagtttagtttgggggaagggttattaacatttaaactataaactaaatttctcccaaagttagcttggccctggcccagaataattaagggcagtttggaggttaaaggcaagatgggggttggttatatcagatctcttttatgtcataattttctcatgttttattttttgcaaagtcggtttcagtcccaagtaagaccaactttaattctgttctgctattcatccttaatggtgtgttcctgtatgaaggttttctggcagataaggggcctcttactagtaaataattttatttagttcttatttacccaccaaaattgcaaactctcatatatttataggcatcagagttttgtaaacccccttttagataactgtgaaaagtcattaaacattctatcaaaatctcccatccttcaaggcctagctcaatttcctttccataaagacttccctgtttgcttcttgctaggttacaggaggcttgagaacagagtgaagtgtggattcaacaaacatttatagaacaggtactgtgctaacaatttacccctcagttatactcacacttgtatatacagaacaatctctggactaaaacaccaaaaaatggtttaaaatacttgtttctgaggaaaaggtaaggataaatacagatcttaaaagaagcaaaatataattttcctagggaaaaaagggagagacacgttaccatttactttagaaaacttgtcatggtgagtctttctctgccctttgaaacgtatgtaaatcttcttaaaagtgaaataagcttctcgccagcttttcaacccaaggatgaaaagaatcttgggagaatgtctttctcaagaacctggaaaccatctcttttaaatataatcatcaaagaacgtagtgtccctatctcccagtttctgtgggaaggcaggagcctaactttggtgggtgcctggctccaagttacaaacttgtcttctgtcaaaaagatataaaaagttcctttggataaaggcaattagtgaacagagacagttattcaaattaccaggtgagtttaggatgaactatgtatgtaaatggtactgtcaagtcctcttacttgaggaatagttatcatttatcttgagaacatgtatctaatgggttgtgtctcctaagctatataaaacattgagatttctttatgtctctgcatttctttagctgattgcctgtggtatatatcacattctggtttaatgcttatcaattataaaattgttttcctttgtgaagggtatcctgggttggcaggatatattgttttaaattatatttccccaaaactcactggagattactgtatcatttaaatatgtaaatgtgcaaatgttttaacttctcaataaaatgaaaggaaccaattaagaaactaaagaataaggagggaaattgtggaagaagaagggaaaggaagaaaagagggagggaggaagaaaaacaaagaacaggctattagcaaaaactcaacaaaaagcacttccacttagggaagaaaagaccttcaaaaaaaaaaaaattaagagtttccaacaggactctagaatcaggcttctagagcctgcacctgattctagaatctagattctagaatctagaatcaggactctagaattcagtctctactgaacatattgtctgcgaagtaattaaaggggagaacaatcaagccaatatcccataaaaactaaaaccccttctcaaaacaactcacgcctgtaatcccagcactttgggaggctgaggcagatggattacttgaggtcaggcgttcgagaccagctaagccaacatggtgaaaccccgtctctactaaaaatacgaaaattagctgggcgtggtggcaggcgcctgtaataccagctactcaggaggatgaggcaggagaatcactggaactcgggaggcggaggttgcagtgagccgagatcgcaccattgcactccagcctgggtgacaagagtgagagttcatctcataacaaaacaaaacaaaaattgtaatgcataaaaataacagatacaattttaaatggaaatcaattccattgacagatataattttttagtcattatattaacatgaaataataagatctagcagtcagcctaataactctcataattcagacatagtgataagcatacatgacataatgtggtatgaaaatatctgtaatttctataggtgacaaagtcttaggtatcttatgcactgtggtttgtatttaataatattaataactaaagtgataaatttcagatagaactttataaaataaagaactatttatttttctcatccaagtccacagacaccctgaattctacatatgaatccccatgaactgtagcttaagaacctctgtgggaattgtaacagaactcaggatgagttctgctaccagaaaaactaggcaagtctaccacaagagacaagaagcttcttctccaagaagataaactatttgctttccatgttctaaagggccacctacatctccatgttgccctccctccagtatagcgacttgacctagcattcctagaatcagaaccttacaatcttacaaacctgcaagattacccgaatactcagtctaactgaaaaatatacagcagctaataatactgtataatctagattaatggtttggaacatttagtgtgcttaaggatcacctgggaaggctcgtctttgaaaatgattcatgacctcatcatcagagtatgtctaaatttgggaacagaaatcttcacttttaactagcacccaaagtgattcttgtgcaagtggttaatcaccaaacatttgagaaacatcaacagaattagagtccccaaactcaacaaacagaagaacttaaggaaacataattagtataattaatattctaaaagagattcaaatgtttatcatagctataagaacagccaggccaggcgcggtggctcatgcctgtaatcctagcacttttggaggctgaggtgggtggatcacgaggtcaggagtccaagaccagcctggccaagatggtgaaaccacgtctctactaaaaacacacacacaaaaaaaattagctgggcctggtggcaggcgcctgtaatctcagctactcgggaagctgaggcagagacttgcttgaacccaggaggcagaggttgcagtgagccgagatcgtgccactgcactccagcctgggtgacagagcaagactctgtctcaaaaaaaaaaaaaaaaatagccacagaaaacaccactggtattcttggaaatttaaaatggtattgcaaaaataaaaactagacagttgaagacttaaagagcggaatgaaaatagctaacatcaaaatcagtgaccagaaaagaaagccaaaaattctcacagaatgaaaaggatatgcaaagtatgagacaaaaattaaaagccacaagactcatccagacagaccaacattcatcttaataagagttttagaagagaaaagaaaatgtgtctctgcctagaaaagcgtctggaaaatatataccaagtccttaattgcagttatcactggcaataagaattgaattgaggtgaagtgaaaagagacattaacttttttcttaatttccataattgtataattattttacaagaataaattcatgtattccttatgaaattaattaatctagacatgaataaaattattgtcaaagatacaccaggaaaatgctaataaaaaggaagccaagaatatcaatattaataccagacaaattgaatcagagtagacactattaaaataaagaggaacattttataataataaaaggtaccttccaccaggaagtcataggagtcaagaaaacttctaaatctaataatataagggtattgttattttttgttgttgttgttgttgttgttaagacagagtctcactctgtcaccaggctggagtccagtggcacgattttggctcactgcaacctctgcctcctgagttccagagattatcttgcctcagcttcccaagtagctggttttacaggcacacgccaccgtgtccagctaatttttgtatttttagtagagacggggtttcactatgttggccaggctggtctcgacctcctaacctcaggtgatccacccgccttggcctcacaaagtgctgggattataagcatgagccaccgcacgggcctaatataagtttttaaatgtatggaacaaaataccactagaaatacaaggagaaaatggtattttgctgtaatgtgaaagacttcaactaacctctctcaaacaggtgaaacagaaaacagaagtaagaatgaagacactttatttattacaattacgaacttttaaaacttcctcccaaagagagaatacacaattttttcaaatatgtataaatacaactttcaaaacatgaattaagccacaaaaaatttcagtgttcccccaaaaaaattccaaacattttccaaaataaaacctatattttctgaccaaaattcagtaaaactagaaattaattttaaaggatgacaaaaataaacaaaaaacaattttaaaacaccaaaaaccaattttaacatttttaaaacacacttctagtagtataaggcaaagaaaaaaaaactaagttaaaactaacacctattttttaaaatacagataaaagtactgcttattaaacataggtgttcagaggaaaactgacaccatgaatgagtttacaaaagaaaaaaaccaagtaagaaaaacagaaaaagagagactaaaaattaactcaataaatatattcaagatattataaaagatcagcaaattaacctaagaaattagaaaatataagttaataaaaataaaagcaggccaggcacggtggctcaagcctgtaatcccagcactttgggagagcaaagcaggcagatcacaaggtcgggagatcgacaccatcctggctaacatggtaaaaccctgtctctactaaaaatacaaaaaattagccaggcatgatggcatgcacctgtagtcccagctactctggaggctgaggcaggagaattgcttgaacctgggaggcagagattgcagtgagctgagattgtgtcactgcactccaggccaggtgacagactgagactccatctcaaaataaaaataaaaataaaagcagaatctagtaaataattaaatagtagtcttaattgctaaaaagaaaattctttacagagaagaaaataaaaattcagatttttaaaattcaaactaaaaaaaagaagacacatgttcctaatgtcattcatctattgcctcttttttgtacacatctgtggaatacaacctgatgctttgatatatgtatgcactgaggaatgactgaatcaagctaattaacatgtccatcatcccacatacttttttgtggtgactcttttattgaggttttctttgcagcctttgctccatttttgtggatccattttggatccatttttccatagctatttgaaagatatgcgtcctctgttgcatgtgaagttctatacatgaaatcaactttccatactgcatatgggggggggctcaataaaaaataataaataaaaataaaaactgttctattttgaggtcctctataaatttcaatcagtagtcagtgtgaattatccactcctattacacaatcccttcatcagctctcatatttatttttccttcatgccttttctcattttgcagtgctcacaagtatggtccctagttaacgctaaactaaccctaaaactaaacatcatcaaggaatcggcatccaagaaagcccgacctgtgtcatgtgagtgaggatctaaaggaagagttgtgctagcttttattgcttgatttatggtattcttatctcctgaatatgcaatttttaggattggaggctttttatttttacttattttctagctcccattaagcacatgacaatgtggaaatagagaacaagtacctaataaatactgatgattaactgatggtcatgagactcatgatacaaacattttataagaatttgtttttaaaaacttgctgtggattcattttggttttttcaagttttggagaaaaaaaaaaaaacattactataactggctgccagagttttctccaagcttgacatcgggtccatataacagcaaaccttgaacacgatctataatgccatgtacatcatggggtctaagagtcccaagaagccaagagcaaacaaggtctaatactcattactatccatgtgttttatttaatcatcaagataaaggagatgttgtccttcttttattgggtaaatatttattagatgcattaaaacctcacactaggttctgaaatatcaacaattcattgctttttcaataaatatgtttaaagcaattactatgtacctggcaacttgctaggcggtgacaatataaatatgaataaggcattattcctctactcatataattcatccaatagcaaagacagatgcataaacaaataaatgtattaaactcaagacctaattgtattccaacagtctccatcatttgtcacaagagcattatttggaaagagtaattgttgggagggctcacgaaatatgtgttcaagttataactcttctaattcctgtttatttgactttgtacaagttacacaacctcacagaagagtagtttgctcctctataaagtacacaataactcctgacctatgtgctctatgaagcaatttgatactattaataaaatgtgcagataaacaccctaaatagtacaaatgtaagatgctagtaccttaaatttgtattaagccagtacctagcacaagggttcacacagacattaattacacagaaaatagatttaataaatatttgttaaatataaacagtacattgttgtagcacttattctcagatttaccacccattttaacacactttattcaatttcattattaactacctcaaacataagagaatgtatgaataaagaataataatataacacacattcatctaccaacccagcttctgaaaaacaatatgctcagtagctttaaagctcctgatgtgtgtatgcaacctctttctccccactcctccactcctcaatattgcataaatcattctcttccttctctttatatcttaccagacatgtctgtaacactagaaatgtgttgtttagttttgcttgtgtgagcctttatataaaagtaaaaatgctgtatgaattcttatacggcttgctcttttatggtaaagctttttgttttggtatcattcatattgacatgtattactataatttactcatttttattcattatggcctcatgtctaagtttaaagggagtgtttttaattactcaaatttaactatgaagtttactgtagaattttacagaaaccctttatcaagaaaactcacttctgttcctagctttctagaagttttaaataaattatattgaatttttcaaatgttttctgtatctactgagattattatatagtttttctcttctaacttgttaatgaggtgaataccatcagtaaatgttctaatgttgaactaacattacattcctggaataaattcaactttgtcataatgacttttttatctagtgctaaacagtttattcacattttgtttgcaatttttgcatctaatttcataaattagattggcatgtgaatttccttacttatctgacctgtgtagcatcgtttcacacttgcttcaccaatttcatataatggattgagagctactttgtttgtttgtttgtttgctattctcaggacactgctgtagaaatacatttacatattcctggaagggtttatagtattctatcaaactatctgagcctcctatttgctttcagtaaaaactgttaactactaattctatttaattatttcattcagattgtctatacttgagtcaattttgttaatttatattttcttaggaatttttccatttcatccaaattttcatttttatcagtataaatttgtttataatattcttttagtgttttagtatttataatatttagtatttagtcataaccctgtagttatgactcctcttctgactttcactcttacatgctgttttttgtctgctttcagtattcttaatttatctcaccagcagtttgtcaattttattggtctttacaaataatacacttttggctttgttgaacttctctactgtatctttgtttgtgatttaattaatttctattcttatctttattaattttttccttctgggttttttatattgtctgtttcaaactccaagtggaaacttagctccttaacatccagctttcttctttcctaatataagcatgtataggtgagaaatttccttctatgtactccctttagctatatcgctcaagttttgttgttattatacattatcattatttctcagttataagtattttttactttcaattataatttattcatgacccagtagttatacagatatggttttcaaaaaagattccaaatagtagggtaatttcacttatttacctaaatacatttctaggtggcctgtataatactagtgctttgaaaatcatgactcagtatgctgtcaatttttgttaattttccatgtgtcctcgaaaagaatgtgttacaacctcctggtgaatttatcctatcagtagatagtaactgtcattagcatttttactagtattgatatagctataccagctttcttcagttagaatttgttggatatcgttttatcctttgactttcaaactatcttgattcttaagtgttagatgtgtttttataaacagcatatagctagatttcgttttatattctaagctgtcagtcttttgtctttggagagtttaggtttcctttttacatttattatgattccaagattatttggatttattttattatgttttctactgtgtgtacatccttctttttccacagtgttttttcctccatttttttcttcttttggacaaactgagtttcttattttctcattgcatttctccttttccatatttggcaattatacagtctatgactacacatttttagtagttactatagacattttaacatgcttattaagataaatgcctaatataagtcaatatttttatccttccccaaaaaatatataaagaccctagaacatttaactatgattctatccatcctaattatacactgtgtttccagacacaatcattctacaattttaattatacaaagtatacatagttattaatcatttataaaaagtaatatgtaagcagtaataaatccttatgtttaccatttcctctgcttacaaattcttgcatttgcacccttaagataggataatttttttatttttctttaacaatttcttcagtgaaaagttgttgacaataaactattcatgtttgggactgggtaaaaatatatttatcttttttcttgaaaaacagctgtatcatgtattgaactcaaggttaacagttattttctctgagaatgatttactatcttgtaacattcatgtttaagaactcggctatcattcacagataatcagtcatcattcataggtaactcttttttttcctattttcttttaaaaatattcttttggtctttggcgttcttcagtttcactatgatacgtgtaaatataggtttctttaaagacaccttgcttgggatttactgggcttcttagctatagagaatggtgacttccatcagttctaggaaattctcattatctgttttatacttctctctcttctgaattgtatattataatattttagaacttgtcatggcatgtatcttaactgcttttcaaaaaatactttttacttctgtgtctttctgtgggaaactcaaagtaacctcttcaaatatctttcagatcaccaattctctaacctaatcacctgttttgcctaaccattgaatttttcatcattatatttttcattttagatagctctgcctggtcaattttgacagtcttttgtttcttcaacatattcattagggaataatgtatattaaaatacttttttcagtaccttataatttcaatatctacagtgtttgcagacctgattctgtagtttgttcattctatgaagttactcaagatggcttatttgtgtgtcttgtgaaaaccatcttccttggaaccgtatgagaattttttgaaagctgtgtataaagtgcagaaagaatctgagtttccttctggcagatctctggaggtattgccaggataaggcaattttaaactagatttttggatggggttttagaggctacacagataatatgaatgctgacccaaagtccagataaggacaggcctatggctagaaaattccaacatggattctgttccttttttctgagcttcccagagccaaggctatgctagtcaaaagttctcccaacatctcctgctattcgggttagtgttattttcatttctccaacaaggtggtcaaattttaaagattcccagtaacatgcaaatgtatcttacgggactttccagttggcaggatacagaatttatcttttgtcttcagttcacagtctttcaagattcaagctccaggccataattgaaaagcagctaccccatcccccagcataatgctggtgttggctcactagtttggattttgtgctttttgtatcagcctcaaataatttccataattcagttatcagattatttatgtatataaaaatattttcttcatctcttttagttcttatagttcactatatatctagaaaccaaaccattttttaaaatcatattaatgtgcttctagataacagtgatatctatttcttctttagcttctaaatgctaatctgactaacagagatcctgttttctcctaacaggtgaaaatgtaagaacatgaggagtatcttccccaaaattattacccttagtaaaagacagagtatcttggaagtaacagggaactctgactaaggctggacagctgctgagagaagagaatatatataaagttttttctctttgtgctgccttaccacagaaaggattctgagcagtgtatcacttacatgtgcttctggtagtttccatcactataaattcatggcctggttaaaagttaaagtagagccatatacccccaaatacatccactttcagtcggaggaaggagaaaaaaataagggtaaggaaaaaatgcttttcactgcaaaatcacaaaatggcatgccgtattattgcattcattcattcatgcattcattgatatttacctagcacttactacatttagggcattattctaggtgctggagatataacagtaaacaatgactgtatgaatgatgatacatgaatatgtaaaaaagttaaaaaaagtgaatatgacagctctctaaaaataagaaaatatacatacatatcatttgttatcatctttattgcatgggaattcagattagttcttgtgtaccacaatgacaacagctgctttttccctcctcacaggagacaatatgtcttaatggacttggaattttcaaagcaatttttattggtgaagtttcttgcttcataacattttcaaaattctcttaatctacaattcagcacttctcagctctcattcagccacaaatacagaagaaaacccctataattcacactggcctttccaataaatcaattgatttagccagtatagtgttccaattcaacttctattttctccactcataaatttcaggtttcatactcacacccagccaagggccagaatgaaaaatttaacaaaagcttcagcatggttgttgagtaagcactctgatacattccacactataaacatttaatgagacttactcccaacagagtatttactacatcaatttacttcatagtattatatttgcaggagcaaaatagagcaaaggttattttggatcctttaccaatacagcttcctgtaaataatgaaaagtgcaaccatttaatttaccaaatcattaaaaaaggttaaatgctcaataaattctgctttatctagttcagtcagccacagcagctatttgtaacttggatataaaaaatatagaaaacttaggcattttttactagtttgtgcatctgtacctttgactagaactaaatttcaaaggttgttcagacagtttagaatcctcattaggatctcagagaaatatcttttggaccccttcccgcctcatgaagaacaactgagtctgcctttcttaagagaacactgttgccctgcctatgcccactcccactgaagttacacacataacacgcacactttctcctcctctccaaccactgccattttgtgcctgtggcagtcactttcaactaaaaagagaaaagagaagaggtctcagaaggaggaacaatttggaaatgtcttcttctttaatcctaaaatacagaatgcattgtctgagataaactggagctcttatgggagcattctctgacacaattgtgttttagtactgtgaaaaatgtgctatacaggttgagcgttgctaatctaaaaatctgaaatccaaaatgctccaaaatctaaaactttctgaatgccaatgtgatggcactagggaaaaattcagcatctaacttcatgtgacaggtcgcagttaaaatgcagtcaaaacatcatttcatgcacaaaatttttaaaatgttgtataaaattaccttcaggctatgtgtatagggtatatatgaaatataaatgaatttcatgtttacacatcaatcccattcccaagataattcattaggtatatgcaaatattccaaaatccaaaaaattccaaaatccaaaccacttctggtcccaagcatttcagataagggatgctcaacccgtatgatcctatctatctactctaacaaatttcaatgtatcacactcggcactccccagatacagactacagatggtccctgacttgatttaacaatggttcaacttataattttttccagctttatcatggtgcaaaagtaatacatattcagtgtgtatatagagtgtttcaggcccctaaaggtcatacccttcccagggtagagtaacctgcatccagtgactgaaagagacatacaggcctggccatttctgcctgacaaggtacactctggagggcaatgctctcaccagagctccctgctgattggcctaggctttgcgggtctagctgtcaggtagacttcttcctctatccagtcccgctccttccctctttccttcccaaatgtaacaccttgttttccaaactccattctgtgtgtgattctggaggacccagcctacaacactagccatgactccttcctttcattcatgtcccacatccattctatcaaaattcagttgactctatttacaaaatttagcactgatgtccaccaacaccactctagtctaaactaaaacatgaggtggttcatgtaaagtgtataaatggaacctgggttactacaatagcctccagcctggtttttcagttcctctcattgttctccttcagtctatgttccttatgcaactatcatagtccttttaagacacgagtcgcagcatgtcacacctttgcttaaaacctttcagtgtattcccatttaacttggagtaaaagccaaagtccttaaaggcatacacactcctaaatggttggttctccaaccttagctcctgctactcatcactttgctgtcttcacctagacaccctggtttttatgttgtcacttaaacacagggcacataccttcaagcctttgctctagatcttcatctgcccgattcctgaactctttcaaggctttggcattatctcaccttctcagtgtaacatctatacaattttgttctctacagtgtttattggttttattttttgcctataatcacctgctaaaatgtaaaaatttgtcaagggaagtgatcagatatgtcccaagcacatagaacagtaatgccaataagtatttgtggagtgaataaatcttatgcttcataagtagatctacataaaacaaagtcatcatttcgatctaattaacaatcccacttcaaattcattggattccttggcagagatgtacaggagtcagaagtttactaacagagtactttcctgttaatcaattctttggaagactcaagaaggtgatagagactaatctggattttttattttctcatgctctaaacgccaacatgtggatcttcttctgttttattattattattactgtattaggacatcagatcacactttatctttctcccgacttacctccagctcatcaagggcacttcccagggttgctgcctgaggttctggtggggttgtcatattctggatcccttgtgaagcatttgaaattacattgagagcattctgaatttcttcacaaactgtgtccttgcttgctttgagggaagcaacatcagaatgctccaaacaagctgaacaaattgaatgcaagaggggagagttctccttcagtgaagctcgggctcctgcaatttcatctctctgatttggagattttaagtcctgagaaggtaaataaaaagagtggtatcttacaatgggttatgggagaaagacttaaattaaaaagcttctttttttgtaagtataaatgaaaagataatagacatgaagaagtcagctataagttataatcaagggcatctattatttctacattctttcagtttctgttaaaaattctgcagtataaacaatgacacagttaataagtaaaggtccccgtagagcagatgtgtaaagatccattactattcagtcaagtccttgtcagtcaaatccttataagtagctaaaatactctggcattcacattattaagtgcattacatgggagcttgaattacaaggatgctgattacctcattccatagatgttgataattgcatttaacctctccgttaaaattagaccaattgagttaagaacactaatgaaacctcccaccattcagctatttttctttttcagaaatactaataaattaatcctatatcattctttctttgatatttattcaacaattagttactgagcacttagcatattctagcccttgtgctggactccagtgtacagatatgaaaaaatcctacaaggaccttgttcttctttcttttggggggaaagggcctacagacaaacaatgaactagatgaacaaatatacgagatgatttcaggtgacaataaatgctatgaagaaaacacaaaagtgaagtgtcatagagattgacttgaaaggaaaagctgctttaggctgaatggtccgagaaggtatttcttcagagatgacaatttgcagtaaatgtaaatgaatagcattacatcagagagaagagaggaaagagaatgccctgtctaagtgataggcgatcagaactagctcaatatacaagaaaaaaatctggcaagccctaccttaaccaagtgatgaaatttaacataatcagtgatatcacatggatatcatgtaccccttgatatactgtgacaggaaaagtatgccatttctgtggtattccctccaggaacccataattccagtctaatcatgagaaaagcaacaaacaaaatgagattggtgaacatcctaaatgacacctgggcagtattcctcaagaccattaacatcatggaaaacaggagatggactgacaagctgtcacagaacagagaagattggggagacataactaaatgcagtgtggtactgaggattagatcctggaacagaaaaaacattcatgaaaaactgctgaaatccaaataaccattattaatagttaatagcaatgcatcagtatccatttctttgtagtggcaaatgtaagatacagcattaacaatggagaaaactggaaaaaaggtaaatgggaactctctgtaccacctttgcaacttttctgtaaatctaaaattactcccaaataaaagcttaagttaaaaaaaactaattcaagggacatttacaatagttcattcacttcatatacaacatttcatataatctttataaaaactcatgagagatgtgattattcccattttaaaactcaaaacactaaggtttcaagagactaagtttcttagccaagtggcagagctagatggtggtatttcttgtattgtaacccacgtcagtataacttccaagcccttatcctaaaaactatgtgacattatttcctacataggaaaaatttttttcttttttctttttttatgacagagtcgcgctctgtcgccgaggctggagtacagtggcgcgatctaggctcactgcaagctccgcctcctgggtttatgcagttctcctgcctcggcctcctgagtagctgagactacaggcacccaccaccacacccagctaattttttgtatttttaatagggacggggtttcatcatgctagccaggatggtctcgatcttctgaccttgtgatccgcccgcctcggcctcccaaagtggaaaaatttcttatttgctacacagaatgaggacttgtatttgtataatatcatgtagcttataaagtgcttctatacagtatcttactgatcatgacaatagtctttgagggaatgaggctgctattattagtcctattttaactaaacaggtgtttggtgcaaggagatagaaactagtaaaggaacagagatctaaacctaagtctactgattgctaaccttatgccttttcacaagactctgctactctgggaataatgttgcatgaggttaataaatggcttgtgctactatatttttagttccttcccttctgaaaataaacactgtctgctacttcactcaggctttggagagattaacttcgttacaaaatgtagggaggacagttagaagtagctatcaacccactgttcatagtcactaatcacccaagaaaagacactatggttttcttggcttgctacgatttcccccttgtatatgtggtctgggttttagttttagttctgtcattagcactgtgagctaggtaactcatctctttcggtgtctgtctttctatctgtaaaaatgggataatgatacttctgccgaccctctcacaagattgagtacatagcacatcagaaatggaatataagtggaaaatagagaaaaggtgtagaaagaatacggaattgttttattccttacatctgtcaaacttggtgtactgtttctgtactgataatcttagtgatttttgtatttcccacaacgttgtacaagctctacctacagtcatcagtgtaacttagaggataaatagtttaatgtttagaaaggatgcacagctcctcagatgagtaataattaaaagtataaatatttagaaaaaggtaaggcaaattctctgatattactgtacaatcacaacttaatacataattctctctgaagtgacctatacattatgcttctttatttagaaggacagtgtcaaggtttagtttgtttctgaaaggtgaaaaacttgaacatagattataatcaagaagctaaagttaaaattatttcttttgctctaatggtagcaatgtgtaatctgatggtaaattgtagtaactttaatgccatggggactttgaaatgttaaaaatacaaatgtattttgaatttggagcctatgctttgtcatctctgcccaaggcaattacagaatccatgagcccaaatagcaagtccttgacgcctgcgaaaaaggactagatcagtgaacataacaaatataacgttacagcagtggacaggggcaaaggggcaggtggcagagtttatgtaaggaaaactgacaaggcatgaccatttctcccaaaggacatcaagcatgataaacttaatgtagtaaataggcacacagataaaagagaaattaatgactgtcacctcctaaatgtatgttgtggtagtggtgtttgtagttgttttattttaactgatgataccataggttcaaaggttcttgtttgtccatttaccctaaaattttacataaagtcaaaataggcattaaacagtaaagttaatcagggatttctttggatggagaagtataaagaattcagctcctcaaggattgatacttatttataatctttttttaaatgctccagaagaaagctcacaggagatttccaagttaagaagacattaaatgtttccagctgacgaagaaacacacagatgggatttaaaaagaccttaaagtctgtgcaagtgggtagagaagtaacatatgagttttaaccctggcaagagaacaaaatatatttaggaatattattttaaaaaatacaagtggagggctttaagctatcagttaattaattcaaccattccttcaacctgtactatgttgagcctctcctatgctgagcctcgactttgcatcaaggcagtgtgctaaatgttggaaatgcaaagataaagatcaggaggggagacaaataaacacatttacatgggaactaaaatagagttacccacagcatagaggacagtctctcagtttgaagggattaaataaaatttctcagagaatgtgaatcttttttccagctttattgaggtacaattaacaaataaaaattgtgtagattcaaggtgtactatatgatgctttcatatacatatacattgtgtaatgattactacaatcatattaatcaatatatccatcaccacacagttaccctttgcgtttgtgtgtatgtgctgtgagaacatgtaagatctattctcttagcaaatttcaagtaagcaatacattattattaactgtcttcaccatgctgtgagttaggtccctagaacttactcatcttataattgaaagtgtataccctttgaccaatatgtccccgtttcccccacatgccaacccctggcaactatggtaaaactgcttctatgagtttgacttgtttagattccacatataaatacaatcatacaatatttatctttctgtgccgggcttatttgacttagcataatgtccttcaggttcatccaagttgtcataagtggtgggatttcagagaaggtgaatcttaaacagtgagtagaagttatccctatgagggaggacccacagaccctttgaaggaagcggactgctcctgcaaaatctgggagacaccacaaatactgtgagtgccccaactgcggaagtgggaaagggagagcctcctctcctgaatacacaaccccactggggcaaatgaaggtctgtttgcgggagaagtttctgaccttacctggagctgagtcaatttaaagagccaagcaaaaaaaaatatagagaggaagcagcagaaagtccctaggagctcgctgggtccccagtcaggccattcctgcctggcatcacagggatccactgggagggcagccagagaagcaggggttgggggagggggaagcaccacagggagaaggaaaattccagctgaacttcgtaacaatttgaacagggtgagaagcctcatggccagaacttgagggagggtgtgaatccagcatgcagactccacagcgtgggggaagaaccaggccgttttcatttgaaggtggcaggcaggtagcctggggcaagttctcaagcccagcttgcccaccacctggaaacagacttggggctgtttgggggcacggtgggagtgagaccagccctttggtttgcctgggagctgggtgaggcctgtgatggccagctttcccccacttccctgacaacctggatgactcaggagaggcagccataatcttcttaggtgcacaactccattgacctgggaatctcactcccaccccctacagcagccacagcaagacccacccaaggacagtctcagctcagacacgcctagctctgtccctatttgatggtccttccctatccaccctggtagctgaagacaaagggcatataatcttggtagttctaggacctgcacgctgccagttcctctccatactaccacagctgatgctctctacaaaaccccatctcctggcaggaggccaaccagcacaaaaatagagcattaaaccaccaaagctaagaaccctcacggagtccactgcaccccgctgccacctccaccagaacaggaactggtatccacagctgagagagccatatatggttcacatcacaggactctgtgcagataacccacagtaccaacccagagcagggtagacttgctgggtggctagacccagaagagagacaacagtcattgcagttcggctcacaggaagccacacccataggaaaagcgggagagtactacatcaagggaacaccccttgggacaaaagaatctgaaaaacagccttcagccctagaccttccctctaacagagcctacacaaataagaaggaaccagaaaaaaaaatctggtaatatgacaaaacaaggctctttagcacccccaaaaagcacactacctcaccagcaatggatccaaaccaagaagaaatccctgttttacctgaaaaagaattcaggaggttagttattaagctaatcagggagggaccagagaaaggtgaaacctaatgcaaggaaatccaaaaaacaatacaagaagtgaagggagaaatattcaaggagatagatagcttaaagaaaaaacaaccacaaattcaggaaacattggacacactttagtaatgcaagaagctctggaaagtctcaggaatagaactgaacaagtagaagaaagaaatccagagctcaaagacaggtcttcaaattaacccaatccaacaaagacaaagaaaaaagaataagaaaatatgaacaaagcctccaagaagtctaggattatgttaaacgaccaaacctaagaataattgatgttctggaggaaggggagaatcctaaaaccttggaaaacatatttaggggaataatcaaggaaaacttccccagccttgctagagacctagacatccaattacaagaaacacaaagaacacctggaaaattcagcctgaacagatcgtctcctagacacattgtcatcaggttatccgaagttaagatgaaggaaagaatcttaagagctgtgagacagaagcaccaggtaacctacaaaggaaaacctgtcatattaacagcagatttctcaccagaaaccctacaagtaagaagcaattgggaccctatcttcagccttgtcaaacaaaacaattatcagccaagaattttgtatccagtgaaactaagcatcatatatgaaggaaagatacagtctttttcagacaaacaaatgctaagagaatttaccattaccaagccaccactacaacaactgctaataagaagctctaaaccttgaaacaaatcctagaaacacatcaaaacagaacctctttaaagcagaaatcatacaggacctataaaacaaaactacaagttaaaaagcaaaaacaaaaaaccaaagtacatagacaacaaagagcatgatgaatgcaatggtacctcacatctcaatactaacacagaatgtaaatggcttaaatgctcgacttaaaagatacagaaccacagaatgcagaagaactcaccaaccaaccatctgctgccttcagaagactcacctaacatgtaaagactcacataaacttaaaggggtggaaaaaggtatttcatgcaaatggacaccaaaagcaagcaaaggtagctttttttttcttttttttttttttgagatggagttttgctcttgttgcccaggatggagtgcaatggcgcaatctcagctcaccacaacctctgcctcccagtttcaagcgattctcctgcctcagcctcccaagtagctaggattacatgcctgcaccaccatgcccggctaattttgtatttttagtagagccagggtttctccatgttggtcaggttggtcttgaactcccaacctcaggtgatctgcccgccttggcctcccaaagtgctgggattaaaggcctgagccaccatgcctggccaaaggggtagctattcttatatcagacaaaacaaacttaaagcaacagcagccaaaagagacaaagagggacattatataatgataaaaggccttgtccaacaggacaatatcacaatcctaaacatatatgcaacactggagctcccaaatttataaaacaattactaatagatctacgcaatgagatagcaacacaataatagtgggggacttcaatactctactgacagcactagacaagtcatcaagacaaaaagtcaacaaaggaacaattgatttaaattataccttggaacaaatgaacttaacagatatatacagaacatttcatccaacaaccacaaaatacacattttattcaacagcacatggaactttctccaagacagactatatgataggccataaaatgagcctcaataaatttaagaaaattgaaattatatcaagcactctctcagaccacagtgggaaaaaaactggaaatcaactccaaaaggaaccttcaaaaccatgcaaacacatggaaattaaataacgtgctcctgaattagcattgggtcaaaaatgaaatcaagatggaaatttaaaaattcttcgaactgaacaaaaacctctgggatacagcaaaggcggtgctaagaggaaagttcacagccctaaacacctacaccaaaaagactgaaaaagcacaaactgacactctacggctatacctcaaggaactagagaaacaagaacaaaccaaacccaaacccagcagaagaaaggaaataaccaagatcagagcagaactaaatgaaatcgaaacaaaatgaaaacagatgataaatgaaacaaaaagttagtttttttgaaaagataaataaaattggttagcaagactaaccaagaaaagacaagcgaaaatccaaataacctcattaagaaacaggagataggccaagcacagtggctcacgccggtaatcccagcactttgggagactgaggcgggcagattacaaggtcaggagtttgagaccagtttggccaacatggtaaaaccccatctctaccaaaaatacaaaaattagcagggcgtggtggcaggcacctgtaatcccagctacttgggaggctgaggcaggagaatcgcttgaaaccggaaggtggaagttgcagtgggctgagatcgtgccactgcactccagcctgggcaacaagagtgaaactccatctcaaaaaaaaaatagaaagaaacaggagatattacaactgataccactgaaatacaaaagatcattcaaggctactgtgaacacctttatgcagataaactagaaacctagaaaagatggataaattcctggaaaaatacaaccctcctagcttaaatcggtaagaattagataccctgaacagaccaataacaagcagcgagattgaaatagtaattaataaattaccaacaaaaaaatccaggaccagatggactcacagcagaattcttccagacattcaaagaattagtaccaacccttttgacactattccacaagatagagaaagaaggaaccctccctaattcactctatgaagccagcatcaccctagcaccagaaccaggaaaggacataaacaaaaaagaaaattatggaccgagatccctgatgaatatagatgctaaaatccttaacaaaatactggctaactgaaaccaaaaacatatcaaaaagataatccaccatgctcaagtgggtttcataccagggatgcagggatggtttaacatatgcaagtcaataaatgtgatacaccacataaacagaattaaaaacaaaaatcacatgatcatctcaatagatgcagaaaaagcatttgacaaaatccaggatccatttataattaaaatatcaggaaaatcggcatacaagggacatacctcaatggaataaaagccatctatgataaacccacagtcaacattatactgaatggggaaaagttgaaagcattccctctgagaactggaacaagacaaggatggccattctcaccactcctctgcaacatagtactggaagtcctagccagagcaatcagacaagagaaagaaataaagggcatccaaattggtaaagaggaagtcaagctgtcactatttactgatgatatgatcgtttaccttgaaaaccctaaatactcctccagaaaggtcctagaacgatacaagaattcagcaaattttccagataaaagattaatatacacaaatcagtagctcttctatacaccaacagtgaccaagtggagaatcaaatcaagaactcaacaccttttacaattgctgcaaaaaataaaataaaataaaatacctaggaatatacctaacaaaggagtcgaaagacctctacaaggaaaactacaaaacactgctgaaagaaatcacagacaaaacaaatggaaacacatcccatgctcatggatgggtagaatcaatattgtgaaaataaccatgctgccaaaagcaatctacaaatttaatgcaatccccatcaaaatactaccatcattcttcacaggattagaaaaagcaattctaaaattcatatggaaccaaaaaagaacctgcatagccaaagcaagactaagcaaaaagaacaaatctggaggtatcacaccacctgatttcaaactatactataaggccatagacatgaaaacagagtggtactggtataaaaataggcacatagaccaatggaacagaatagagaacccagaaataaacccaaatacttaaagccaactcatctttcacaaagcaaacaaaaacacaaagtgaggaaaggacacccttttcaacaaatggtgctgggataactgactagccacatgcaggagaatgaaactgaatcctcatctctcaccttatacaaaaatcaactcaagatggattaaggacttaaatctaagacctgaaattataaaaactctatacgataacattggcttaggcaaagatttcatcaccaagaacccaaaagcaaatacaaagataaacagttgggacttaattaaactaaagagcttttgcatggcaaaaggaacagtgagcagaataaacagacaatccacagaatgggagaaaatcttcacaatccgtaatctgacaaaggactaatatccagaatctacaatgaactcaaacaaatcaataagaaaaaaacaaaaatcccatcaaaaagtgggctaaggacatgaatagacaatgctcaaaagaagatatacagagaagccaagatagctgaataggaacagctcggtctacagctcccagcttgagcgacgcagaagacaggtgatttctgcatttccatctgaggtacagggttcatctcactagggaataccagacactgggcgcaggtcagtgtgtgcacacaccgtgcgcgagccgaagcagggtgaggcattgcctcactcgggaagcgcagggggtcagggagttccctttcctagtcaaagagaggggtgacagaccgcacctggaagatcgggtcactcccacccgaatactgcgcttttccgacgggcttaaaaaacggcgcaccaggagactgtgtcccgcacctggctgggagggtcctacgcccaccgagtctcgctgattgctagcacagcagtctgagatcaaactgcaaggcggcagcgaggctgggggaggggcgcccgccattgcccaggcctgcttaggtaaacaaagcagctgggaagctcaaactgggtggagcccaccacagctcaaggaggcctgcctgcctctgtaggctccacctctgggggcagcgcacagacaaacagaaagacagcagtaacctctgcagacttaaatgtccctgtctgacagctttgaagagagcagtggttctcccagcacgcagctggagatctgagaaccagcagactgcctcctcaagtgggtccctcacccttgaccccagagcagcctaactgggaggcaacccctagcaggggcagactgacacctcacagggccgggtactccaacagacctgcagctgagggtcctgtctgttagaaggaaaactaacaaacagaaaggacatccacaccaaaaacccatctgtacatgaccatcatcaaagaccagaagtagataaaaccacaaagatgtggaaaaaacagagcagaaaaattggaaactctaaaaagcagagcacctctcctcctccaaaggaacacagttcctcaccagcaacagaacaaagctggacggagaatgagagaagaaggcttcagacgatcaacttactccgagctacaggaggacattcaaaccaaaggcaaagaagttgaaaactttgaaaaaaatttagaagaatgtataaccacaagaaccaatacagagaagtgcttaaaggagttgatggagctgaaaaccaaggctcaagaactacgtgaagaatgcagaagcctcaggagccgatgcgatcaactggaagaaagggtatcagcaatggaagatgaaatgaatgaaatgaagtgagaagggaagtttagacaaaaaagaataaaaagaaacgagcaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagacactcctcgagaagagcaactccaagacacataattgtcagattcaccaaagttaaaatgaaggaaaaaatgttaagggcagccagagacaaagcttgggttaccctcaaagggaagcccatcagactaacagcggatctctcagcagaaactctacaagccagaagagagtgggggccaatattcaacattcttaaagaaaagaattttcaacccagaatttcatatccagccaaactaagcttcataagtgaaggagaaataaaatactttacagagaagcaaatcctgagagattttgtcaccaccagacctgccctaaaagagctcctgaaggaagcactaaacatggaaggaacaactggtaccagccactgcaaaatcatgccaaaatgtaaagaccatcgagactaggaaaaaactgcatcaactaacgagcaaaataaccagctaacatcataatgacaggatcaaattcacacataacaatattaactttaaatgtaaatggactaaatgctccaattaaaagacacagactggcaaattggataaagaatcaagacccatcagtgtgctgtattcaggaaacccatctcacgtgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggccattacataacggtaaagggatcaattcaacaagaagagctaactatcctaaatatatatgcacccaatacaggagcacccagattcgtaaagcaagtcctgagtgacctacaaagagacttagactcccacacaataataatgcgagactttaacaccccactgtcaacattagacagatcaatgagacagaaagtcaacaaagatatccaggaattgaactcagctccgcaccaagcggacctaatagacatctacagaactctccaccccaaatcgacagaatatacatttttttcagcaccacaccacacctattccaaaattgaccacatacttggaagtaaagctctcctcagcaaatgtaaaagaacagaaattataacaaactatctctcagaccacagtgcaagcaaactagaactcaggattaagaatctcactcaaaaccactcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagacacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcatcactgatcccacagaaatagaaactaccatcagagaatactacaaacacctctacgctaataaactagaaaatctagaagaaacggataaattcctcgacacatacaccctcccaagactaaaccaggaagaagttgaatctctgaataggaccaataacaggagctgaaattgtggcaataatcaatagcttaccaaccaaaaagagtccaggaccagctggattcacagccgaattctacaagaggtacaaggaggaactggtaccattccttctgaaactattccaatcaatagaaaaagagggaatcctccctaactcattttatgaggccagcatcatcctgataccaaagccgggcagagacacaaccaaaagagagaattttagaccaatatccttgatgaacattgatgcaaaaatcctgaataaaatactgggaaaccaaatccagcagcacatcaaaaagcttatccaccatgatcaagtgggcttcatccctgggatgcaaagctggttcaatatacgcaaatcaataaatgtaatccagcatttaaacagaagcaaagacaaaaaccacatgattatctcaacagatgcagaaaaggcctttgacaaaattcaacaaccttcatgctaaaaactctcaataaattaggtattgatggggcgtatttcaaaataataagcactatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaagaaaagaggaagtcaaattgtccctgtttgcagatgacatgattgtatatctagaaaaccccattgtctcagcccagaatctccttaagctgataagcaacttcagcaaaatctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatcaagctactaatgactttcttcacagaattggaaaaaactattttaaagttcaaatggaaccaaaaaagagcccgcatcgccaaggcaatcctaagccaaaagaacaaagctggaggcatcacactacctgacttcaaactatactacaaggctacagtaaccaaaacagcatggtactggtaccaaaacagagatatagatcaatggaacagaacagaaccctcagaaataatgccacatatctacaactatctgatctttgacaaacctgagaaaaacaaacaatggggaaagtattccctatttaataaatgctgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtttaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaatctactcatctgacaaagggctaatatccagaatctacaatgaactcaaacacatttacaagaaaaaaacaaccccatcaaaaagtgggcgaaggacatgaacagactcttctcaaaagaagacatttatgcagccaaaaaacacatgaaaaaatgctcaccatcactggccatcagagaaatgcaaatcaaaaccacaatgagatatcatctcacaccagttagaatggcagtcattaaaaagtcaggaaacaacaggtgctggagaggatgtggagaaataggaacacttttacactgttggtgggactgtaaactagttcaaccattgtggaagtcactgtggcgattcctcagggatctagaactagaaataccatttgacccagccatcccattactgggtatatacccaaaggactataaatcatgctgctataaagacacatgcacaggtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagcaaactatcgcaagaagaaaaaacaaaacaccgcatattctcactcataggtgggaattgaacaatgagaacacatggacacaggaaggggaacatcacactctggggactgttgtggggtggggggggtggggagggatagcattgggagatatacctaatgctagatgacaagttagtgggtgtggcgcgccaacatggcacatgtatacatatgtaactaacctgcacattgtgcacatgtaccctaaaccttaaagtataataataataaataaaaaataaaaaaataaaaaaagaagatatacaaatggccaacaaacatatgaaaaaatgcacatcactaatgatcagggaaatgcaaatcaaaactacaaggcaataccaccttactcctgcaagaatagccataatcaaaaaataaataaaaaacagtagatgttggcatggatgcagtgatcagggaacatttctacactgctgatgggaatgtaaactagtacagccactatggaaaacagggtggatcttacttaaagagctaaaggtagaactaccatttgatccagcaatcccactactaggtatctaccccagaggaaaagaagtcattacatgaaaaagatacttacacacatatgtttacagcaggacaattcacaattggaaaattgtggaaccaacccaaatgcccatcaatcaatgagtggataaagaaactatggtgtatgtatatatatatatatatatatatatatatatatatatatatatatatacacacacaatggaatactactcagtcataaaaagaaatgaattaatagcatttgcagcgacctggatgagattggatactattattctaagtgaagtaactcaggaatggaaaaccaaacatcatgtgttctcactgatatgtgggagctaagctatgaggacacaaaggcataagaatgatataatggactttggggacttggggtggggaggtgtggaattgggggaagggataaaagactataaatatggcgcagtgtataccgctcagatgatgggtgcaccaaaattttacaagtcaccaccaaagaacttactctagtaaccaaataccacctattccccaataacttatggaaatttttttaaaaaattaaaattaaaaaattcaaacattgcctaagtataatagaaaaaaaaagaagctatccctatgagcaatgcagaacaaaagagcatgtggaaaggtctgaagcatgaaaaggcgaggaaggtgcaggtcactgcaggtgatatgacaaatacaggaaacctaagcatgaatggtgatgaatccagcagaaaaaggtaggcaagagacatttcacgtgctctgctaaagaactctgaaagcaacaagctcagatgtgtatttacaaagattgctctggcaatgggtttttgagtggattggagagaatgaaattgcagtcagagagaccaggcaataacccaggtctgggaaagagacaataagtgcctgaacactattgctaggctatagtgggagagatccaggaaatttttaggaggtacaaatggtaggattttggtatatctagatgggagtagggaagagaagatatttgaaagcatctagagaattgtttcagcaatcgtggaagtggtgatgcattcaccacaatgagaatacagagagaagaatgtacttggaagaaaaaggtgaacacattttgtaatctgccaaatgtaatatatcagcacaagatccaaatgaaaatacaatacacatgaatctagacttcagaggagagtctgggccagaaatagagatatgtgaaacaccagctcacagttgggagctaaagccatgtgtgtgaaggctacaggacctgcatccagggtgaatattacaataaggagaagaatctaggagtcatcgtaaattgttccttgagtatatcaacccagtaattttatgtgctagcccaaaaggccaaatatatatttatattagcaagaagggtatcagcaaatactaaactaaaaaaaaaaaaattcaattaaaaatatttttaaataggccagaaaacgcatgcaggctacagagttagaatctaaactactgtgggtaatcatggtcatcataccttaagataacaaatgatttttctttaaaagcaattttgaacagaatgacttctgtttctggaaagcttaaaaatatgaggtctgttcaccttggaaaggggaaatttttattggaaaacgcatgataaaaacatctgtaaatcatgaacgaacttgataacttgttaatgggcttctttacttaaatctggagatactaggtcatagaagtagctttttagatttgagtaaaataaattatatctgttcatacttctgtcttcactacttcattataattctcttgaatgcaagtactatggcttacttattttatacctcattatctagtagtatacagcacatattaggagtttaatacatttttgttaaggaaacagacaaatgaataagaattaagccagaggaagtcaatatgctcaaaaggagatagaaactccagatatgattactccaagaaataaaacatggggaaaatataccttaatccagagagtttgaataaatttatgcatggcaatgccacagaaagctgaagagcaaaattaaactataactatcttcacattaaatggtagtgaggccgttggtacgactactttggaaaatgatttgatagtatttactgaagctgagtatatgcatgccctgttacccagctatttcattcctaggagaggatacacacatatggaaatatgttcctatgtccatctaaagacacaggcaaaaatgttccataccagcactgtctgtaatagtcccgacctggacacaacccagagtaatgaaaaagaaaaaaagacagctacacgtgataaaaaaaaaaaaaaagcaagacataaaagagtatgtatggtttaattccatctatgtgaagttcatactcaggcaaaagtaacctatcattttaaaaatcaaaatagtggttattctttggggggtgattagagactaaacagggaggaggaatctttcagtttctggtaattttctatttcttgtcctgggtgctagttacaccaatgtgtttagtttggaaaaattcattgaactgtttatttcacactatgcatttttctgaatgtatgttatactttaattaaaaaagcttcacataaaatcaaggaaatgaaaaacaaaaagtaaagccaatatctacagtgtgagccttcttttggcaaaggacactggtataaactagctatggactggctatgttgtcatattacccatgtcattaagggaagaatgagaaaattagatattctgtccatctgtaagaatcctgtatccactttgagggctcatatttttaaaaaagaaaaaaaagtctgaaatataaaaataagaagagaaagctcctgtagcctgaccatcagaaaaagcaaacctaagaggttttcacagcaactgattccatgaaccgttggacaaacctgcatttctgagaatcaaagaaaacttccttacgaagctacattcctgcccacatggaatagctcagcatatactctgctcaacaaagcagagctacatacaaattactgagtttctcttccaggtgtttaaatgaggtttctgaagctgacaaaaccactctggtaagggaaggaaagggagcttataaaaagaggttttgtttgtttgagattaagatgtgcagcagaaaagcccatgtatactttgctatttggattccattatgggttggcttctgtctccagtcttctctctgccaagatgctgcataccaattgcttcactggtcattgggcagcttcatgttctattaggaaacaaaataacacaaacacctgctaatttaatgttcttggccaacttaaattaggaaatggaaacttagtcttaactgagctgaaggatataagatggtgaaacaacagtaggcttcaggtaaaagaaagttttgagaagaaaaattaaaattaaaaaaatgcaagattttacaataaaagcatcattaaggagcagagagaggcctttactacttttctatccttatttcccatttgtcatttcatagaaataggacagattcaataaaagagaaaataaaagaattcttcaaattcaaataggaaactgagaaaccatatcataatagtattaagatatctcccaaggtgtgcattctgggccattaatgcataccttgggtaactgaaatacaccaaggtgaatattaactccaaagaaacctatgaggaaaacattatcacttaattctaatgcggactactgtgtcagtcaagaaaatgtaggggggtgtgtgtgcacatgtgtgtgtgtgtaaagttcaaaaatgcactatgttcatttcctgttcatctgaagcaaatacaatatgtattacatttgtctattgtttgcttagaatttatatctcaaaataaatggtatctgaagccatctgccgcatgattaaaaagtaaaaggaatacacagaaaaacaaaaaagttatgggctattttagcaaaattcagtggctgtacttaatgcatcctttccattggtgcatatgtttcatcatttaatctatcaagaagagtcaaatatccataggtcagggccaggggtgatggctcatgcctacaatcccagcactttggaaggccgaggcaggtggatcacctgaggtcaggagttcaagaccagcctggccaacatggtgaaaccccatctctactaaaaaaatacaaaaattagttgggcatggtggtgtgcaccagtaatcccagctactcgggaggctgaggcataagaatcacttgaaccttggagacagaggttgcagtgagccaagatcatgccactgccctctagcctaggtgacagagtgagactgtttcaaaaaaaaaaaaatccataggtcagaaaatttttcctctaaagcataattaacaattataaaagtaaagttgaattttttaatttagtcaaaaatcaataaatatttttatccttgcaattccttcctatttaagttttcttgtgagaaacagaccacttgtttcctgaacattatggtgcatctcaaagagcaaacagaatcacttagatcaaatagggtccaaagcccagggatgttgacccaacttcctagttaataattcattacatttgtgtagtgatttattctgttcaacatatttccagccattcttccacaaggagttctatgagaaatcataaaaagcggtatcccttgttgtcaaaagaagaaatggacatttgtcaaaaggcacacacatattaataaaaagtggtgatggtgatttttttcagaaagccaacatttaccaagcagctatgatgcttcctatattcaagtactctctaatcactttctcatttaatggccccactaggaataggatccaagactggctcctgtctcaacactctttctactcgacactatttctatttgttgtcagtagctcccacatctgctcttaaagcctgtcaaaaaactctcctttaactctgcccatctgcggtgacccaatagagaatatatatttcaggcatatcttcctgacaaagaactgttgtaactaatacaactaagttagaaacattttcctgaattcagttttagaacaaggctgatacaaaaacctcaggtcaaaactacaagattaaaaattaaagtgtggtccataaggtcatttagaatgctcaaaaatataagtcagatatgtggagaaagaatgaaactaataagtataatcttgaatatttcaatctaactttgataaaggaaacattctaaatatggcatatttgtagactaatggttgattttcccacaggaaaaaagtgttttgctttttagtttaattcaaatagcttgaaatgcctgctataaggtgtgactttaaagctaagactacaaactcaaatgtttaagcaggaagcgtgaatagggcagatgaaagtaaatagggagtggtgaggccttggcacactatactgtatctgccccgatttaaacacattcagatccaattgaccaaaccaaaagaatccctgaatctaatatactagcacagatgtttctgtgagccttattaattcagtcaccatgctgtgcattcatgcaatatatgtgcctgaccttggaagacctcggaaagataggaaatgcatgtctccgggcctgatgagcctacaataagccaaaaggactgaatgaggagcaactccaaggcaggaagtctgcctcattttaatggaaatagcataagctttgaggttagaatcccagtgcaaaaacactccaatagcaggagatttcaggcagaataattaacctcacttcagctacaaaatgtgaacaattcctaccttttagggtattaatgaagttaaatgatttaatgtcaaagacttttccagcattttcttatttgatgtctctccatgcaacaaactattagccatattccctctttacaatatttctcccctgttttcttagatgacagcaacctaaatttaaactgagaggtgtttacctctcctctaagttccagctgcatatctcaagttgagtctcaaacatgtccgaagttgagcccattgtgtttcctacactcccactccccatgtttctctccagcattccatctgcatggccctaatattcagctgatcaaaaagaaacgtgaggaatatccgtgacttttccaacccccccaacccccaccattaggtaaggtctattattacactcattaactatttctccaatatacacccttgctctgttcctcactagtagcactagtctagaggagaaataattagggataaaattaaggaagtgcacgtgaacacaagggagatgagagactacagaaatatttagtaagacagaactttttgaccaatcttttctctgtcataccatcagaggaaactctttaaaacttaaatctggtcatcactcctccaatgtaaaattttctaatgatggttaatccacaaataagaaaactcatattttttgttatagacaagcatgcttctctggcttctctctctagtcttacttcctactactcctgtcacggtcactcttttctccagatacatagaatccatgaggttccactggtgcctttgcatgagctatgttccagtctcccctgcacctcctaggaaatgactattcatcttttaagtcatcgtggattcttacattctatcacacacagacttcactcatgtgccccctttatatggcactagtctagcagatattttaaactattactctttgctgtaactatttgttgacacgtctgtgtctctcaccaaatcatgagttcctcctgaggccaaaatgatgtcttcattcctccatccactaggccttgcataggaactagctgagagtaaccaatgaattgataacacctctcaccactttaaagtaatgagaaaaccttgagggtcactgccataaaataatttacttttccatgaaataaaaattgcacttttgtaaaaggaaatcacaactgcaaaaaagctcagatatgctcagtctagaatggaaatgttttttaatcttccctgactaggctaagtagatttgtttatgaactagtcttcaaagttttctggtctaagcctcttttaaaaaaccagtgatgatggtttttaatcacttataagaaggtgtgtctttcagaacctattgctttgactctcaggatgttctaaaatatacctaatttctaacacattccccaacagaaacaagactgagaagaatgcagataaagatgtctcacacttgacatgcttttcagaaagttaaattagtgctccctatgttaaccaataactagattcatctgatcgaggaaaacagaggtaacttaggttgataatcttgctaaatttcaggtattctgaaaaactgatttcaacaagtatttatatagtggaattgtgcttagagctgtgagaaaatagaaataccaagtaaaatcaagtacccagctctgcagtcctctgttcttcagaaattgttagataatgatatgctaaaataataaatttggctaaaattagtgaaatagataataattaccataggaattataaggaaagcatgaaaagcttaagaaatgcttcagagagaggaagatgcacatttctaaatgtaccacgtaaaagctagtccagaaaaccggtatgaaagtcagttggcttgctagtaggcatctcagacattctgtatcaaaatttgagctcctgatagtgcccctcagcccactattcttacggtatttaacagttcagttaacagcaattcttctaattgccagtgccaaacactttgttgtcatctttaagcttctccccttctctcatatcccacatccagtctgtcagaaaatcccatcagttttaccttcatttatgaaaaatgtgacctcttattacctctacaacttaccatgtcactgcttggctcagaccatcctatgtatctctgtgaccccactcccagtactctccttgcttaccctgaccagctccatggacctccttgctgcttatccaagaagccaggcacatccctacattaggccttcccacggccggcatgctcttctagatccatgactccctaacttctttcaagtctttcctcaaaaataaacttttcagtgagacctcccctggtcaccctgtctaaaagttcaatcaacaattccaacctcaatatgccatatttcccttccttgctttattttctctgtactatttgtcactaatatatactacatttatttatcatgtttgttttctgtcttctccagtggaacgtaagctccatgaaggtacataagaggtgataaatatttacttcatgaatgaatgaacagcaacccaaatcaagaattttcaattaatttgacatattttactgatcacacatgcaaaaagttatcctatcatatggcaataaaataccagagaattggccaggtgctagtggctcacgcctgtaatcccagtgctttgggaggccgaggcgggcggatcacgaagtcaagagattgagaccatcctggccaacattgtgaaaccccgtctctactaaaaatacaaaaattagctgggcatggtggcatgtacctgtagtcccagctactcaagaggctgaggcagaatttcttgaacctgggaagtggaggttgcagtgagccgagattgcaccactgcactccagcctgggtgacagtgcgagactctgtctccaaaaaaaaaaaaaaaaaaaccagagaattatctagttacaacagggaagacagataaagggcatacaaatagcataaacttcctgctcccttttggctctcattctagaggcaaatattagaacattcacctgcatatcttaggatttggttttgtattctacttaggtcatctttcatgtttgcgagaattcatatagaaagcttctgaacccaaaacacaatggctgctgttgaaaggtcaactgcgtatgactgccaattagatggcaagttgtatttaaaatccagatccctaattaataacgattttgccttactcaagaactgtacgcagagcatgaatcatctatatgcagagtattcactgtttagttgttgccaatttaaatattcatgtctctaggaatggcttcaatccaccctggtgcataaaataaattagcattcttgcactctagagagaagtatgtgtttagcaccaaatggaatcagcagatgactaaatactctttttttcctctcttgtttctatcataaatacaacagatgcaagatgctggaatgtggacaaccccagaaggttggtgtttgcctctaatgcagaaataaaccattcaaaaattcattccatatagcataccagagttagcaagagcccttgggttcctttattgccatcaagttgactttatgactaaacatatcacagcgacccccatagtacaaatgaagcataaggctacctttgctactaaacatcacggaatatcttataaatttacagcaatgataactgattcagagttactacagttcaacagtaaattttgagcattacccaaattcatgggacacttaaaggtatgagacatggatctttaaatgataagttactggagtacaactgttcctatattaaatagggaaaaattcctttctaggaagactcagctctcttcaatcacacctcttttacaagcagaatgcgcaaggaaaatggcaggacctcaacagttgtctaattgtccggcttatgttcctcaaggttctctagcttttgctatctcaatgtgagtggtactttcattctcatttttattcactatttgatgtgtaaggaatgcatactcagagacagtcaatttcagtaaaaaatacataaataaatcttcaaccacagctaaaatcataattaatagtgaaaaactgaatgccttcctccttaaaataaaaaactaaacaaggatgtcccctttcactagttctatccaacattgcactagttctagtcaaataatttaagaaagccaaagaaataaaaggcatacagattagaaaaggagaaataaaactacctctctttgcagatgccataatcttatgtgttaaaaatcctaaggagtacactccccgctgaaaacagtagagctaataaataagattgatacagttcgcaaaaggcaagatcaataggcaaaaatcagttgtacttatagacacttgctgtgaaaaatctcaaactgaaattaagaaaacaattccacttaaaatagcatcaaaacataaaaaacttagtaaaaaaatttaacaagagaaatacaagatgagtatattgaaaactacaaaacatcattgaaatgaattaggcaagacataaataaatttaaagacgttccatgtcatggattagaaaacagtatttttatgatgacattattccccaatttgaactataaatttaatgtaatttctatcaaaattccaactgtgtttttgcagatcctaaatgcaaaaatgaattttgtaatcctaaaattcatatgaaaatgtaagggactcagaatagccaaaattatcttgaaacaaagagcaatgttggaagaattcccctcatttgatcattacacattatatgcttgtatcaaaataccacctgaaccccaaaaatatgtacaactattatacaaacatatcaattaaacattaataattcttttaaaaagaattcccagtttcaaaacctactacaaaactataagacagtgtgttacaatcataaagacagacatatagatcaatgtaatagacatcagagtccaaaattaaatatttctatttattgtcaattgattttcaacaagggtatcatgacaattcaatacagaaaggatactcttttcaggcctcgtgcagtggctcacgcctgtaatcccaacactttgggaagctcacggcaggtggatcacttgagtccaggagttcaaaaccagcctgggcaacatggcaaaaccgtatcttaattaaaaatacaaagattagctgggtgtggtggcacgtgcctgtagtcctaactacttggggatgaaggtgggtgtggtatgcggcaggaggaccacctaagcttctgggtgttgaaactgcagtgagccctgattgtgtcactgcactccagcataggcaagagtgagaccctgtgtcaaagaaaaaaagaacaatcttttcaacaaatggtgctagggcaactggattcttttttcgtgttttttgtttttgtttttgttttgtttgtttgttttgagacaggatctcgcttagtcactaggctggagtgcaggtggcacaattttggctcactgtagcctggacctcctgggctcaggtgattctcccacctcagccccccaaagagctgggactacaggcatacaccaccacacttggctggtttttgcttttgtttttattttggtagagagacggggtttcaccatgcttcctaggctggtcgcaaactcctgggctcaagcgatctgccagcctcagcctcctgaaagtgctggaattacaggcatgagccaccacacctgagcaacaattggatatatacatgcaaaagaaaaaagctggactcctacctcacaccatacagaaaattaacaaaatggatcacagaccatttatgcctgtctcaacctatttatgcctagtgttccattattggaatgctaaggatgtgggagttatttatatcctactgctcaaggtcattgccaaggtctgattgcaaaaattcaaaaaattgcaacctcaggcataaatgggttttaatataagagctaaaactataaaacacttagaagaaaacataggagtaaatctttgtgattttggtttagatggcaatttattagatatgacaacaaaagcacaaacagcaaaagaaaagatagataaatcacatttcatgaaaactaaaaaattttgcttatcaaagagtactataaagtaaaaagacaatatacagaataatagaaaatttttgcaaattatatatatgatgtgtcatatatctggaatatataaagagctataaaaactcaataataaaacaattactcattaaaaaatgggcaaagagtctgcatagacattactccaaagacaatacagtcatcccacagtaccacagggtgttggttccaggaccctcatggaaaccaaaatctatgatcttcaagttcttaacataaaatggcataatatttacatacatcacatcctatcatacgctttaaatcatctctagattatagtaaatcctcatttaacatttttgattggttcttgggaactgtgactttaagcaaaacaatgtaacaaaatcaatttactataggctaattgatataaacaagggttaactttctaccgtatgtattaccgagcttgtaaataaagaccaaaacatttctaatattaaacattgaaataaatgtgagccacacatacatttaagaaagactaaggtaagtatttacccaattattatcattaaaggtggcaggtgacagagcctatcatggcagctccaggtgcaaggcaggaaccaaccctggacaggataccattccattgtacacagggctcagtcacacacatacccacactcattcatactgtgacaatttagattcaccagtttacctaacatgcacatctttaggatgtgggagaaaactggagacccagaaaaaacccacacagacatgggtagaacacgcatacttcacacagttagtggtcccagctaggtaccaacattggatgaaacaacattattggaggacctgctgtacttacaatacttaatacagtgtaaatgccatgtaaatagttgttatactgtatttttaatttgtattatctctattgttgcatttttattttttattcagattcagttgacccttgaacagcatgggtttgagctgcacaggtccacttacacagatttttttcaaccaaacatggatccaaaagacaggatttgtgggatatgaaatctaagtatacagagggccaacttttttttttttgagatggagtctcactctgtcacccaggctggagggcagtggcacggtctcagctcactgccacctccacctcccaggttcacgtcattctcctgcctcagcctcctgagtagctgggactacaggtgcctgccaccacgtctggctaattttttgtatttttagtagaaatggggtttcactgtgttagccaggatggtctcaatctcttgacctcatgatctgctcacctcggcctcccaaagtgctgggattacaggcatgagccaccgcgcccggccacagagggccaactttttatacacatgggttccgcagggcagatttcaagactcgagtacctgggtatacctgagggtcctggaactcatccctcatgtatacagagggatgcctgtatatttcagccactgttggttgaatctgtgaatgtggaaccagcgcatatggagggccatctctatacaaatagatcacatatgcatgaaagatattcaacatagtagccatcagagaaatgcaaataaaaccacagtgagttatcacttcacgcccactaagatggctatgataaaaatgcccataatcaataacacttgttggcaaggatgtggaggaaataaaactttcactcatttctaggctgactgtaaaatggtacagccactttggaaaatagcctggcagttcctcaaaatgttagtcatacatagaattatcataccacccagtaattcctctcttcagtatgaaatcaagagaaatgaaaacatatgtccacataaaaacttgtacatgaatgtttatggcagcattcttcataataaccaaaaagtagaaacaacctcaatgtccatcaactgatgaacaggtaagcaaaatagagtatatccacaaaacaaaatattatttgtcaatgaaaggggatatagtactgatacatgcaacaacgtggatgaatcttgaaaacattatgctaagtaaaagaagccaatcacaaaaggccacatggtatgagttagtttctatgaaatgtctctagaataggcaaatctatagagacaaaaagcagattagtggttatctgggggttgggggcaggagtgactgctaatgggtacagggttgcttttggaggtaaggaaaatgctctaaaattaggttatatattgattgtcatacatctctgtaactatactaaaaactattgaattgtataatttaaatagggaatgttatgatatgtgaattatgccttaatagagtggttagaaataaagacaaagacatacccatacatatgtcatcagaaagaggagtgaagaggcagcctgtcctaatagtaaaactcagacttgaaggatgctaatactttggcagctcagaaccaatgaggaagaagaggaagtcaagatcaagggacgggggttggaaaactgctggtttaaagcacttaaagaggccaggtcacgtttgtcaacagaaaataatctcaatataaattacagatagagccccttctagaatttgccatcgtatggtcaggtcacaacagtaaggaattcaagatttgaggaagagagggaggggcagtattaacgtaaacacagagagacatggtatccagcatcaggaaactattttccacaagatcatcactagtggcctcagatgtttagaaagagaatcaagacctgaggaggtggtggctcacacctgtaatcccagcactttgggaggccaaggcaggtgaatcacttgaggtcaggtgtttgagaccagcctggccaacacggtgaaactctgtctctaccaagaaacacaaaaattaaccgggcatggtggtgtgtgcccgaagtcccagctacttgggaggctgaggtgggagaatcgtttgaacccaggaggtggaggttgcagtgagcagagattgtgccactgccctctaacttgggcaacagagcaacagagtgaaacactgtctcaaaaaaaaaaaaaaaaaagacctaaggactaaggagtaaggtagctattacgtggagaattagaagctcatctactgtctgaggttgaaggaggcagtacagtcatcccccttatctgcaaaagatatgctccaagaccctcagtggatgcctaaaaccctggataataacaaaccctatatgtactgttttttcctatacatacatacctatgataaattttaatttataaattaggcacagtagaaatcagcaacaataactaataacaaaatagaacaagtataacaatgcactgtaataaaacttatgtgaatgtgttctctaactctttctgtctcaaaataccttatcatactgtactcacccttcttcttgtaatgatttgagtttatacgatgcccacaggatgacatgaagtgaggtgaattacataggcattgtgacataccgttaggctactattgccgtgtattcctgaatcatgtgtaaccatcccttacttgaaataaatggcttggtgtcacttgtttcaggagactccttgctgaaattctcaaataaactcaatgttttctggtgcaacatgctgtcaatcagaacacattttctgtttatgtctttcaccaacaaatttaatgcattttccatctaattaatcacttattatgcactgtatctgtaaagtttgcagtttgaggtatgacaaccaaactagaatttctttctccttcttcacaatttaatggatagaagattcattcttaccatagagcaacctcagcatacaattatttttttccttactaattcaagaaatttcaattttgcacttaaaggaataactttatgggttctctttggcatatcccaaccaccagcatcactactcttgtgctttggggccatgttaagcaaaataaggattacttacacacaaatgctgcaatactgtgatagtcaacctgataaccgagagggctactaagtgactaacgggcaagtagtatacagcatagatgtgctagaggaaaagatcattcacatctcagcaggactgagcaagagagcacaagatttcaaaatgttatgcagaacaatgtttaattcaaaactcacaaattatttatttctagatttttcatttaatattttcagatcacagttgactgtgggtaactgaaacctcagataaagggaaattactatatttttagaccatgcaagtagaaagatacaaggaaaatgtggagagttaaatagggctacaaggggttaatctatagttcaaagactaggatgtgggagatgagcgagatgatttaaatgttctctctctctctttccctctcctacacttaagtcaagtcctgggaatggcataagtatataatggaggccatcaggggattcaactgttgggagtagagaatgcagagtcaggaggtaaccggcaatgccaataccatgggagattgtagctgttccctgcagtttcctccaatgcagcaacaccaaaggaaatcataaatgaaaaacgatggtgatgatgaaccatgactggcagaacaaagcacaataccaaggccaaattctgggttttatgggcccaggaggcccagaaggtaatgcaatatgagggccactcaaatacccatagttccttcctgactggctattcagactcaggatccagtataccaggaatgaactacgaaaaatatgtactgtgtgtccactatataaacggcagtattctaggtgctttcccttccttctatgattcatgcatagagagagagattatttaaactgcaatacagttttcctttcttaccaatttattttcaactatatgctctaaatatttacaagttcctctgttgtccttttcaggatttaccatcttgctacctttcatatggaaaatactggcagaaaaaagaagacattcaaagttgggctcataaaagaaatgccccaaagtggcccccgagactcactttagttcaaactatgcagtgacttataaattaattagaaacatgaacaaattgcagctaagaaaagccccctaaaaaaagaaaagaggaagaagtaagagagagggataaataaaaactaacatgtatcaagtgtctgctatatagatggtaaggttcaaggtattttcccttccctgtgaagtgggaatcattatcaccattcttattgacaataacagaaacacagaaggatcataactcatccaaggtaataggattgctactacagatggcactggaacctaggtctttctgatctaaatctatactctgagcccaatgtaatgctacttctattaacaggtctctcaagctcactattctaatatcatcatgtacaacaaaataacattttagtcaacgacaaaccacatatacaatggtggtcctgtaagatcgtaatgtcgtatatttttaccttttctatgtttagatatgcttaagtaaataaacaccattgtgttacaatcccctgtagtatttagtaagtaacatgctgtacaggtttgtagcctagtagcaacaggctgtatcatgtaacgtaggtgggtagtaggctataccttctaggtttgtataagtacactctatgctgttttacaatgaaatcgcctaatgatgcatttctcacaagtatctacattggtaaatgatgcatgactgtttatcaaatgaaaggcctaaattttgaagtgtcactctaaaatttttgtgtgattgtttctatgctataaaaccacaataatttctggccgggcatggtggctcacgactgtaatcccagcactttgggaggctgaggcaggtggatcacctgagatcaggagttcaagaccagcctgaccaacagggagaaaccatgtctctactaaaaatacaaaattagccaggcatggcggtgtgcacctgtaatcccagctactcagggggctgaggcaggagaatcacttgaaccagggaggcagaggttgcagtgagctgagataatgccattgcactccagcctgggcaacaagagcaaaactccatctcaaaaataaataaataaataaataaattaattaattaatttaaaaaactacaataatttctaaaatctattacaactccaaaattctctaattgtatcttagtcaaataatatgcagaaggaaaattacacaacttaagattccaacaatcctgagacctatgtttcttctatgtattacataagcacagacgctaattggctctgtgtatagtgcttattactggtgcttactgctatacccgctttatagctattaaatactttaatccttctaataaccctatgaagcaaattattgtcttcattttataaagaaactgacatgcaaacatattaactgttcaagttaaaacactgataagcagtgaaggtgagatttaatccaaagtattttagctccagagcccatgtgtgtaactgctaggctgtcggactttccagtaagaactgaaaaccttctcctagaggttcacagtgttttagttttgtatacattttctcatttgatcccattatattgtgctcattacataaattaataatctaagaaaacaatggcttatttaatgtcattcagctatcaaccagcagaaaacactcttctaattcttgcaatacaccatgagatttttttcttagtgaattcttaccactgaaaaccagcaccaccagagaaataatcacttaaatataatagatatagagtatatataacagataaaagagacaataagaacagcagcaaaaaaaaaaggatttctctcctttaaaattcttagacccttaaattatattattttctctatcaccaaactggactagattacactaagacctttgaagcttagagatttaagacaattagctaaaccattaggaaaatattatttgccacacctttctcttgccttgctctttctttaatttggcataaatgcattttttctaactgcattgattgttcaccaaactaggaagcttgctcttgatgctagtgaagcaatgtcttattatcttgattgtataccaagattatgcttcagtctgaattgtttacttaataatttcactgccttaccgaatgccttcttttgatctgtcttgatgtccaaaaatattagggcattaaatttattttcattattaaaagaacaatatagactataaaaaccacatcgcttcagctcctttttgcataatatgatgggacacatgaatttgatcattaccagatggtttatctgaaagattacccaataaaaatgactgctttttccctaaagtctctttatccttacattcgattaaatgacataagatgggatgatctagattttcttagagtgaattatctgggaatttaacattgctttgaaaagtctctgagtgatgttagacatttatttcccaccaggaaggataaacagaacacaacataaaatattcaccctaagctttaattaaaatcatttaagatcaaaaagggaggtagcacagcaatacagggaggaaaactgcaaaaacttcagtatcatggacattaaaaatacccagtggtactttttttagtgaaatttttagaacaaaatcaatttaaatagttaagaaaaagtttagttaaataaaaaaaattaaaattgcaaaatgcaaactctgtttatgaatgtcttcctttaaataaaaaaatgcatctttgctaagattttatgcttatagaaacacttgcttactcataattcaaacatttcacgagtttccagctataaacatgtttataattttagaattctgatagcagataatcattttataactataaaacaatatcaaacaatagttatctaaatagtttcttgaatcatcatgtgatgtttacacagctgggcatttaagaccaatgtgtgagagataattgcatagctataattccgagcctgttgttttaagaacaagcaggctcttggggagataaagacagggtttgtgattttctaactcaaaaagtaatctggagaataaagtatgtaaagactcctagagtgcaatgctgaaagcacaaatttcagtttaaactaggaaaggcaaaagctaatgttttcattgccacattaattttctcacattatacctgagcagtgttcttgtttctaattatattcctacatgaatgccttattacatataatgtgggaaatattacagtgtgatatcttgtgtttcttggcttgtgcttcttttatatttataactttaatgttctacttagtgagattttgtatataataattatgctccagtacactgactctgctccacaaaacgcaagtacaaagttctcttaaacagcgggtggactagtgtttcgtgcatgtttttttggtcttgttttgtcttgcgtcatttttgttttggtttttttgacaagttggataagaaaaaccaaattttttctttaattaaaaacaataatggaaaataatattacagataatataaaatagaataaagaattgaggttttgtgtaaatttttgtgaatatatctgaaaggttttctgaaaaacatgaagtgttcaggtgtgacttccagaagctgaaaagcaatagctgtttagactctccttacatcatcacaaagtttaacaaaactgacttcttgcccaagagttcatgaaatcatttatactcccaacatttattaagggcctaatgtgtgtgtcagacaatctgccagtcacctgggtttcagattaacaaggataagtcctttccttgttccttctacatatgcaatccctcttcaaaaatctgcatttccttgctcatttcaacaatggttatcctttgtttgtttgtttgtttgtttgagatggagtctcactctgttgcccaggctggagagcagtggcttgattttggttcattgcaacctccgcctcccaggttccagcaattctcctgcctcagcctcccgagtagctgggactacaggtgcacaccaccacacctggctaatttttgtaattttagtagagatggagtttcaccatattggtcaggctggtcttgaattcctgacctcaggtaatccactcgccatgacctcccaaagtgctgcgattacaggtgtgagccacagtgcccggccacaatgatttttcttaaaagtacttgtcataatacccaaattttcttaaagtaacaatttatagttttccaaaagcgaacacctagagaactttcatggcactttgtttagccgacaactttgaaaattttattttattgtagtaagaacacaaaataagatctatctttcaactgtgattttttttacccttaagtgatgtctgctttattctatccctttccatgaaaactgaagccccaaaggttgaatgaatcttaaaaattagtcactttctcagtgtaaaaacattcattgtatcaatatgtaatttaaatatgctatttttcaagccaagtattgtttcagaattaaaggtgttcaaatattccctcaagaatatgtttgtccttcgtaccagagggcattggttctaggatccccactgataccagaattctcagatgctcaagtctcttatataaaatagcatagtatttgtagcaaacctacacacctcctctcatatcctttaaatcatctctagattacacataatacctaatataatgtaactactatgtaaataattgttgtactatattttttctttttattatttttattgttgcgttgtgctctttttccccacatattttcaacccacagttgattgaatctgcagataggaaaccagtggattcagagggacaactatattctccaaaacataatcttaaatgctcacattttagcttttaactacttactactacaacacaagttcccagtctgcagaacctaaacccattctgcggagtgaaacccaagataatcactctttaagtgtatctcttagttgtctctccatatttttatagattggagacatatctttacaacatcttttttatcagccttaaagctctgaacataaatctaaaacatcaaatctcaacactgaccctgaagttatataatgcaaaaacaaacaataaaaaaaaaagcatttagcattaaaagagctgaatacaatcttggctcacctactccccagtaagttaacaagacctgagctaatcatttacgcagaagcttggatcactttacagagtgaataatacttatcacaaggagagtttggaaagatgataataagataatatgcatgtgagagcacttacactgtaaaatatacgtccctgaggttgctgcctgctgcctacttcatgactatttttgcgccactttatgttcccgcttccttgcttctaactcccatgaccctctatgtttttgcctaattggcaaacatattctcagtttctcagctgcaggataccaggtgaccttgctctctgattctgcctcttttctactattagtcaaatgaagtagcttcataagtagcacaggcagtttcctgtaaagtgtaattgggatagtgttggaagggcccctttcccaaacacacctcctctactgttctgcctagggcatgtagtttcatcatcaaaatataattatcataccatatatactatatgttagtataatccattaccttggattaaagcacaatttcttcagcagtcctttactagatgccagtaccctaaagaataaactaatcaagtaacatgtatttgctcagcttattttatatacattagcgctgcgctaaataacaaatgaacccaataacggcatcgtttcctaaataagagccatcatctggagggagtgggaccacagaggttaggtgtttctcattcagcatgataatggagaaggaaagagtgggcaagaacctagcttctgaggaacagaaactcagaagatgctacactcggaagaggacccaaagtagccacagtgcagaatggaagtcttatgtatgaaaaggattcaaaacactatgacatttgctgttcctttataattagccttctctttgtaagtagtcctaatgaagaaatttggcaacaaatataaaatagtttctccacaaaataattttagggactcccttaaacacagaaaaaaatgtagtagctgttatttaagtgcccaggaagtctcctcactccaaaatatctctcacattcaacacctagaaattcattcttctatagatccaaaccattaggcaagaagtgtcctaccaataatgccgtccttgaaatgcaagcattgcaggtataaataacattgaatcataacatgctacgtgactttcactgttttgttttgtttttttgttttttttttgtttttttgaggtggagtttcactcttgttgcccagcctggagtgcagtggctcaatctcggctcactgcaacctctgcctcctgggttcaagcgattctctcgcctcagcctcctgagtagctgggattacaggcatgtgccaccacacccggctaatttttttatttttagtagagatggggtttctccatgttggtcaggctggcctcgaactcctgacctcaggtgatccacccaccttggcctcccaaagtgctaggattacaggcgtgagccaccacgcccagcgactttcactgctaaatccatttctttgacaaaagaaagtgaagttatcaagtgctctgatagaaagcctcagtggtcattcatgtggtcagcctgtctataagtcatcttggggactggtttttaataagcagagggtttcctgtgctccaaaatttgcttagggctgaccctgacaactctatttatttatttatgcatacaaacacagtttaaattagcaaacagatgagttaaaataatgagattaccaaatgaacacaaaaggtatcctgaatcttcccaaacccaattcaaagccaagccttaaaatcaagagggacagaagtgctcagcaaaccacctgcaatttaactgagttcaaggagttaaaaggtcttaaaattaaccatgaaatgtgaaaaatatatgaatggtcttcaaaaacaacatttgggaaactttatgtcagaaataccaacactgtggttgccaagagtgaggcattttgcgatgactaacaaattaaggcatcttaatgtgaaaactgattatataatgcataatcaagcagagtaaggaggaaacagaggtatgctttctcattaattctggcttagaactacattgcgtaacatcaccagatttatgaatatagagcaactttaaaaatccacggatgttccctgaatcaaatcatttttatagctcaaagaggctgtcatttcaaatacacacatttattcaaaatatttttattgtctctatttactataaaatctcaaaactatagtagtcaggatggtcagcaaggggtaattggtccagaaaaacaattcagaaaagagaaatcagagaaaaatggctcattttcagtgatgctgcctctagttcatgttggggatttttttctttatgtatgtagctacacagggttctgctatacaaataagttggatatgttttttaaaatcaactaatactaacacaaatgtagcactgactatgtgttgagaactgttctatgtatactatctcatttaaatataatactcaatacactttaatgatgcatggtataatattgtacaataatattaaatataaattgctcaatctcattcaatatttcaatgatctgatactttttagactaaaaataaatgggaaaagagaaagagagaagagaaaaggcataattattattataagccacaagttttcacgtataataggatgaatactatattggcattcaagtaatttagttcccacaataaataataagatacatcatccaacctattatctgctatatcataaaaataattttatatgcaggatcaaaaggggtgattttcttgacttttctgtgactattttcaaaagtcatgaagcagaacatccacgcaagaggataaactggctctgcagctgacccctggaggtactaatgcagagtttgaaaggggaggaaagcttattactagtgaccatgagattccccaacttatattagtcagaaatagcaccccaggatggaatactaaatcataagggtatcctacaaaggcagtctagaatgtgagaggtctaggatctgtggatgtcagagaagtctgtattttcacaaatcataaaaaccgaaaccgctttaaacagtttttttaaaaaacagctcatactccctctgtgatttcacaaaaggctgtccgtggatctttggcggggaaaaatccctgctagagacaaaaaggggaacaaattaaacaacaatataaaacccaaattgatttaaaacttgtcaggaaaaaaattatttcacaaaagcaaagaaataatgttaaaaatgagaatgcaaaataacacaaaggggaagtgaaaaatagcaccgctaatcagcaaaggcaagagttccaataaattacggctcattctgaaatgacagactccagggtgttttcaatcagtcttcagtgagaaaatatttaaaaaggaagaactgtataagttcaagtaattaacatcttacttgtataggaactagttagtagggagaaggggataaaacttgatgccataacacagcacttggagaaaactaagtctctacaggttagcaggtccagatggcaagaaacccaaggtaatataacaagcagtggtggagtatttattcaaactagtcaatcatcactgcaaggccctggtacctttcttttacaaatgagttcttgtttcagccatcaacttcatcatccccagaagcccaaaacaacactccagtttataacctgattgaattgcagtgatttcagacctagtactattgtgatctgggatctttttattacggcatcataaacatcactttcaacaactttcctgtatgtctttgccccgttctgagagatataagtcagaggtggagaaaaggctacaaatgcgttgatttgtggcatgaagaattgtgcagaatcttttcctttgatatgacagtccaaggggtatattaacaagggcagatggttgccatcatttgttacaagcacctattcattataaaaaaggaaaaacaactcatccctcaagaaaggatttaaagtgataccagaagacctcgatcttccactctccagcctccctgcttcatcttggtaaggatgttgttcctaacccttccttctatgccagggaaaggatatgcaaactaaaaaagaagaagtaccagatgtgaaattctataaaatgccaactgattcacaccctacactctgaggatttacacacacttccacttctggcaggaccaagggtaatgagaattctgctgtcgctggtgaagaagtagcaaatcacagccaaaaaggacacctacccctgggaacgagaacttcaattccaataaatgaggcaatgctgatgagataaaatttacatttaagtcacaaagctactggaactgaattgtaataaaaaaaagtgtcagacaataaagcagtttgataacgtcagcttttttactgttgtgtgtgtatctgaaagaaagtttctttaaaaaaaaaagggtaacatttgaactagcattgaagttatattattttacaatattttatattaaggaaatatcaaaaatgaataatatactatagtttattaaggacacatgatgggttagggacttgacatgttttatctcatttagtatacttgatccagatagacccatttttaagcagcagcagctcagaaagggtgagtaactagtccaaagccctggcggtaggaaggaccagaagtgggattcaaactaaagcctgccagactcctaagtcattgttgtttgtgcctcagattccctttgcaaaattcactattaaattttttcaaagttataataataactattaagggcttactatgttccaggtatactgtctcactatatctccaaacagctatatgaggtactatttcacctatttacagttaggaaactaagactcaaaggaggtaagtaacatgcccagttagaaagtaggataaacatgattcacattcaaatcactgcctccaaagcctcagcacatttccaaaattcataagagctacaaaattggaacagacattaaatgcctggtctttggggaattcctctattctgcaaattttagatttagattcccacctgtctagcttcatcttttatgtgtttgttttctcctctcttcttctcattatagataccataacttcctagattcatgaaatgttagagatagaggttcaccctccgaaaaattgacctactgaggactaaaagtaacttaataacaaagtacaatatacatcccaaattgctcaacagttggataaactttccactgcatgatgccgtaattcaccatttccaaaataagtaaatatgaaggcatcgagaaaagactatgaaaaatccaattctagtgttttgaaggtaacaattagatataatgacttcgtatcaagggtaaatttttgaaatcagtcactactttaataggattttcttatgctataaaaacatcaaaatatgcaacctagctttgaaagctctctaagttgtgttcccaacctggcaaaccctgtacaccagctcatctgttctacttgccatacctagtataagtccttgtctgtcctatttctggaactgtgacaactttctccacatttccatcttttaaaataatcaaactcaaccattcatccttatagcttctatcacaaagtcccagccatgatcagttgaaggctcatattccgttactttgaaattctatcaacagatttatgatgacttgattatactttttttatatcttctctttccccaagacttccctaaaatggtgaaagagcaatagacacatacaaaacaaataaaaggcctaactgaatgagattttcagcatatttgcaaggagggtgctaacaaaagatggataacttacttagcagggaggggaagctataactttaaaaggggaataaagataagagagttgattcacttcacagaacccttaaggaggtttggggtttaaagtctgtttctatggggtacaaaatgcccacacacacctccctcctactccctgcactagatacaagcaccaagagaataccgcattttccatgggataaatttaactggagtagctcaacactcagagacatcaggtactgtgaagagcaaggaaaaaaagtggattaattaaacatccatgtgttgagttaagagatgcctcctcctcagcctctatctcttcatgtgcaaaaacctggaaaccaggcatcttccacacacataaggaatcaaagattacttccttggaaaaactgacctgccgcagagaaaaatatctttattctcagcttgaggttctccagcaaagtgctaggtcctaacaccccggagattccaaaatgaaacagatcaatcgacaaggcctagaaacagatctgcaaatcagccttttaatgcttcattcaaacctagactgacacccaagaaacaccaaacatttcatgaaagatttcaataaaaagagagaccaaaataaacagagaaaaaaattaaaactggaagaagctgatatacgctagaaagagaaaaaagtcatcaaaaaattttatcagtatcctcagaaaggtaaatgattaagattacaatcttaaaataaggacaggatactacagaaaatgaaaaagcaaaagacaagaaagaacactaaacaattcaacttacacttcatcttatgcatgcagtgaactgtatttttgttcaaaaaaaatatatatgttctacccctctcagaggggaggctatcctcccctgtcccctccatggctggctatttgctattgatttcctttgggcaatgaaatgtgtttgaatgtgatgtttcaccgaaaccttagagcgagcatgcggttggcatttttccccctctggcacaagactggcaatattctagatagcagttagaatattgatataatctagaatatgatataatctagactattgatatcatctaatattgaatattagattccagcattttgaatcctcaaaggaagatgatgtggacacatctgtagctgacccacagtgagtaactatcatgataaggaattaactttgtggagatgagtaactcagaaatgaggagttgcttttcaaagggtacaaagtttcagctagataggaagaatacactttaagatctatgtcacagcagggtgactacagtcaaaaacaacatattgcatagttcaaaataactaagagagtaaacttcaaatgtatcaccacaagaaaaaagttaaatagtgaggtaatggatatgttaattaatttgatttaatcattccacactgtatacatacatccaaaacatcaaattctatgctataaatgtaatacaattatgatttatcaattaaaaataatattaactttaatagaattaaacttttgttgttgaaagcttttgaaattctgggcatgcttttttacttcagataatctggtctatcctgacaattacaataggtttgatcacattgacagggctttggattttattttaaaagactgacccaaattagtaggcacatagaaaacgaagaaattaaaacacaaacaattcttaactctggataaaacgaaaagaaatataagaacaaactgtagccattttacactatgtgattcagagtaaaaaatatttacatagtaataatagcataatcacttcatactggctgaaataaaaacacgaaattactgaaaggataggaagaagttctgtgtgtgtgtgtgcatgtaaaagcgatatgaaaattaaattataatcttctttttttgtttttgagatggagtctcgctctgttgcccaggctggagtgcagtggcacgatcttggctcactgcaagctctgcctcccaggttcatgccatcctcctgcctcagcctcccaagtagctgagactacaggtgcctgccaccatgcctggctaatttttttgtattttttagtagagatggggtttcaccgtgttagccaggattgtctcgatcttctgacctcgtgatccacccacctcggcctcccaaaaattataatcttcttcaaaaggaaatctataaagatctaaccttgaaacatcaagaaaaacagtatactgtgtgatatttagaaatatgaatataaatactagaagaaacaattaaaagatttaaaatagttgcctctgaggcatgagaactgggagacaggctggaacatgggacagctattttttattatagcattatttgatttattatatgtactattttggtaaaagtgaaaattaaatgaaaacagtagtttactcttatcttttacaaatactgagttaaatatcagaagaaagagccaagaatttaaaaatagttgtctctggaaaataattgggaagtgaagaggggttaagcacataataatttgataaaatttaaaaaattaaaattttctaagagaaaatgagtaatctgaaataactgaaatttgtgaataagtggaatttggttttggcatagtgggtcaaatcatcagaaaacaaactcatatgagaaataaactactcaatactggtttatctcctggtagaatcaatcatttaacagtggccaagcatggtggctcatgcttgtaaagtcagtattttgggaggcgaaggcaggaggattgattgacgccaggagtttgataccagactaggtaacatagaaagactcccatctctacaaaaataaattaaattaaattaaattaaattaaattaaattaaattaaattaaataaataaataaaaaatcagccgttagcggcggctcatgcctgtagtgccagctacttggccactaaggcaggaggattgcatgagcccaggagttcaaggctgcagggagctatgatcacaccacttcactgggcaacaaagggagacccagcctctgaacaaacaaacaaaaaagctttgggtccctctacggccttttttgtttttcaaaatgagactttttaataaggtcacattgggtgctttaagaacttcaattattataaagcgtaaattacttttaatatgcagttccatacttagactgcacaatgcacatctcagaggcattctcaacaaccattaaacattttgaattcaattttcagttaaaccagtattttattaacaacagattccagttaaatacaacaaatattaaacagctattgtatatgcaaatgacattgccctaggctttgttggggataaaagttaaaatatctcaatctttaattgagtttataatcttccaaggaatataagccatgcaataataactactaaaaataaaaaaaatgtccaaaagagatggttaaaggaaaatccttatcattcagagaaccgtggtcattggaaataggatttgaacatctgaatccagacagagaattatctaagagtaaaatagtatcataaagcatgagagaaggacagtatggcacatgtgagtgcagaaaatcattcattttggctggaacataaggtggattcaggggagtagtaaaaaataaataaagtaaatagtctgggagaagatcatggggctccttgagagtcaagttaacctttttataattcatataacagaaaggttggagtcattaaagattttttatgaacaagtggcttatctagatttattgtttaaaaaattagtccagaaatgtatatgagaaggattaaaagggaaaggatgaaagctatgttttattttatattaatagataataatgagaaaatcttattctctgaataaatagctagacatacattttgaggattattattctcaagcactgtgtacatttcaaatgtgcttcaatattttgtgaacattcaatattttgtgaaggtgttttagagaagtcataagcaagcaacacatgcattgagctctgtaaactctgtttatgttattaatcagaatagctcctgtccatctaaaggaggaatagatgtctttaagaagaaatgaaaaaataaagtaaatgtgaaaatttcccttacttatttccaaacaagtgctcctccaaaaaaatgcaaataattaagtttctgaaatggtgaacatatcagattagtagacatatggcaggagcagcaaatgagcagatcaagttgaagtcctagtattaccaatctgttaatgttgacaggaagactcattttgactgttccttttatatcaataaatgagtggatttcaactactctaaataggaatgctaaaagcagcactgctaaaagtgcatatcaaaccaataattttctgatgctgttttggtatatcctacaaacatttgtaggacaacaactcagaagggaaaaaaatatcttatgcctttgaggtctgtactgaatgctaatgcatttgtatatgatgggtttaatacagaactgagaataaattactttcagcagctgcactctagacctataaatcgctctgagtactacaaaatccatacaaaggaagaacagctggataatttacaccaccagtatttgtcaaaaaaaaaaaaaaaagctgaaaatacagaacctgatttgtccctttttcgagtatacacgtctacaaaaattaaacattatctttctagagaatctattaggataggcacatctattcgcatcttgacatgttgctcttttaaaataaacataattcctcttattttaaaagcactttttaaaaggataaaagcagcaaagaaaaaaacttttccttataaccaaacgcaagcacaaagaaaagtctgttaatgtttattttgtgttccaattgctatgctctggtaaaattctacaaaaggaaacacgttaaccagatgacttgcagagcacagtgataccaaaaatagtacttaagttaatacactaattgcaaagttgcagagattaagttcaccattctagttcttggataaacttttggagagggagtatttaaagtttaatataagggctgtcttaagcttcctaaagaataatacaagcagtaaaaatgtgctccgtataagtgaactccagaaatagaaagctgcagtcactaaaggaatattagcttttgtgtaagcaacaaaattacccttttgcaacttctattaaagtcaatacaagagagtggctaatggctaattttgctcacaaatctaccattgttttgagtttttatatgtgacgctaattcgtaaagaagccatactaccttgataataacaacaaagaaaaattcttaagtccccacatggtaattactgtgatctatatgtagaaatttgacaatatgtcaaaatttgaacctattttcaaatgaacctatatcagtttcagaaatctaagcgttcctaaaacaatgattaacaaaaaccaattggtgttactctccaaatcatgcaatctagtggactgtaattccaatattataaaaatgctgtgataggaatatgcatgagtgaacaaacaggcggctttatctgcctgccaatttcacatccactggaaacaaaaggaataggtgaggttattcttaattgatgcctgtcaatctttcttttcctacactactaatatggttaggctttgcgttcccacccaaatctcattttgaattgtaatcccaataatcctcatgtgtcaagggagagaccaggtggagtaatcgaatcatgggggtggttcccccatgctgttcttgtgatagtgagttcgttctcaggagatctaatggttttataaggggctcttccccactttcgcagcactcaactctgtcctgccgccctgtgaagaagttgcctgcctcccctttgtgttctgccatgattgtaagtttcctgaggcctctccagcaatgtggaactgtgagtcaattaaacctctttcctttacaaattacccagtcccaggtatttcttcatagcaatgtgagaacggactaatacaactacactcttctaatcactttattttaaaatcagatagcttggagcccaaacaaggcctcctctctgtcaattgtccttaatctgaactcagttttagaacactcacaaccacataggatataaactcatttagcaaaatgccagggaaaaaaataataggcatccagtagtagaagtaagcaaagattgacaaagaatccaagccctaaagtgtccataaggttgaagagtttaaaaatgacacactagtttatgtgaagtaagagtcatgcagataactggaggacttatctacttatctgtatttctctcaagttatgctgcttactagttcacagcataaaccaccaaccagatggcttaattgcacagcagacattcttacattgccttaaactaggaatagagggctactagtaaatatacaaaaataaaacaagtaacattgtttatggcccactaaactgtatacatttatgtgattctcttccctatacctctgtcacaactttgtatcttttctggattctctcttaggagttcatggactgaactgagctaactttaaatgcactactatacttaactattctataattctgaagttgccgtaatttctcaagttaaaataccctgtggttccaaactcaacccaacttatttcaagactggtagcacccaatttttttaaatgtccattaaggctgggcacggttgttcatgcttgtaatcctagcactttgggaggctgaggcagatggatcacttgagcctaggagttcaagaccagcctgggcaatatcgagaaaccttgtctctacaaaaaaatacaaaaattagctgggagtggtggtgcatgcctgtagtcccggttacttgggaggctgagatgggaggatcgcttgaacccaatagttggaggctgtagtcagctatcattgtaccactgcactccagcctgagcgatagggtaagaccctgtctcaaaaaataataataaataaataaaatgcccattaaataaaaatcttaagcaaagttaatactttattaattcattgttgtggaaaccaaaccattttagcagaagagaatacaaaataatgttcaaagaatagggaagaaagttttagttctcataatttgcaatgcactaaagcatcttgataattacttgttaaagttcctggcctcaaataatcttataattttgaggacattttctgattgatctctctattattactccatgtaggtgcatgactatcttttgcatggaggtatttttacaaacctctatatcccacaacacaataccactacttgataaataattatttatcactcatctgtcactcatcaaaatctatcatttccacttattttctttaatcatctcagctcacatgggttccctctctcacataaagtcccatactacttattatttgtagcataatgtagtagttacaattacacagttttcatcctagccatcctgtatcagagttctatcatttattactcatgagactatggagaagtcacataaccatcataactcctattcctcatacctaaaatggaaataattatatctatttcccaaggtttttgtgagaaatgactaaaaccatatatgaaagtgcttacaactcaatagaaagcgggaaaagataaaaataaataaaaatacaactcaataataagacaaacaacccaatttaaaaatgggaaaactatgttaacagacacttacaaagaaagacatataaatggccattaatcacatgagaagatactcaaaattatattcattaggggaatgcaaattaaaccaccattagatgccaatacacatctggcaaaagctgaagttccagcaaccagaactcttatacattagtcagtcagagggtaaaatgataaaactccttcaggaaagagtgtgaccatttcttataaaactgaaaatatgtctatcctatgaccaaataatttcattcttatttatttaagagaaataaaagtatgttccacagaaagccttgtgcatggatgtaaatagcacctttatttataataaccaaaacttagaaatgcccaggtgtcaaaaaatagagaaatgtataaacaattgtggtatattactactttcccataaaaagaaacaaactactggtatatataatgacatagataaatattaaaaatgtcacaacaagtgaaagaagacttacacaaaacagaatgcactgtgtgattccattaatgtaaagtaatgagaacaggcaaaactaatgaagggtggaaaaggtgagaatagtggttgtctagtgtgggaggcactcctggctcacaagagggataaaggaacttgaaactatctgaggtgatgggttacaaggatgtttgtattcatcaaaatgcagaatatgtacgcttaagatttaggcatttaaatgaaagttttgccataaatttactataaaacaaaaacattggaaaataactataaattaaaagcagaaaacaaatcaatctattgataagcataaattagagtaaaataattaaactgaacaaagagattctcacaactgttcttagttcagcttcatgctgtttcaagagaaaactatagaaagattcaaacaaaagaaatggaagaagagttacaaagcagatattaaataaaagaatgttgaataagttaagaataaaggaaatactgtttttataccagaccaaaaaagatgtttaggccaataagagttactagtatacaagggtcattggataaagacaataggaatatttactaggaaataattacaattcttgatttccacgacctcaatagcataatcacaaatatttgaaacaataattgactgaattatgaagacattggcaaatttacaatcgccatgagagattataccacatctcttttggtagttaaaaattaaggagatggcctggcgcagtggctcacacctgtaatcatagcactttaggaggctgaggccagcggattgcttgagcccaggaattcaagaccagcctgggcaatacagcaaaactccatttctacaaaaatacaaaaaaattagctgagcacagtggtgtgtgcctgtgtccccagctactcagaggctgagataagaggattccttgagcccaggaggtcaaagccacagtgagccatgatcatgtcatggcactccaggctgagggacagagatagactctgtctcaataaaataaaaattttactgacaaaatatcagtaagaatcagatttgaacaacatgattattatttaatttaatgaacaaatatagaatcattagatatattcaatagaaaatatattctgattaaagcattcatgagacatttacactattgaccacccactaagccagaaagcaaagcaaatctcaatttgaagaatcaagattatacaacccacattttctgaccatcatgataatacattagaagtcagtaaaaatgttccagagaaataatagtagcaacgcatatggtccttgctaagtggtgggcactcttctgagtattttaaatacgttagcacttttaatccttgtaacaactatataaggtaggtactgctattatcatcccagtttcatagatgagcaaattgaggcagaaagagaataaataaggtgctaaataaccacacgtgcacacataagtggtggagctcagctgtggtccttggcagcatggctttggaggtagaactcttagccaaaataacattaggatcaaagaaaatgtctttatgtaaattagataatagatgagaaactttgatcaaactacaacagctacatattacctggaggaaaataaagagccttaaatatttgtgttagaaattatttttaaaaaatgactgacaatgaatgtgctaagcgtataaaaaaccgaagaaattgaaaaaagaataacagtaaaccctaaaagaaagaagaaaatgataaggataaaatcagaaattaatgaaatggaaaaaatcaagattaataaattcaaaagggtacctctaaattcaaaaaaagtggaaccaaactggaattttcccattggtgtttacattgcttaggaggcatgtatcacattataaactgtcctaagaactatcttctgtaattcacatatattcctgagctctctccttttcaggttaaatcaacacaatttctttagccgtctttactgatcctgctttctagcccttcactaatttccatttattatcttctgattttttccacttcttcttagtcttcttaatttatggatcagaaaactagctcagaaccttaataagaatccgaatggcactgagcatagttggaaaatcacttctgggttttacattataaatatttagaatgatcatataaaatgaactgcaatatgtttcaggaaactttaaaaatgttcagataatactaacggggcttcataagaatatcaccaaaatacagacttaccaagactggccattcattgtcactagttgcaaattaaatctgcaaacatcatcctcaaaattttacaattaattttaatggattatggaagaatttaggacagcctatccattataacaaattcctgaaacaatgtttttgtctgattggagagtataaaaattaccttgttgagtttgcctgtttacttttcaaaccaggtattgaaaattgaaatatagtcaccagtcagaagttgttgcagtaggcttcaaataagtttaatatacttattgctgcctttctaaaattctatgcaaagaaagcaatcagatactgaaataagtatttatgggcaaagattctcagtgcagtattgttggtattattaaaattcagaaacaaaccatccaaaagtacagctattgttaaataaattatagtatatccacacaagacaatattatgcatccattgtatttgtattttttaattaattctatggggcaatgtgtgatatataaaatacaaagagaaagtaaactatataaaattatatatggttgatacatttgccgatgaaatgacataatgattgccatttgcttcaaaataatatgtgaggggaatgaagtgggtgtgacagagatgaaacaagatggatcgtgaattgataattactgaagttgggtgttagggacacaaaggttcattacattattttttctacttttgataatgttacaaatattctataataaaggtttaagaagcctatatatacattgtggttctaattataaatctatatatacacatatatatattataatataactagtgttttataacatatgttcatcttgaagaagacatcaccaaaatgttaaggctggcccaaagtggttgatcattccttattcattaatacttttctaatcaaacttctaagtttataggcatcccaggtcttccaagatactactttaaaatgttaccttttttctaattcatgctttcaagtggcaattcatataattaagaagaatatgctgatcatcactctactttattgtttcaaattatcttgaactcttaaactcataatcctacataagatgactatttctaccatggcaatccctgtggttatttgttcaatgcccactgccttctgatgcaactggctcccagtacaccagaaaggtcctttattggctgagcacattgatgggtggttgtatgcagtttgaataaagataggagattattaggtaaaatagagggaaaagaaacctaaagttggataatgataacctagaggaaaggtagtcagaagctggggaaggtgaatgcttcttagtcctgagaagactaaagtgtaaagaatctccttggcagcatggtagtgtcagaggcctttgaaccagagcaacttcatcttaaataggggctgggtaaaataaggctgagacctactaggctgcattcccaggagattaggcattcctagtcacaggatgagatgggaagtcggcacaagatacaggtcacaaagactttgctgataaaacagattggggtaaagaagccggccaaaacctaccaaaatgaagatggcatcaaaagtgacctctggttgtcctcacttttcattaaaggctaattataatgcattagcatgctaaaagacactcccaccagtgtcatgacagtttacaaatgccatagtaatgtcaggaagttacactgtctggtttaaaaagagaaggaaccctcagttctgggaattgcccacccctttcccagaaaacttatgaataatccaccccttgtttggcatataatcaagaaataactataagtattatcaatagagcagtccaagatgctgccctgcctatggactgccattcttttattcctttgctttcccagtaaacttgctttcactgtactttatggactcgccctgaattctttcttgcacaaggtccaagaatcctctcttggggtctggattgggacccctttccaggaacaggagaacaaagatgatttctggagaacgtacaggtataacaaagatttttacagtaatttgttatggaatgtgcaaggtaaaagctttcctttgatgatgaaaagagtcaaactctgtaaaatattttaagagatttattctgaaccaaatatgagtgaccatggcctgtgacacagcccttgggaggtccagagaacatgtgcccaaggtggtcagggtacagcttggttttatatattttggggaggcatgaggcatcaatcaaatacatttaagaaacacattggtttggttcagaaaggcgggacaactcaaagcaggggcttccaggccataggtgaatttaaacattttctggttgaaaattagttgagtttatctgaagactggggatcagtggaagggaaatgttcaggttaagataaaggattgtggagaccaagttttattgtgcagaggactctctcagatagcagacttcagagagagagcagattgtacaatgtttcttatcagacctaaaaacttacctgcctttcagttgactgcctcctggatctagaaagaaaggaaggaaaacgaagggggaaggagattctctgtagaatgtggatttttcccacaagagtctttgcaggtcaatttcaaggtatggcaaggaaatatattttggggtaaaacattttgattttttcccttcttatcctatagtcagattggaaagtaagccacgatacacagggttaaataaaacccatctgatgagaatttatggtttgtagggcatgattccccagaccccttagaaaggaatttgggcaagataaaatcagatctcagtcctcacctccaaaataacattcagcacaatcaccattacttactgatgctttaggcgtgggtaaattttttctggagaatgcaaaggtggtgttgagtcctgagttgtttacctatggagcagtaatcagaaaaactgacatatgggatccatactaaataagtgacatttactgcaccccaaatacatcgagtcagtcataaaacctagagtctaagcaacaccaagccctcaaaagactaaggacacataacaattaacccatcattagtctattagtatacatacattaacaataacattttgaacctggagagagccataaaatcattcatttgtaaaccaaagtgtatctgagacaggtctcaatcaatttggaagtttattttgccagggttaaggacatacccttattaagaaataaacataaaatcaccgaaacagtctgtggtctgtctttctccgaagatgaacttgagggcttcaatatgtaaagggggaaagcgggctggaggggaaggagggagagtatggaaatacacacactgcaagaggaaaggggcagatagggtaatagtcaattaggtatttgtcttgtgcttggtaaattggcactttacataagttaaggtgaacactatgtagctacggggagatatttaaccttttatctgtagctatctgcttaggaacaaaaggaaaggcggctgactcagccttcagcttaactttttccttttggcatggtgaattggggtcccgagtttctactttcctttcacaaaatctaacctcctaaagccacccagctagttccagtcacagccagatataaaatcaaggcttttgactcagtgctctttcaactactccaaactgataaggtttactaggggaggtggaagagaaaaaactgagaaaatgaaagaaacggacagagaaaatttcattcattgataaaaacagatgacatctatcattacttcataaaagataccaaaaatcatatctattacacaattatagaaaaatatattaaataataggccttaccatagaaattgtaggagtccagagaacaataccccaaagtatggtgctttggcatgctgagttcttttaaattaaaggatatcaaaaggcctcataagcagccccagaaccaaggactttttgatctcctgtttctcactccaagcacagagtggaaccctctctctcaaattcctttatctgagctttccaaaaggcacagaattgtcttttgtcccccgccctgaaatttaattatctatggcaggaaagaagactaaggaatgtaaccaaaactggatggactttgtcagaaaatagtgtctgtctctaaagctcattcaaatgccaaagagaaccatttacaagctaatttctgtctcctggtgatgcaggatttttttcctccttagttcgggtaaaatccaggttcttgtctcacaaccaggaaaaattaggcacacagatccattgaaaggtaaggagagcagagttcattgggcaaaaagaaaactctcagcaaacaggtgagggagtcctgccaaccggctcccacttcacagactgaataccaggtcaccacacacaagctgaagacgcccgactcctgcccctgcataaggtgtcaattcctggtgactccaccccattctcccagtgtgcacataggcccccagtgcattgcaggcatgcccaggcaagaagaccctgtgcaggttcccttatctgcctcctgcatttatcactgggaccatttaatttccctaaaaatcatttacaatccctcaaaattgcctatatttcctccatttccctcccccaatgaagagggtatataagcttcaactgtctgtctgtttctttgagtcttatatctgtgggactctcatacccatgtatgtgcacaataataaacttttgtgtctttttctcctgttaatctgtctgtctattgtcagtttattttggcaaaatgtgtcaatcatcaaaacatcagagggaaagtaggcttccccacaaaacacagcaattctacacatttttacgtttgacattttcatcattatcctccctccaccattctgtctttattttttctcctattactgattttaggtcatgatctttacacttttgaaaaaaaaaatgagaggacagtcaaatatttttcacctcaaaaatgatttaatcaaatagcaagatttaactaaataagaccaatagtagcaataaagacctgtttagcattttcaaagttattttctaacaaaaatgttcacttaaacatactctggtcaatagtttatttattgcctgatctatgtaatccactacatttcatcactttgattcagttgcaagtccttttgttttccttctgcagcaccttcactaaatataaaatatatcagcacgctgagtgctctttatttacacttctgagtgactagagaaatttatttgattgcaaagcttaaaaggagcccaataagtcaggaaaaaaatgcacagcactgcttctctactcagactaatttttttctaatatatatgatggtttataatttgcagatatctttaaatatttataattcagcagggactccttattagttaagtttatttggaataaaaattaattttccaagatacttcaatttcatagattgttactgtcctttatgtcatatagcatgaaaaaatgtctaatgggacaatcacttgtattatattattaatcatgaataattgatatgtaatcaattcactttagttctgaatataaatatcccaccagccaaatgaatcaaattcaatttatcttactttttagaggacattttcaatgtaacaagaatgataatgatttctaaggaaaagatccttggattatgcttccataagatgcattcattcattcactgattcttcaaataaatattgactactctctacatagaaaacctcatgataggtccatatgacaacgcagagagagttgccaatcattgtggccaatagaaaactgtgaagtttcattttaatgataataccagtatgtcctattacacaaataatgatttcacattatcatttaaagtaaattaaacagaaaataagactatcataataaatattattttttaacttatactttctattagaagtaattctaccctattccttacgcaacttggtccaaaatttattttaaaattttataactctatattgaatccctactatatgtcagacactgctagtcttgaacatacaaaaatgttcctaagcctagctgtggagagagattcaaaggcactaatataaacaatataacatcatgatgaatgttttcctgtaggtatactcccatgggaacacaaatttgagtaggatgcagagaatgcaattcataggaaaaggcttctcaagggaagtaatatttatccaagcataaataagaaaaggaaaaggagaaggaagcggatcttcatatctaaaaacaattgcttaacccatggtaacctaagtctacttttatgttttcttttctcacattttatgttttgctcttacattatttgatacaaattacatctttaaacattataaagcaataaacgcagttttacaatttatgaaattgtctcaggggtatggagcttttgaggcagctccaaatccattcttcttttttcagtggctgctcagctgtgggtttcacagctaccatggttgtgtgactactgactttcaagattggggctcagaaaacaatgcctcaaaatgaaggccttagcagtagctcaaaagcaaacatttttatttgaccttctcctgcatgcctgtctctcagtcccattctcccgcaaggctagccatgaaaactagaatctctcttccccaaggtgggtcatagaaagcaggaccccttttcccaaaagccagccttagaaacctaaaaatagtctatgtaaaaacaggccataaagaaattatctaatctattttgtttgacattccagagggggccccatcccacacccagaaggaaggactgctgcacagagaggacaagaagaatctagacagacaggacttgctgggtttccccactcagttttttaacactagatcatattgttatagaaggtagttagtgagacacaagcatggtaggagagggtccactgcttcttcaccaggaatgtcaggcaaccatcaggtgatggtaaggtggttgttatacagtcttgctaaaataataattggtcgcagccagtgccaggaaaaggcagtctcccaatagacagataacatctgaaactggtaatcagcagcttcccaataagatctcaggagttgggtgagtgggctcaagcacgcaccctaagaggcaaaatggcagatgaccttcctctaggaacactcagttggtaaggaaaaaacatctcaagtgactatgtgtacaacttcagtaaacacactgtgcattcaacccctccaaagtcctagtaggtcactgtgcatctggatggcccaccgcaaggaagaatcaggatataagagatgcagagatgcagaccccagaagcatgctaatgaaatgtataaaatcctaagtcaaaggtcaaatcacatacttgatctctcaagtcacccacttggccctcttctaaatgtactttacttcctgtcattcctgctctaaaactttttaataaactttcactcctcctccaaaacttgtctgggtctctcactctgccttatgcccctcggtcaaattctttcttcagaggaggcaagaattgaaggttgctgcggacctgtttggactcgccaccactaacaatatccttttgaacaatcatatttctacaggtatgtccatacttcattgaatctcagcctaaaaatggataatgtatctttgtcttcattctgaaggccactgtgtatacacattgaataaatgtgtatgccttttctcctattaatcaatctgcctcacgttagtgatttttcagcaaaccttcagagggctggggtggggaaagtggggaagctctccctttgcccccaaacaaggctactgtgatcctagagagagggagatggaaatagggtaaattaaaacaccacaaaaatcattgttcttgtatcaattctgccatttttcttgttgcaagccttaatttccagagttctgaaaaagttattttgaccatttttgccagtgttctcattgcttttaaggagtgaattttcagatgtccccactctgccatttcaaaagtactcccctggggctatgcttttgaattacatttaggagtgaattgatttaacggagaacaaagaagcatctttaaagtaattgacttttcaatgaagacaaaagaattcatgcaaccaaattagtattattttgttcaaaagcaacatcttagaaagaagtaacactaattccatggtagttcacatacttaaatatattttgaatatttttatctgtacttacagcgagtaagtaaaaaaaaattaatgttttaataatggcaaatgtaccctttgggagaaatttaattgaacaaagtctaattaaaaaggtatttgatcaggctgaatgtatcatcatttttttatctaagccaattgatggctataaagtaatcagggtaatatttgcacttggatcataacctaactacaaaaccctcattccaaaagagtaactttccttaaaatgttataaccaatggagaaaacattggaataagcttatagcattcccagtggacatatttggcttaacaagttctatagtgagtgttaaaaatattgaaaaaagaaaaatagctcagagaagtctaagctatgtgaggaatacaaaatttatcaagcctggagagacataagacttcagtcatcccctcaccccctgggggtggcacctatgcccaggggtaattgtttaaaagcgtttttgctcctgactagctgcctcacccattatcttcatgttcctggaatttgtgacttcttcaagacttactccaaatagatatttactcatttctctgagctatcatgtatatagaaagtacacgttattaaacttctgtttgctgttctcatgttaatgtcttttagacattagaagttttagaagacactgttctcatgttaatgtcttttaaacattagaaattagacatttagaagtcccaactaataactaatgaaaggtagaggagaaaattgtttttcctcctttacagcattgcagagctagctatgggcccctagaaatcatccgtaaacttcacatatttaaaataaggaaatagacggctagagaactgcccaaagtcacttagctagcagagattttacaaaacatcaatgggcatctaagaagtgcctacaatacatcaggcactgggctagacactacccttcacaaaataaaactataagttgggccaatgacattcagtctactgctctttgcacaacttcacactgcataaatgaataaattctcaaatagccatcaaaaatgaaatatccagaggaggcagtctaaagaattacaatgaatttttaaagtaacacttgttttgtaaacaggaaagtacatagaaaggaaaagagaaaatccattctatataaaatagaaaaatatgtttgtactgactcaattatttaaaattaatattgtgtggcctaggaatatgtttttatataattaatgtttgttttttacaaaggttcctacaggcaggaaatgtgtttgatttttgtgtatacttcagatttcatcacaacagcaatataatgcaggactcaatgcaaagtaagaaaaaacaccaggcaatcagttttggttgctttttcactaacaaagcttgttaagaaaagaagagcatttttattttttataaatagaggattttagtgcctattttggaatagcaggtagtattccagctgtttggggctgctttgggctctaggcattttaaaattaatgggctgggccaaacaaagagtgtattttcattccacatcaaatgtgtatgctggtttctagaaatacaatatgtttgtgcaagtgtggcaacatttatccttccaggtagtaaatgaagacatctgccttctcctagagacttagctctccaagtcaatttaaagaaaccagcaaataacccttagtgactcttaccctcacacagaacaagctgatttctcatgacagctatattcaatctatgactaaataatgccattttaaatgaccatgtgtgggaagtaaaactataaagtgaacatgtgctttagagcctggagctcttagttcaaatcccagttctgtcatttactagttgtaggacatttttaaaatctgttaatttctctggatggtcagtttcctcctatgtaaaatggagacaatattacctacctcacagggttaatgtgaagattacattatatagctcatgtaaagcacttagctaaatagctggcacagagttgacacttgatgaatggtgccttttatctgccccctctgcaattacttacttaaagttatctattatttaagcatctttccattcttaccaaacttaaaattggtacccaaaaaaatcacctaatttttctcctgttgtactaagtagcaaaagaaaaacattcaagaaatgggaaggccttcatgatacaagttttcatgtctgtaaaattaactctgcattaactcctgacttaaaattctacaacacagaactacaaaattttaaaagaacagaatattaatctagagttgatataaaaatactagctgtctcaacttaaggcatttcacaagcctgagaattatttctgctttgactttgcagctctactgaaagaaacccttaccctagctgcaaacctggacagattcttgaacacaatttcttggcgcttcctctgaaatccccctagaagcaagagcttctgctgagcgactccatggtgactggaacatgaaaaaacatgctgggcccgagcgcggtggctcgtgcttataatcccagcactttgggaggcggaggcaggtggatcatgaggtcaggagttcgagaccagcctggacaataaggcaaaaccccatctctactaaaaatacaaaaattagccgggcatggtggtacacgcctgtagtcccagctacttgggaagctgaggcagaagaatcacttgaacccaggagacggaggttgcagtgagcccagatcccaccactgcactccagcctgggcaacagagtgagactccatcttgtaaaaaaaaagaaaagaaaaaacattcttacagattgtctttgtgatagccaaacccattccagactagtcaatggttttgccatcactttcgtgcaaatattttctaaatatctttgcatatagtatgatgtattataaagacaatcctctggaactattgtgtatgttcaccataaaaggtactccttatgcacatatttctcacactgactgcatacaaatgacttgaatttatagaaggatttttcttcttgtagccattcatacccagctcacagcccaagccaatgtgcgtcctccaaatgcaatcagatgatgtgaccagccttgaaacgctcatcagacatgttttctaacatatattcttggtccagtctaaacttggatatttggaaacagactacttagaacaccagcatttgatattgtgttcaaagattgcagaaaaacatgtagttataatcactctagtactctccctgattatataattaggggtgtagttttagtcttaaaagagtaccaaatagactttgagtcagtaaaaagaacaacttttactgagagtagaagagcatctttgccatcaaatatgagcttttgcagtcaatttagccccttctctaattgacactgttcataaaagacatttaaaaccatttcatgtattgttaatatgcacagtttcaacaccattacataacccatcaatgtgaagatcagaggtttataatcactgaaattgattagtccaatcctcaaaacaaatagcttactattctgtaaaattttttccctggtgcaagtggaagtagtattgtaaaatgtctttgaaatccaacaggaatacagatttctcctgtaggacacagttttgcaaaaattgctttaatcattaagtaaagttaagcttgatgaaaaatctttctactacacgtctttgagtcccaacaacagaagcacagatgatggctgtgtgaacttctatcagtttgcttcaaaattaaagaaaatcttcttagcatacaaatcccaacaagtagcctagcaccacttttcatttattaccaatgcaaccaatttaaacagaacttattcagtttataagatggatatcttgtcaactgctaatcataatataaacaatgaatttgtactgcatattatctgtgcattttttctcttcaaataagattgcaaccttaacagaaaatgtggaacaaaccagcttccgcaacatagttctttctttaacaataacaacaataaaactatgctaaaactacactgaagctacactacaataaactgcaaaaaatcaaaagatccaagcactaacactgagtcacattgtactctggcacctgtaataagattacctccttgtgacctgctcaaattctggacccaaagaaagttttcagaaagtttttccaaaatcctctgtctgtcacccataaagcttcattcaggtactaaatgataggtaagtttagtagtgtagtcctagctacatgaaaggccagggcaggaggattgcatgaacccaggagttcaaggttatagtgagctatgattgcaccactgcactccatcctggcaagagagcgagatcctgtctctaaataaataaataacagataaatgatttacaaattttttatcaagcactctttagaaaaacttcagcattcacacataatatatgtatttatacattatatacaagttctaatctcagcctttatgttaaataattactaaactttgttttttacttagataaaaagtaattatccgtagaatttctaatatttttcagatgttccactggatcattgtgcatgccttctgggtattcaactttggagagtactgtactatatgagtcaggattattagacagaaaaccaattaaaaaccttagatgtaaaaagagaagagagaggagagaaagaaagcaccagttgcaaatagcctaagttttaaagtacatcaaacatcgttatatgccagagcttcacataaattatcttagtaaatcctcaaaaaaggcattaaaagaggtatcatttttgctcttgtacagatgaggaaactaggatcagggtaattacatccaaggtctaagtgtcaaaacaaatgattgtcagaggacaggaagaaaataaaagggaagccgttaatcaaacatttggccctctcatatcccaaaattctaaagatctcttaccacaaagaaggcaaatctaggaataatcatctaaaacatgttcagtacatgtatttcaaggctctagagacaaagggcaaaacatactaaattattattagtgcttgagaaactaatcaattatcttttgattgcctgtcatttcttaagcaggtaacatggatccaacaaaggaaggatggatgaatggatggatggatggatggacggatggatggatggttgatggatggatttatttatttatttattttaaagacagtgtctcaatctgtctcccatgatggagtggagtggctcactgaagcctcaaactcctgggttcaagggatcttcccacctcagcctcccaactacctaggactgcaggcatataccacatgccaggctaatttaaaaaaaaaaaaacatttgtagagacagggtctcactgtgttgcccaaactggcctcaaattcctggcctcaagtaatcctcctgccttggcctcccaaagtactgggattacagatgtgagctaccatgcctcaccaaagtctttagaatctctattagcagtctttagaactgtggtatccttcatacaatgtataaatgctagcagctccagtgattccctgcttacagtgttaagggatggagtaatacctgctttttttattttattttggtttattggagacctgcacaacttgtgtggcatgtagcaccacaaatcctagtctgttatgtaaagagaatttaaacaaattaatcacaaacattcatgagcacatatgcttatttgcatgactgtcttgtattatagcctaaaagttattcatgtcttaaaggtgtagaaatactgtgtctttcatcaacatagcctgagacaattgagaatttaataagatatgcaaaaccataaaaatcatggctaatatttatgcaacttttctatgtgccaggatgtgttctaagcattttatgtgtattatcactttgaatcttcacaaacacctcataaagtagatgctatatgtgtccccatttccaaccaggaaaactgaggcaacaagaggtaagaaatgtgaccaaggttacatcactagcaggataaccagatctttgactcaaagatgtctgactccagagcttcctccaagaactatgacagacatacagtaagagagttcaaaatacagcaaattgttaacaaatatgtagagcaaatggctaacaatatcaattaagcactctgatatatctccaagactagttctgcaacccctcgcagctatacatcctaaaatattctgcctcttacatgtctcagaaattaaaagaagattctgctaatccatgttcagtctgtcacacataattgatgtgtgggtgatgttgagtttgcttatttgttcaccctttcttatgtaatataataggtgatgttacagatgatagaaaaacataaggttgaaaggatggactccggagtcagatgcacaaggattcacattgctctctggctgtttttggctatataataaattgatccctccaagtctcagtctccccttctataaatggagatattgacacctgcctcattaaatagctgtaaggagaaaatgaaataacatatgtaaaagaaaataatacatgtacaatgcttgggacgtggtgagctcccaaactatgctagctatggtaaataaaaataaccccactaatagtgacacagctggtgttaacagtgtgatctatggtacatggacacagaagagatagttaacctattgagtggctaaaattgtgagcttggtgtgaaagatgaatgatctatcctggtccactgattttctataggtctccacagcacttgctcacccacctctttacaaagcatttctcctctctctagcatttctcattgttatctctaacaagtgatttattttaagttcatcttttctcatttcctgtgacctgttcagaagctcatgtacatctaccattgtgagcacccaaatagtttgttatctcctcacacaatacttcatagtcagctgattcactggggttcgttttactatgtaaccatctaccataaatacctagattgtttaaaaggccacaccgccactcacacacaaaaagaaagctttgcatattactgtaacctcttcacatgatttactagtgttaacacagctttctatgaaaaatgaaagataaaagttgtagagaccaagggaaaactccttcagcctctaaaggttcatggaaaaatcaactcacaaaaggcaaattaattacagaaacggcatacaaatgtatttaatgtgtacatgagagccttcagaatgaaaacccaaagatgcaggggaaattgtccatttatatgcttcagttcaacaaagtatgaacagccatactcaaataagattggacaaaaagtttactacctaatgctaataggttgagtggggaaggtctgtctagactcttcttggcctctctgagcatgcctttcttccttccgggtatggggcaggactctctcttgaatggcgggtgggggtcttaagacctacagtaaaacaatgtcagttagataatttctttatggccagtttttacacagcagggcagagagaaagtttgagtaatatttttaggtgttatggggggctttagggaaaagaagttctagtttctacgacatgccctggggaagagggattctcatttctatggctggatgtaggtgaatggggctgagagacaggagggcaggagaaagtcaaagaagctttcacttctgagaccttcattttgaggtatttttttttccgagtcccaacaaagtaaagtgggaatccagacaattctccacaatttcatgtaaaacaataagcgcaatgattgtaatatactgatctacttctcaaatttaaatgtcaaatgataccacatcattttactttttcagattccataattagtccccctcccatttttatatctataaactcctacttggctattttctttgaactgctacaatgaaaccatactctaagggatagaacaattttatcaacgtttgtaataatgaaaactttgaaagctttagttttacttaataatcagttaataaaaagccataaagctgttaatacattttagattcaagtaaaaatagtaatgactttcaaagagcaacatttctgattggcaatattaaataggaacaaatcattgtggtttgagatgtgtttaatgcagaaagtcctgtgtgctcaccatgtatcacaattaatgttttctggtaactctaatgggctcacagggatttggaagtttggtaactatcagcacttgaaactttttcctctttgtccaatactagataaataaaccattctagtttaggatattgaatcatataaattcctaaagagaattagtagattaagaagagtcaataaagcagaaccatcagaagttctctaaatggaaagaagttataaatactacctatttccttgttaatatcaggttacataaaaaaattattcctgaaaataaagttgctaagcttgatcaagtagactttcttttttataagtagattagacttttcaacctaatgttttgaggaaaacatctccaaaggtcctcttagaaggtagttggaaggagccctagtaaaagaaaaatctataaagcttacagataaaaatcagcttaaattgtgtccatccatgaatgtcaatttctattacagggcagaatttaattaattttgtttcatttaataaatattctcctatggtatacaattccttactagacactatatcagatttctaagtagttcaaagtattaaggattacttatgactggaacatgttatcaatgtacatattaaattttctcctccttctaaattacacattttattttttttattatactttaagttttagggtacacgtgcacaacgtgcaggttagctacatatgtatacatgtgccatgttggtgtgctgcacccattaactcgtcatttaacattaggtatatctcctaatgctatccctccccctccccccaccccacaacaggccccagtgtgtgatgtcccccttcctgtgtccatgtgttctcattgttcaattcccacctatgagtgagagcatgcggtgtttggttttttgtccttgcgatagtttgctgagaatgatggtttccagcttcatccatgtccctacaaaggacatgaactcatcattttttatggctttatagtattccatggtgtatatttgctacattttcttaatccagtctctcactgttggacatttggcttggttccaagtctttgctattgtgaatagtgctgcaataaacatacgataaattacacattttaagtgctctaggttcaattggctctgagcatggtaaacaaactgcagtcactaaagaatctccaaaggcttatctaataccagtcaaagttatagattctatttggaaggctttttcatcctacaaagaggatgaggtcttattcgttgtccccaacacctcgctttttgagtgttcgcacagtgtttggcactcagtggcactcaataactgtttgctgaaaaaaataaatcaatgagtatttagagacccaaatatatataaggaaatctaatactcgagtaaatataccaatagacacaagatataggtggggaaaaagactatgtgttgctacaatttcagggtaattacatacatacaatcattcaagaatttcaaacttaaaatgtattcaactacaccaagttaaccttctcaataatatgttcccttctgttccacaaattattcttaatttgattttttttaaaaatcacactatcaattcaggtaacatttttacaaataaaatgttttgatttttaagaagaagaataatgactacaaagctatgtatattgtcaaatcaaataaatttatcatgcacctgaaacttgcaccaaggaaaggaattctaaaaaagtgactccccagttctcccactgagacaggagttaaaaagatttaagacactgacagttaaatcaatctcagtgatctcttttactgggggaaagtactgatttgatttataaaagtttaatttcaaattaaaacagctgttaatatcctttaccaaccattattttgttatacgtggcaggaaaataagcagatgaggtcatctgcctagactgaggtgttgtgattatttacagccctaatttttgttcagtaattggtaggtacagttctaattcttgctaatgactacgatatattgctcaggcaaattagaggaatagaatgttctgttactttagcagtattggtaaaaagtgacacaataaaaatgagtactcgttgaattaaatgccttcaacaacatcataattcaccccaaagatgctaatactaaaaacacatcctgcccccatgaagtggacttcagtagaatggaatttctgtatttatttagcattggcttctatcactaattaccccttctttaatgtaattttggggcataacgtagtaagtggttcatgatcactaattaaatgcctactatctgtgagaaaacatattttaaattgttctcttgaaataaaaatgaaaatactcaaaagaaaattctttcttaaaggtctcagaaagaaagcaggattttttaaaagttaattcatgacaacagatagatcataaattgtaaaattataaagccatttttactggaatagaagaggattagcagctaaggaaatacagtcacgggcatggtaagatatacaggtactttctaagttgcttcatttgagtcacgtgggaattccaaattgaatcatatgggaagttaggtcagagaacattcttactccaggagtttttcaaggataatagctgagacctgcttatatataggccataatgcagctatttaaagtaaataaagtcttcaattcctaaagtggcagattccataccaagttctaatgtacccagccactcacagctaaagccacaaacaaatgaaatcaataaaatcaggcagtaaagccaacatctggggttgctgttcattgcctaaaagtgtcaatgtgggttttaattagctggagtaagaagaataagagttgaataaaatcaacttaaattagaagacacacacctgtgatgcaaatattttattctgttaaatcttgtttattatactacttatcacatttatctcagatgctgatacaaaatgctatgcaacaggctttgaaaactgtaatgtaccatacacatgcagggccactacctacggatgctcaggatgcgcagttcattgcagtgccacatctaagggagggtccatagtagacactgtagatatcatgaatttttcagggtgatcaaagttaaatgtctcagtctaacaagaatttctgacaaaggtgaagtgtgagtaagcaatgaccctgtaagatattatttttaacccaaaatttatattatctcagcaaagaggtttctggaggaagcaaacacagttgaaattatagcattttttttcttttctctctaaaatattattagatgctcatttaaggcaaacaccacaatgcagtacagcatcatagcctaacagagcattatcgcctacctagctctatggctaagcatttaagaggtcagaccatcattctacaaagctagctgtttctgaattatatacatacagtaaacccagtaaattctgtgggcttgaaatcactaatgccataaaaaggtctgttaattgaaggtgattttatgggtataccatggagatggataaaatattttataagtccaaaaatggcagcgattttagaagcactgtaagaaaaggcaaatcaatatttggactttgcgtctttctttgtgaggacaaagcatggcatcctccaggttgaaaggggtttaatgcaatccagttgtcacttggtagttggatgaccaatgatgctgtatcaagggttcagtgctgggccgggcgtggcagctcacgcctgtaatcccagcactttgggaggccgaggcaggaagaacacctgaggtcaggagttcaagaccagcctggccaatgtggtgaaaccccgtctttactaaaaatacaaaaagtagccaggcatagtggcaggtgcctgtaatcccagctacttgggaggctgaggcaggagaatcgcttcaacccgggaggcagaggttgcagtgagccaagactgcaccattgcactccagcctgggcaacaagaatgaaacgctgtctcaaaaaaaaaaaaaaaaaaaaaaaaaaaagagttcagtgctggtccctgatcctagcaaattaaatagtcagcaacttgttgaagtcagatcagctttgtagaggaaaaacccatattgttgagctttgtatgacctctagtcagtcaccacagccacattgtacgtggactctctgaccaagcaacagggtagctggaaaaagttgactgacattcacagaatgagtcatttgaccacctgaaaactgagtgtcccatttactgtgaatctctttggtaggcattaatgtgagacaggaatatcctcacactccatgacagttccaagaggtgtcctccagatcctctttgtcaccaacttcacaaatattttctttccaactccctgaccagccaatcagtttgctagggaccatccatgaattactgcatattgataccttaggacatctttacttctataggaaattaacaactagatgtagtgctcagagttcagcccactggaaggatttcccttcccactgtctttcacggtcctccctgcataggttacacctatcccctatagctggtttcagtatactatgcaatccatccataaatggaccacatattttccttctctgttaacatatcataggaaattccccacgaagccatagatatggactgaagaagaggcagagaaatagtagaatcaagtaccatgggagtgtaaatcacctgcttgtgcagtttacttggtgggcattctgggtctctcaggctgctcttaatatgccacatctgattactactggaatgctcttaggcacatcctattttaaggttcactggattcgataacaccttgttcattatggacaggtcaggtcacatactttgcatcctgcggtcatgtagggtccagaagcaagccagaaaaactgctttttaaatggaaaatagttgttggcagataagaaatctggccatgattctcctttgaggtttcttccagaaactccaaatagtaattctgtctatcgcatacatttctagtacattgagcctgctgggccataaaattaatgaggcataacagtcattggaatggtaagatgtacaagtactttttaagttggcttcatctgagtcacatgggaatcccaaactgaatcatatcggaagttaagtcaaagatgatttttactccaggagtttttcaaggataacagctgagaccatcttatagataggctgtaatgcagacaggacctaaggacctaatgcagagaccttcctttctcctggattcactcaaactgccagccttagcatttatccagtaaatggtcagcagtagcccatccgaaggtaatatgtattgcattcaaaatccgaagtgtctcaccaagcattgtgcttgatggtggatggggttcaaggttcaggtttaataatctgtttttcactttagaataacctgctttagtgtcactctaatcctagaaacttcactgatgtggttagcccttcaaattttacaggatttatctcccacactccaacatgcatatatctaaagttactatagtacttgcttcttcctgcctgttaggccgaattagcataacgctaacaatttaatagtatatttgatgttctattgggtataaaagaaaccaaagtccctctagattatgagtgatcagctaggtgttacttatggtaaacctgtaaagatatactgttgtccctgccatgtaaatgcaaactacttctgattttttcatatcaatgttaatggaaaataaaacaacttctaaagggctgtgctagttagttcccataaatgttgcacaactggaactatatgtgcaaatagcatcacaacctacttaagtctgcaaaaatatactctcatgctccatgacccacatgttttgcatcagccaaacagtcaaattaaacaaatatgtagtaggaatagtcactcttcatatgttgcattttttttttttagacgaagtcttgctctgttgccaggctggagtgcagtagtgcgatctcctgggttcaagtgattttcctgtctcagcctcccaagtagctgggactacaagcacgcaccaccacacccagctaatttttgtatttttagtagagatggagtttcaccatgttggccaggatggtctcgatctcttgacctcatgatccactcgccttagttatatcttttatggtggtactaatctctgacattccctcaggaatgtgatgttacttttggtttactacctcagctaggtgaaaaatgtcattccaggagcttctgcttggccctttcttatcataatagccttcattacatggatcaagaaaccaacgtgttgattccaccagttactaattatatctattctcattatatattctgagactaagaaatgctgttagatttagaatatgatcaagatctacgtaaatctctactctgacttttaaatactatggtggcatttagagtctctggggatcagaatgaatttaaagccagaatcgaataactcagaagttctgagtattatttccttttctcccgtgtaaagtcaccctggtagaaggctgtaggattctttatattgtgaagatttctctttcccactggctttcagggtcatccccatatggggttttagtgcagcacctatccaattacagctggtctcagtatgccataaagattcatccataaatcaggaccacacagtttcctcctctattattatagaaatatgtttagagatggcttggaaaaaatgcaaaatatacagccattgctacattgcaaggcccttttacaaagagacctgaccttttcctcaattgaaaggacctaatatataaattggcatacatctgaaaacactaagttaaattgtttctgcccacaagacttgacataaggcagaatttttctgcctatatatgtaagacagtacattggaaggctgcacatgtatttcattcttagaactacatcatcagttagctattgctttagattaatggttctcgaagtgtcatgtccaggccagcagcatcagcattacctaggaatttgttagaaataaaaatttttagactccacttcagacctattgaattagaaattctggaggtggggcccagcaacctgggttttagcaagcccccaacataagtctgacacacagtgaggttaaaaaaccgctccccccacaaaaaatacagaaaagaaaatcattcccatagatgcttacaggtcaaaactccatccctgtggcttgttgtaatttcaaacacctcgtttgtaatgattaagggccaccagctggtctccatcactgtcaaaccatcatgaatcctactggatcaggaaactcagttccattatggcataacctacagtcatctccttcctacagaggacagcaaccacagagctatttaacaatgctgttatccccctcaccaatgcatattatagtgctttcatcaaaacagcatcctctggccttcctagggagtacggttaggagttggctgatccattctagcatttccgtttccccaagcctgtgaattccttcctctagagtaggtcaggtaatctcaaacatttctaccttattgactataggtcatcattgagttcaggcttcaattaatatattcatagactattaatgcctctcccaagtgctcagaccaacatattaaaccctaaattccaggtgagtacaccaatgtcaacaatttagcctgatgaacattagcattcactccccatgtatgccaatacagactggtggggtcttgaccttcttgacctctttcagtgtataaactgtttctcctggaccaggccttgtaccttcccatctgggctatgttgagtcaataagaggtggcaaagattggtcctgaggttaatcagcatctgcctgtgagacaggtaagaatttttttatgtacaatattttttatttaagttttaaaataaattttattgtataaatttaaggtatacaacatgatgttatggtatgttttgtagcaaaagtaaaatacttttatacactgagtagccaaatcccttagtgagccaggaggagttagatttagggccagaggctcctcagccatacctggtctgaatctggaagagatgggaaactctttcaagtctgcagtggagagcttcgtttgtccacacatgtccttaattgtatgtgcctagtttttaaattactccttttttctatttaacttcctgagagacataagaagaagccagggactccacaatctttacaattattaaaaaccacaatgagacatctcacctcatacctgttagaatggtttttatcaaaaagatggaagataagtataggagagaatgtggagaaaaggcaacccttgtacactgtggtgggaaggtcaattagtacagccattatagaaaacagcatggagagtcctcaaaaaactaaaaatagagctatcatatcatccagcaatcccactactgggtatgtattcaaaagaaatgaaatcagcatgtcaaagaaatatctgcactcccatgttcatagcagcattattcacaatagccaagatatagaatcaacctaagtgtccatcaacagataaatgaagaaaaagtggtatatatatatataaggaatgcaattttgcctttaaacataagaaaatcctggctgggcatggtggctcacgcctgtaatcccagcactttgggaggccaaggcgggtggatcacgaggtcaggagatggagaccatcctggctaacacggtgaaaccccgtctctactaaaaatacacaaaaattagctgggggtggtggtgggcgcctgtagtcccagctaatcgggaggctgaggcaggagaatggcgtgaacccgggaggcggagcttgcagtgagcggagatcgcgccactgcaccccagcctgggcgacagagcgagactcgtcaagaaagaaaaaagaaagaaagaaagaacgaaagaacgaaagaaagaaagaaagaaagaaagaaagaaagaaagaaagaaagaaagaaagaaagaaagaaagaaagaaagaaagaaagaaagaaagaaagaaaatcctttcatttgcaacaatagggtgaacctggaggacattatgttaggtgaaataagccagggcacagaaagacaaataccaaatgatctcatttatatgtggaatctaaaaaagttgaactcacagaagcagagagtacaatgagagtacgatggtagttacgaggggctggaggaatgggggattggggagatgttggttaaacaattcaaaatttcagttcaataggaagaataagtcaagagatctattgtacaatatggtgactacaattaataagaatgtattgtattatgtaaatcaataagaaaatagattttaagtgttctcaccacaaaaatgataagtatgtgaggtaatgcatgtatcaattcgcttgactgagccattctgcaatgtatacatatttaaaaatgtaatgtttatacaataaatataaacaattgttgtcaattaaaataaaataaaatggtaaataagttatcactgacatacaattaagaaccacagccacttgacctccaataatctatcttccatgtacacttcatccccatgttaccaccagtgataatctgagtaattatgccacctcctgccataaactgcccatgtcccattttcttccgctgtacactttgaatacatgacaaaactaattccggaatttcatttttggttctgttgactaggaacatttttggtaaagtgggaaagagtactaggcagggtgccagcattaaacagatggtataaccaaattagaataattgaaaaaggattgaataaaaggacaatttaataaagctataggcaagggacaaggaaaacataggctctttaaatgtggtctctgaaccagcagcaccaacatcacctgggaacctgtcagaaatgcaaattttggacctcacccgagacctattaaattagaaatcctgggagtgaggcctaaccatctgtattgtaataaactcatccaggtgattctaatgtgcaccaatgtttgagaaccactgacataaggtataatgcagtaaccaagtgctaatagctgtgaagctgttaccaatcctaggtccaaagagacaagagaacagatccgtatttgaaaccagagaaagccatagagacaaccaccttgagagaatcagtgacctttggtcaagagacccaggctaccctaggaaacccaataacaaggggataatataataaataacaaagtctcattttctcccttcttccagttgtcaacctggactcccaagtggccaaattcaaccagaatctagaaggcgagggaaccagataattttgtacattacagccttccaggctgaagaagaaagatgtatctgaaggaacaaatagaggagatccggcatgcaggcctaatttgcttttgttaacacacccaagttttgataaaactccaaaacatgtatttaaggaagctagaaatttaaaatattttgcaatttccatggcaagaatggtttctcaggaatggtcatttactatttaagctaataactagattccaataagaaagttcttttatggttagtgaccaaccccttttcttgttccctataatacagtatattgtagatattaaagaaatgtcagggattgttactattattcattttataatcacctcctttcccctatttagatatttaagtctctccttgtttccatgccgcatctgctaagtgaggatctaacctgtcactgaattctcctaggatttctgttcatatcagaacccttccctcttctgaatgccataatctaagctccattcacccacaagctacaacctactgacttacttaattcctttctcttttataagctatatttctttatttgcatttaatcctatgtaccgttttgggcttactcttgctttcagctagacaaactgctctagcctcctccttgttcttagttctatactacactttaacattcgcattgccttgatgcttgagatgtaaacatatataatgtggagttgggcaaaattaagggtctgcatccccattattgacttttagacagcaccacttcaccgtgcccctatctccatctatttctattatacaatgcttgtatccatctattcagaatttgtctgaatgtgaagtctcagccatccttgtcaaacccatctctccataggcacttcactatataggacaagtacatacacaagaataagaagccttgtttataattatagactgctttaccacacacattctcatcaatgtttcatctttcacgacactgataacttgaattagaaaggattctggacagtcagcagaaacttgttttaaactgagctttgttagaaaataaaagtaagactgaaataaatattatctgattattatgaatgtgtccctcaaatgtgtcctgcaaatttacctcttggctttctctgaaatgaaagaaatctatttacaactatttttggttttttttctactaaataaaataaaaggtgtatcttttgaggtgttggaaggatcagctaaccaatctcacccaatcattacttggtatctgctacgtgtctgacgttatgctagttgctattgactcaaaggaaaaaggaaaattgtcctctgccttcaaagggaaacaaaaaataagcaggtagttatagttattagtatttcatcaaggtacaaagcaggttatgtactctagactctgtgatcagagaaaggctttctggaggagacatcccagaactatgacctaaagagtatagtaagtcaagcagaaggagtgaggataagggaagaggaggaggtacaaagaagaagctatatataaaaaggtataaaggcattagaaaatgtgaggtattaggctgggtgcggtggctcatgcctgtaatcccagcactttgggaggccgaggtgggcggatcacgaagtcaggagatcaagaccatccttgctaacacagtgaaaccccgtctctactaaaaatacaaaaaattagcagggagtggtggggggcgcccgtagtcccagctacgtgggaggctgaggcaggagaatggtgtgaacccgggaggtggagcttgcagtgagccgagatcgcgccactgcactccagcctgggtgacagagcgagactccacgttagtgggtgcagcgcaccagcatggcacatgtatacatatgtaactaacctgcgcaatgtgcacatgtaccctaaaacttagagtataataaaaaaaaaaaattaaaaaaaaaaaaaagagagagagacaatgggaggtattaaagtaaaaagtgaaaagtgaagaggaaaagtctagataggtatgtaggggagaaataaagaagggtcttgtaccctatgctaactatgctaaaatctatagagaatcatggaagaattttaaatcagggagttgaagagtaatattttcctttttaaaaggtcacaatgtgaattgtaaaaaaataaataaataaataaagctagattggaggggcaagactagaagtggggagataagttaggataccattacagttaaaaaaagaaaaaaggatgaacctgcactagagtggtagatgtgaaagtggagggaagtagcttcatttgagagattagggaagcagactcaataggacctggtgactatctggttgagtagctagaagagatatcagtggatgctaatacaggactgagctcagaaagaaaaataagcaaaggtgaccaaaacagaatgatcagaaaacacaagaaaaactattatggcatttcacacccaaaacaagcgtttgaggagatattggtctatggtataggttgagtaaatgaggtctgaaaaagaatcagtgtgcttgacaagtaggaagtcagtgaaatttgccagaggagtttcagaagtggggtggaactagaagtcaaataagcaaagtgaggagaaaataggaggtgaagaaacagataaagcaggtgcaaatttctcttttaaaaaagcttaacagtcagggatagaaagaactgatagcaaaaaaaaaattatagagcccagggaaagtggtggccttttaatttttttagatgggaggaactggaaccttcatcagaacgagctaataaaagataaagtttgggaaaaataggattgtattcttcttataccagacattggggtatattgagtaagagacactactgacacaaaatgtcttttaaataatatgttggaataaactcccaaaagcatgaacaatattccaataaagttatgcaagttgcaagataggtgattgaagaagagctctttattaatcaaagaaaactctcaggtacacactgcctgacatccttaaatggtaacatgtagctaaagatgacatccaggaaccttaattaataaaaccaggaccataaacctcaggaacaagagttggaaagaagttttacagaggaagtttcaaaaatggcaatgagtggccggaaaaagaggaaaaatcagcatgcgtgtgctgatgatattttaccagctaatagctcctcagaatttcttctccatcagtctcccacaaccccagatcatcacactgcattggaccattttcttgatagctttggctctgagcctctctagagccctctgctggtggatttttttaaaaaaaaatacaaggattaaggattttacctgacttctagatcccatccatccaaggtaaaacccttcacatatctggctttcctgggaagagtattccagaggaaacactatttccactttaatgtaagtgttcatgggaagtgaaagtaaacattttgcacacagagaaaacctatcaaagactcagagcaggagataaaaaggaaggaagatacaaaaaaatgtaaaaatcaagaagggaaagttatgcattgtgggtgactgcaggttctggaaacaatctacctgaattcaaactctggcattatgctttaacagacacatggctgttaacaagttgcttagtatttttggacttcattttcctcatcaggaaagtatggaaaaaaatatcttttattatgttgattaaataattaataaatgcaaaaaaatgcaaatggattctattgctacattttcggttctctcttcagtgtcttatagaaaagtaaaggaaatcaacttgtcaactagcagaaagcagtatctaataactgatcaaattatacgggcagtaatgctaattgattaaaagtcatagcatatcgtcatatactgagttccaacagatggcatgaaaagcctttgcagtcctgaatctctgccttctatacaacatgctactgattaattgtttgtttgtttgtttgtttggttggttggttgtttttacctcagcaactaaatatcccattcatataaaccacagcactagtatcagagacccattcagtgcttgtctagtctaatttcatgaaggaaaacatcatgcttatttgaagactatccttgaaaagctacagtggttaatttcagtattctagatatgtcagtatcagatattgagtcctgctttgcctatcacctctttctaagactgagtgtacaacctatacccccaaacctcagactgtgctccaagcatctcaaagtggccattaggtgaccagtacattaattctcgtgtacattaaattctgtacaatgggtggaagtggtaagtggctaggtaaatcagatttcatcactcgggacctataaaggaaaaatatggatgaaattaaccagtggaattaggaattaacacacaaaaagaaagagtcttattaatggtagagtgctagagtcaagatccatgaaactaccactaagaggaataacattatctggtccccattctcagaaggtcctgtgggattctgctactctaccctacatgtgttctcataaaactccaatcattcatgttctccatgacaggaaattgccaaactagcacattatagcatttaattatcattccttcccctcttttggcctacatacttactggatcatcctttcaacattcaagagactaaattacagaattacattgatatggcttagctgtgtccccacccaaatctcgagttgtagctcccataatacccatgtgtcatcggagggacccgggggggaagtaattgaatcatgggagtgagttttttccttgctgttcttgtgatagtgaataagtctaatgagatctgatagtttcataaagggcagtttccctgcacatgctctcttgcctgccaccatgtaagacatgactttgctcctccttcaccttctgccatgattgtaagacttccccagccatgtggaactgtgagtccattaaatctctctttctttataaattaccccatcttgggcatttcttcatagcagtatgaaaatagactaatacatacatctttgagacattttttttctagcctaaatgttaagtggtatatgcataatgagtatggaaagacttcattaattaaacattccatttaagaggactgagcataatattcaaaggaaagaaagaattctaggattcaatcaaactatttaagtactaaagttcacttagagacccagttaatcaatccctcatttgaaagttaaggacattgggagccaggaagtaagtcactaggaactgagagacctgtcaaaaatgacacagctatttagaggcaaaggcaaaaccagaatcagaggtacaaattcctacttcaaaactttttttttcctattagtgaattttaattctcaaaaagtttacttctactcttggtctgaagtgactttttaacctcttaaccttaattccaacatctttgaaaggtgctcatataattgtgactgctgagaggatgttacttcattttgtgaaaaactttgaagataaatagcaccattacaattatgactcatctcaaaaagtttaacatttcaacctttgcttcttattgtctttttatgcaacatgattaatgcactctatttttttgtggctgtcacaagagccacaaaatctctcacttcctttattgtgactcagtttgaaaaaaatatgcacaaactttttcttgagtgcttgcttacataaatttaccaagtaaaaaaattatactactcactcaccatcatcaagtgaaatactatgtcatcttacagcagcatctcctggctgatgtttgtggcaagtctaaagagcttcataaacctttcctacatttcactctgtaggaaaaggtatgggaggtggaagtatgattgtaagataaaagagaattaaggagaaaaaatgatgtggacatggatgagaagcctgggagacaatagaagaggcacaaagagagaaatgaagggagctaataagaataagtgtgtgtatacaggtgtgtgtgttgatgtgtacatgtgtgtttgtgtgcagctggtcacagaaatacagtcagaaagaagtcgttattatgttgttttgactgatctgttgcagaacaggaactgtgatgaaaacagcagcaaacagggtcaacttactattgatcaatataccacaattataataagtagttctaaattaatccaaggctatttcagaaatcccaaatagaacaaaaaaatgaaattctacccttattaatcataccattgccggccaaaaggagcagaattatactcctgagagtattctgaaaatgtcagtgcaacattgttctgtaccaagaactgttagcctgcaaatgtatccttcctttaaaaaaaattgccaccaaaagtagatattaaaggagcaactaaatagatgtttctatttacccaaacaagctccagaggaacttacgtgaagtgtcttaggcagaataaagctatacgttactcagaataaataaataaccaagaatgttatttcttgcacagttcagagtgatagaagggttaaataagtaggtggagataagggaaggcaaagcttaaaggctcacaccttggaagatatttaagtaggaaagcatattgcaaagttcataagattgttctcctagtctattttaccactgtaaaccctctatttaagtatctagctgtatgcatcttccgacatctaaacccaattaaatgccaactgaaatagccttaaattactacccctaagtaattccctcctacttccataaataaaacaaggaaagtaaacagcactaaaaccagctgtgatgtccttcacacacacacacaaaaaaacttctttttaaaagcaaagttttctgagatattaaatttgtaagaggaaaaaatcaacacagactcattcattccccaaatgtgctcacaatttttaaagttttaatattaccatattagtccgttctcatgctgctataaggacatacctgagactgggcaatttataaaggaaagaaattaaattgactcacagtttcacatggctgggaaggcctcaggaaacttacaatcatggcagaaggcaaagcaaacacatccttcttcacatggtgacaggagagagaagtgaaagcaaagcaggggaaaagccccttataaaaccatcaatcttgtaagaagtcacggactggcacaagaacagcatgagggtaactgcccccatgattcaatacctcccaccgggtccctcccaccacacatggggattatggaaactataattcaagatgagacttgtgtggggacacaggggacatagccaaaacatatcaaccactttattcttactcctagttattataaattactgtattttataataaagataatttgtgaaaatgagcttaactgtcatcttttgttttacttttccccagtttcatacacaatatccaggtgccacagaaaaggtaactagtataaaggaatttacaaaattataatttatgaggtttattctgtaccttctgcgccttaaaagaggtgatactattgaaatttggaggtgaaaagattttgactctggaaaaaactgaagccttttagggaaccacttgtggccaaagtctacagtagacttatatagcagaaaatgaattaataatggtatttgaagaggaagaatgaagcaagaggagtgaggggtattggaaaaagaagcaaaaaagtgagacagataaaggaagaatgagagcagcttccaagctctataaaggatcatggaaggaggggggttgggaatctaataggtaactttaaacaagaaaaatggtattaaaaccaaatacctgaaaaactaattgatagtgaccaaaagcagatctgtggttgcctgtggctggggattgagaagggagcttgcctataaaaaggcagacagaaatttctagagtgatagaaatcttatatttcaattatggttgtggttacctgaatggctacatttctcaaaactcaatcaaccattaaaatgggtgcattttattgtattcaaatcatacctcaataaagttgattttaaaaattgaatgtttagtaaagcacactcacagacatatatttaagtgtatagaagaaagagaacaccaaaaaggctgctaaaaagaaacttgcacgaataaataaagcaaggaaagcataaaactatcccataatctttaggaacaatgtgttctagaagagtaaattttattgaatactgaagcttatgtttttaaagcctcccattttttcaattcatttcccctagtatcccaaccccaacattctttctaccacattggatcaccaaatccatcaattatatcaactttttagtcacacacacacacaaacacacacacacgcacacgtaccacctcacctcactacaatcacaccacaccgagctgattttttaaagtgttaagtctgcaaggcttgtgaaaaaatatatacatttaaattactttttttttttttttgagacagagtctcgctctgtcacccaggctggagtgcagtggcacaatctcggctcactgcagcctctgcctccggggttcaagcaattctcctgccttagatttgcaagtagctgggattacaggcacgcaccaccgtgcccagctaatttttgactttttggtagagacggggtatcaccatgttggccaggctggtcttgaactcctgacctcatgatctgcctgccttggcctcccaaagtgctgagattataggcatgagccactgcacctggccttaaattacatttaaaagaaatttggctttaagtgtatcttggctttcagtggaggtcccattcagaaacaaggaacagagaagtgacagtaaagctgagtgatcaccatattgagaaaattctacacagagggaggaaaataagccaacaaaaacaaaatagttcagtgcatcaagggaatcataaatagtcaatctcgctggaaataataagggggagaagaggagactggacatgcacatagcaaagaccagccttagaagtctgaggacgatagccattgattctgtgacaatgaaacctgtgttttgttcattagcatgtccctggaccgtaacaattttctaggatgtactgggtgctcaacaaatatttgacaaatagatggacagatgggtggatatatgaataaataaatgactggcctgaatcatggagggttttgtttgtggtaaaaagtctggactttgatctaaaacccagcttttgctaaccataataatagacaatcatttatgaagtatgtcacaagtaatttgttagaaattaaagtcaaagtaccataatttgtgaataatttactttttaaatttaaattagagtctgttcaagattacccctacattactaccttcatgttcattccttactttactgagtggtaaagtaaggaattttagccaattcaccaataaatgcacatctattataagctgttattgatagtaaattaccacggctaaactactaataactgtggccattataaattattgaagtctgtacttcctaaaaaataaactttaggtaatcctagcactttgggaggccaaggcaggcggatcacgaggtcaggagatcaagaccatcctggctaacacggtgaaatcccgtctctactaaaaataaaaaaaaataaggcatggtggaggggcctgtagtcccagctactcaggaggctgaggcaggagaatggcatgaacccgggaggcggagtttgcagcaagctgagatcgcgccactgcactccagcctgggcgacagagcgagaatccgtctcaaaaaaaaaaaaaataataataataataaaataaactttagcatttctcaaagttgggcaaatcactgaagtatacaaggcatgtgaaatcaccagtcatgtgactctaatgaaggcaacagagagtcattgaataattttaagaataggattgatattatgtaatttgtgctagagaaaaatcacttttgtggcaatgccaattagtggagcgtatgagacctgaggcaggagactgctacaaaagtataggtgagaggtggagaaagtctgaaccaagatagtagcaacaaatatgtagaaaagaaaaggacaagagaagtaaataagcaataaaattaagacttatgcatcaattagattcactaccttaggcaaaatggctttgcttaaacaacaaggtcaaacagcatataaaagaagagggtcatactaggtaggaaagataagaagttctatattagacatgctgacttggatacaaggatgccaaactgagaaaaagaggtctggaatagaggtactgattcaggattcctgaaacagaggtgtaaaagcctagagagagtgcatagagttagcaaaagagaatgtcacacagacagaacctggaataatatcacttttaagataaacagcaagtatttgggcttctactgaaccccaaaaagaagatgcacataatttgaatcatagaccgttagttcctccaagtagagttcctcttagtgtaatttcatgcatagtataggcatttaataattaaaatgaataattagaaagccaaaactaaaaagaaagaaatcatctatactacggctaggaaatcagtttcaagactaactgcagtcattttcgcatgactatctataaaactgtgtcaatagactctgaggtcaagtatggaattcaaaggaaagactcccataactctcaggtaacattaaagccatgggctcaggacaagagaagcaatcattcgtgtgtcacatattgccactattgatattttctgtttattacatagtttattttttattttagtatataatttaactatgaaaataatacaagtaaattgtaatatcaaacaatacagagataaatgcagaaaatataaataatattccccaacctgctctgaagtcttattccccgaaggcaacaaatactcaacaagagtaaaatgttctgcatttatgctctcactcctttctcctgctcataaaagggttttgttttggtttcatttgttcataaaattattatcaaaggaagacattatgacataggaagcattatggcatatggataaaattgctaatgtccaaatttattgttagagttgactatcatttattattgtttaaaaagtattttctataattatatgtaagattatatttttcttctctaagaaggtttatcagtagtttgcctgctacattgatttttatcagcgacccaaatgacttctaagtggcccattccaatgttcaagtttcagtcttcttggcagcatttgacacagctggtcactttgtccttgagatttcaagtagtgttcttaccagcttaatgaagttccttctcagattcccttgctattcctcctcattcttctgacatctaactgctggagtacacacacagtgcccagtcctcagaccttttcttttctccatctgtactatcatccaattccatgtcataattgccatctttattctgtctacctcaagtatgtatcttcagcccaacctctctatcactcagcatcttcattttattgcctaacaggcattcaaaattcatacccaaagtaaactccccatcttttccttaccccaaaatattaccattgatcattaaattgggtgagttggttattcagcaaattgattgacaacttagcagatatttacctccacccctctcattaatctatccactgaagaactgaccataataatatctaaagtatctcagtaacggggagggggaactaagaattttatattcagcaaagttgtcctttaactataaactaaactgataggccatctcaaatatattaagaacttagtaaaattaagcactttgtaagtgcttagtaaaaagcacttacaagtgcttccttaacaaattcccagaccacaaaatctaaccattcaaacaaacaaactcagtaatatcgaaataatagtaatagggctggtgttgagcacaaactctatttttaaatggaacaaggaacatgttattaaatagctttaataactacagttacagaacaaacaaaaaatgtactaaatcaatgtataaagaataagatatcaaaaatcagaggagggggaggggatctgttaaaaagtatgtttgttattttttcatcttttatagaaaatcactagtgattgcactgctttaatatgttaactttgtgctctacaagcctctacataactttcaaacatgctctgttcctatgaccatcactacattagaatagaaaacaattgaaattgactcctaataaatagtcgtacttgaaagaaaaaatatgttaatttcaaactcttagactgagtttattctttttgaatagtgataatgggatttgtaaatcggctatatcatttatggtaatgaaatatttatctgagtggaatcaacagctcctccagttttatttcaatctctctttcttatgttaaattcaagtaaaagtaaattaatacttggtatttaaaatgccatgtatactgtgatcccattttcctaaaattacatctagctatattttgctcaatatagacacactgagaaatgtctggaaagatgttcaaatgctgagaatggttatttctggaaagtggaatttggagtgtttttctgcgttcttatttttctgagttgtttaaattttataataatcacatcattttataacaaaagctattaaattttttgtcaagggccttagtacaaacagaaatattctaatagttaaatctagtaactcccaccaccaccaccatcaacaaaagcaaggccttttgcagttcaaaatacatggaagggatcaaagctcagagggaaagacctcaagatcttgcttttttgggtatgacattgatctcatctcttcaacagtaatagataattttggttttatgtcatctagccatgacagagccattcattgcatcattggttgagataatatagcataaagtatttaacagcaaccaccctaaagatgacaatatggaaatactgcttaatggacagaaatttttttatctgtaaaatagcataagccatgttttacctcctcacattcagaggaggtgattaatgattttcccccttgaaaatataaagtattttttaaatgcctatacttccaaatccatataataattaagtagctctgaacttaacctttcaaaatttattctaaagggtttcttttactttttattctggctttcaaaatagtaaaaggcattattaaattcctttccgtagctgtcacccaaattgtacctttagcacacatataccaccgatctatttgcatctaacatttcatttctttatgcttaaaagcagtaaatgtttcaaaaactgtagatcttcttttcagcataattttcttttgaaagaaaaaattagatagcaattatctgttgatttcataagcagcacatatcatcgggttttgttttgttttgtttttttctttttgtttttttctttttttgcttcttttttaaattttattattattatactttaagttttagggtacatgtgcacaacatgcaggtttgttacatatgtatacatgtgccatactggtgtgctgcacccattaactcttcatttagcattaggtatatctcctaatgctatccctcccccgtccccccaccccacaacagtcccccgtgtgtgatgttccccttcctgtgtccatgtgttctcattgttctttttttttttttgagattgagtctctccctgtcgccaggctgcagtgcagtggcacaatcttggctcactgcaacctccgccttccgggttcaaacgattctcctgcctcagcctcccaagtagctgggactacaggcacccatcaccatgcccggctaattttttgtatttttagtagagacagggtttcaccatgttagccaggatggtgtcgatctcctgacctcctgatccacctgactcggcctcccaaagggctgggattacaggctgagccaccgcgcctggccatcatcgggggttttaaggtcaaacatactactttctggatctgtgttcagtaggtatgctttggccatgtttcacccttttcaactagaccttcttggtgtgactgttgcagagttgccaatgagagaagttaactttaaagtcagctttagtttatttttatagcccttgtgaaaaaccacagttgaatctctttaaaatcaggagacagcttaataaactttttctttgtttgcatataatcataatgggggcaaaagagggatggcttaacaggcaatgaaaaccatttttttttttttacataaggagggatagatgtgaggtgtaaagacatttaattgaattatcagacattctaatatgtaggagaaaatgcctattaggtatttactacttgttttaccccctacttactcaggattaggcaccccagtccccttctattctaaaccaaaagaaataattgaacacattctgcctgaactatcctgaagcagtgtggcatccatttattatcaactacattaataattaggattctcctaatcttgatggaaagattgaaacattaatgttctacattttatcccccattctcccactgaagatcatgtgaccttaagcaagctacctgtcatcacttagggcttagttttccacctgtaaaatgatggaagttaccctagatctgcagttagtggatgttgggggctcacagaatcaaaagaaatgaaaactaatggatctttccccagtaaaatgcacacatgcataaaccaaagaacaaacaatgttctacaaggtcccatatggtatagccagcagtcctctccccaaaccctaattttccaccttcatctccatgttcactctgctccagctacattggcctccttgctctttctcaaacatgacaagcagactatcaacttagggtaattgcattgactgttctcctcacctggaatattcctttttacctccaagcctttgctcaaatgttgccttctcagtgaagcttactctgatcaccttatttaaaattgcagaccacgttgctttccagctttactagcccttgctccttgctgtaaaattattttccccaatgcacttgtcataatctagctgttcacaaaaaacttaacatagcagacctaactgctacccttcaaaaggaaggcttaaaaggttggtccttggctggcatctagaaacttgggtttcaggagggtttccacatgcctagaactggtaagagtagctcactatacctaagtgtttgtgcaaacaatgtagtttatgctgaccatctgctttcctttggccagtatacaaatttggtatgtgctaggcagagggagggtgctgtgtgatcagcccccaataaaaaccctgagcactgagtctccaataaactgtactggtagacaacatttcatatatgttgtcacaactcattgctggaaaattaagtgtatcctgtgtgacttcactaaaagaagtgtgtaacttagtctttcccagactttgcttcttttcccttttctctttgtggatctcgcccaatatctcttcactgtgataaatcatagctgtgagtaaaaccatatacaagtcctgtgagtcctcctagcaagtcatagggaccaggggtaatctccggtaaccccaacccggtagcacactaaaatttactcatgaattatgcctagcacataaaaggtgcttgattaatatttattaaataagtacatgcaaaattttgcaattaatttaagaaagttaatggagctccctaaaaaaagtgctaatcattgatactggtaaggactcctttccaagatgctctccttataatttgaagattcaaaattctaagcaatggccaggtgcagtggctcacacctgtaatcgcaacactttgggaagcctaggcagatggatcacttgaggtcaggagtttaagaccagcctggccaacaaagtaaaactccatctctaatgaaaatacaaaaaatagccaggcatggtggcgggtgcctgtaatcccagctactttggaggctaaggcaggagaatcacttgaacctgggaggtggaggttccagtgagctgagactgctccactgcactccagcctgggtgacaagagcgagactcagtctcaaaaaaaaaaaaaaaaaaaaattctaagcaagaagatctgtctctgaactagtttctcttcctgaaaatgcttacatttatggaaaagtagaaggaactgtatatgttttagttggccaaactaggcacatgtcctcagaattaagtgtgacggcatgttgtaaacttggtaaaaaccctggctacacatgagcccttgatggaaatatgaggtttccatttttcttggataccatagcttcaaaattagatttgggaaagcctcttaaagccagacttttgaagctcagtaatcttctgagccaagttaatctagagggagtctcacggcctcctttaaaaatgaaaaacatggaaagttaaagaaattttaaagaggaaattagaaaaagccaactctgagaacagagccaatctttgagtatgtgcagaacatatgagggaggggagaggaagaaaaagttgttattactgttaactgaatcctgtcagaatcaaaaaacaatgtgcaaagccctctcatgtcagcaatactacaatagagataaccagcagcttgggtgcaagcctacattttaaaatatttaatcttttctggtagcaagaaatattggccaatatatttattttggcaagaaagatgcccacttgtagacaaaatgctcacagaactaaatttcatgctgggtactcaaagggagcatatgagtaggttctgttatgggggcatagtaggagttcaataaatgctagtgaaattaataagcatgcctggtaggtattcaataaatgttagtgaaatgaataaatgtgtgcaagacactgggctacacgttgattatagccttagtgcaaatcatacaggtcttaattactttctatagtaagtctgggcatattacagaatttgggggagattacaaaagcagacccttagtcagtgaattaaaagaagagaattgagattggaaggaaacatttctgctgtttttaattaacaaatcctaaagtagttattttagctgttaaaatagattctaagtctttattcaatttttgcaaattttatcactaaattacttagcaatagcttcttctctaaaccatcctccctcctgctccaccccacacaacgcttttggttccattaaaacctgtaagaatcttgatttctttgcagaaaaagttctttgtggcccaacactaactgcacttaacatatgatcttatcatgatattgttaaaaactgtaaaacctcaaaggtagccaatttcaaagagagaagataagcactaattattcaatcaccaatccccatgtttatagttgcaaagtgcaatcaagaattaatttttaagctagtctcaaagcacctaagagaagatagattaaagatgcagaaagaaacattctaacttctttacacactgaattctatgtatctctagaaggagcctctggaattcccatgtcatcagttctttgatggaagcatttatgtgattctactcttcattcctacttatgacttaaacagcccgtatcttcagtcaggattctgcatgattaagtgccatcctagaccaatgggacgggtctcaacaggcagatcagcggcacccagagggaaagaaatccacatcagatcccaacacagaccataatcttttgaccataccatgtagatttcttattacattcatgagactggtttcagagccctcttcttaccttatcctaaactttctctctagatgatctcaaatgctgccataactttaaatatcatctctaagctgaaactccaaattttaaatctcgagtccacacctctcctcttaaattcaaactcacatatacaacttgatttctgtttttggatgtctcacaggcattgcaaacttgtatgcaaaattgaactgtttcaccctaccacacaccttggatctgcttctcttcaacttcttccatccctataagcagcccctccacctactcatttgctcaggtggaatatttgtgtcatattaatatttatttttcacctccctccatacacaccccacattgaatccatcagccaggcctagtgtgtgcgccacacagatcacaaacctgtcaaaccttttcttatacactgacaaggtcctagtccaagatactgtgtcatttttcacttgggtttcagcatggggagaaaagtccatgcttatacttgaaaaaaaaagaccttttataaaattataacattacaaattttaaacaggcatttaagaagtctcatacgtgtgttcaatggaacacacttgtgtttctttttcttttttatttataacttttattttaagttcagggtacatgtgcaggtttgttatataggtaaacttgtatcatgagggtttgttgtagagattatttcatcacccaggtattaagttcagtacccagtggttatttttccggatcctctccctcctctcaccacccacctttcaataggcccaatgtgtattgttcctttctgtgtgtccatgtgttctcatcatttagctcccacttataagtgagaacatgtggtatttggtttgctgtttctgctttagtttgctaagaataatggcctccagctctatccatgttcctgcataggacatgatcacattttttatagatgcatagtattccatagtgtatatgtaccacattttctttatccagtctaccattcataggcatttaggtttattccatgtctttgctattgtgattagtgctgcaattagcacacaagtgcatgcatctttataatagaataatttatattcctttcagtatatacccagtatttgaattgctggatcaaatgatatttctgtctttaggtctttgagaaatcaccacaccatcttccacaatggtcaaactaatttatcccacaaacagtgtataaacattcctttttctctacaatctcaccaacatctattatatttggactttttaacaatagccattctgactggtgtgagatgatacctcattgtggttttgatttgcatttctttaatgatcagtgattttaagctttttttcatatgattcttggccacatgtatgtcttattttgcaaaatgtctgttcatgtcatttgcccactttttaatggggttgtttttttcttgtaaatttgtttaagctccttataaatgttggatgttagacctttgacagatgcatagtttgctaaaattgcctcccattctttaggttgtctgttgactcttttgatagcttccttttctgtgcagaagctctttaatttaattaggtcccatttgtcaatttttgcttttgttgcaattgcttttggtgtctttgtcattaaatcattgcccatgcctatgtacagaatggtattgactattttctcttcagggtttttatagtttttggttttgcatctaaatctttaatccatcttgagttgatttttgtatacggtgtaaggaaggggtccggtttcaatcttagcatatggctagccagttatctcagcaccacttattgaatagggaatcctttctctattgcttgtttttgtcagctttgttgaagatcagatagttgaggtgtgtggccttatttctgggttctctattctgttccactggtctatgtgtctgttcttgtaccagtaccatgctgttttggttattgcagccttgtagtataatttgaagtcagggagcgtgatgcttccagctttgttctttctgcttaggatggtcttggctatctaggctcttttttggccccataagaattttaaaatagttctgtgaagtgtttcaatggtagtttaatagaaatagcatcaaatctctaaatcactttgggaagtatggccattttaacaacattgattcttcctgtccatgagcatagaatgtttttcgatttgtttgtgtaatctctgatttctttgagcagtgttttatagttttccttgtagagaacttttacctccctggttagctgtattctgtggtgttttattttaccttttttgtgtgtgacacctgtgaatgagattatgttcctgatttgattctcagcttgattgttgttggtacatagaaacattagtaatttttgcacattgattttgcatcctgagactctgttgcaaaactgttgaagtcgcttatcaggttaagaagcttttgggctgagatgatgaagttttctagttataggatgatgtcatctgcaaaaaagggatagtttgacttcctctctttttatttggatgctcttattttctttctcttgcctgattgccctggccaggacttccaatactatgttgaataggattggtgagagaaggcatccttgtcttgtgctggttttcaatgggaaatactagaaatgcttctagcttttgcccatcagtatgatgttgactgaatgagtttgtcatagatggctcttattaatttaaggtatgttccttcaatacctagtttattgagtgtttttaacatgaaggaatgttgaatttatcaaaaagccttttctgcatctattaagataatcatgtggcttttgtttttacttctgttatgtgatgaatcacatttattgatttgcatacattgaaccaaccttgcattctagggataaagcctaatcgattatggtggataatatttttgatgtgctgctggattcagtttaccagtattttgttgaggatttttgcatcaatgttcttcaaggatattagtctgaaattttctcctttttttttttttgtcttgccagattttggtatcaggatgatgctggcctcatagatgaggtagaaagaagaccctccttctcacttttgtttggaatagtttcagcagtaatggtaccagctcttccttgtacatgtggtagaattcagctatgaatccacctggttcttggcttttttgattgataggctatttattacggctcaatttcagaactcattattgatcaattcagagattcagttcttcctggttcagtcttgggaggttgtatgtgtctaggaatttatctgtttcttccagattttctagtttatgtgcttagaggtcttcataatactctctgattgttatttgtatttctgtggggtcaatggtaatgtgtccttgttgtttctgattatgtttatttgaatcttctctctttccttctttattagtctagctagtggtctattttattaattttttcaaagaaatggttcctggattcattgatctttaaatgctttctcgtgtctcaatctccttcagttcagctctgattttggttatttcttatcttctgctagctttgggatttgtttgctcctggttctctagttcttttagttgtggtgttaggttgttaacttgacatctttctaactttttgatgtgggcatttagtgctataaatttcccttttaacactgccttagctgtgtctcaaagattctggtatgttgtatctttgttctcactggtttcaaagaacttcttagtttctaccttaatttcactgtttactcaaaagtcatttaggaggttattcaattcccatgaaattatgtggctttgagtgaatttgttagtcttgatttctcattttattacactatagtccatgacatggtatgttatgatttcagttcttttgcattttgtagagaattgttttacttctgattatgtgatcaattttacaatgtgtgccatgtggtcatgagaagaatgtataatctgttgttttggggtggagagttctgtatatatttagcaggtacatttgatccagagctgagttcaggtcctgaatatctttgttattttctgtcttgatgatctggctaatattgttagtggggtgttaaagtctccccctattatattgtgggaatgtaagattctttgaaggtctctaagaacttagtttatgaatctgggtgctcctgggttgggcacataggtatttaggatcttcttgttgacttgacccctttactattatgtaatgcccttctttgcattttttgatctttgttggctggcttaacatctgttttgtcagacactaggattgcaacccctgcttttatctgttttccatttgcttggtatatttttctctatccctttattttgaatttatgtgtgtctctgcatgtgagatgggtctcttgaagacagcatactatgatttttggttctttatctaacttgccactctgtgccttttaattggggcatttaagccatttacactcaaggttagtaatgatatgtgtggatttgatcctgtcatcatgacgttacctggttgttttgcagacttgtttatgtagttgctttatagtgtcacttgtctgtgtacttcagtatgtttttgtagtggctgacaacagtctttcctttccatatttagtgctacctttaagagttcttgtaaagtagttgatggtaacaatttccctcagcatttgcctgtctgaaaaggatcttatttctccttcatttatgcagcttagtttggccggataagaatttctgggttgaaatttcttttctttaagaatgttgaatattggcccccaatttcctctggcttgtatggtttctgctgaaagctccactgttagtctgatgggcttccctttgtaggtcacctgacctttctctctagctgcctttaacactttttctttcatttcaaccatggagagaatctgattattataggtcttgagaatgatcttcttgtgaagtatcttaggggttctctgcatttcctgaatttgaatgttggcctctttagctaggctggggaagttctggatgatatcctgaaatatattttccaagttggttccattttccccatctctttcagggacaaaaatgagtcacagatttggtctctttacataatcccatatttcttggaggttttgtttgttccttttcattcttttttctctattcttgtctgaatgtcttatttcagacagccagttttcaagctctgggattctttcctccacttgttctattctgctattaatacttgtgattgcactatgaaactcttgtagtgtgtttttcagctctatcaggtcaattagattcttttctaggctggctattttgactgtcagctcctgcatcattttatcatgatttttagcttccttggattgggtttcaaaatacttctgtagctcaatgatctttattcctatccatattctgaattctatttctgtcatttcagccatctcaatccagttcagaacccttgctggagaggtgatgtggtcatttggagcaaagaaggtactctggctttttgagttatcagggttcttgtgctgattccttctcatctttgtggacttaccttccttcaatctttaaaactgctgacctttggatggggtttttttccttttatcctatttgatgaccttgaagtttgattgtggtataaagtgaattcagctaactgccttcatttctggaagattttacagggccaatgcttagctcccaactcctggactgcatgctgtaactctgggggacttgtattgagccccaactttgttctctggctccttgaggttaggaatccacttcactggggaggtgggggagaatgaggtgctcccagaccactggtcagtacactccaacgggtggtgtcagccaaagtgtttcagagtgcgatgacagtgggacccattcttgctcacaagtgccagtagcagcagtagcaacagctgtggcatagtgggtggcaggtgccaggatgcctgcctccctgcaagtgttcaccacagtggcaaagtcaacgcagctggggggcctccgctggtgactgtgtgtgtggtcaccctgaaggtggtgttttggctcaggagtggggcactgatgggtgcaggtctgggtgtataggtctctgtgcctcgcaagcaggaatgattgctcaggcatgggaggatccaccattctctgcagagtgttaccataagggcagagcactggcgggggcagggctggctgactctgtgcccaccaagactctgtctgcaacagaggtcagtggggagaggaagggtagactgcacacccaaatgctgatggtcaagaaaagcaaaacccacctccacagacacatgccagcaaagcaatgtggggagttgccttaggcctaaagaaagctgcagtatgggagggagcatgggggttggtgcatggctgtaggggccatcctgctggagctctctaccagtcaggcacaatctgccagtgcagaagctatggtgtgggaccccagggcacccgaggctgctctgcaagcaggtgtagccaggctggggctctgggaaaggacagcagaccaaggggttctcaggtcagactggcctcgtctgatgggcaagaccaccctgcagagttcaggactgacagttcccctagtcctgcaccaaactcttcgggctccacatcagctggctgctgcccctaacccttctctaagcagctctccatgccatcttgagtgtccatagtggtcaaggggtctccccctgccagggttccagaggcctgtggcaaaagcagtttgctccttgccagtgcaactcacctgttccctcagagccactgggggccaggaatgagtgtgggtatactgtagccccatgtagcgtttccagctttctcacccttcagcccagcttctgcgtcttccctctgtccattcttagtgcctttatctctgaagatgtgttaggagtgtgtcagtcatctgagtcccttcatgagagccgttccacctgcctgcgtctagttggtcatcttgtcccccaccaattctttttctttttttatgattaataggatattataggacttatttggttttgaaactttttcaatataaacatacataaacacatgtactttttcattgtaccataaatgtagcataatattaaatatcagaattctgatttgtaacatccagataaacccataagtgatttttccagtaatcactctttctaattgatttatccattgatcctaccccactgatctaatgtttaatataaaatggcaaatgggctgggtgcaagggctcatgcctataatcctagcattttgggagaccaaggtgggtggaccgcttgagctcaggagttcaagaccagcccggacaacatgggaaaacccatgtgtactaaaaatacaaaaattagctgggcatagtgatgcatgcctgtagtcccagctacttggagtgctgaggcaggaggatcgcttcaacccaggaggtcaaggctgcagtcagctgagatgatgccactgcactttagcctgggtgacaaagtgagaccctgtctcaaaaataaaatcaaataaaagtcaaatggtaataaatagtaacatacttaaagtacatttggtttgctacatggatgtggcaagggagttttaccttgatacttgtaagttgtattctaatatttggatcttcctcattactttaagaaaaaaggaaaaccactcaggccctgttgcccaattattttacatttacagcatgattttgaatgtagaatatacatacatattgtcactgttcttataaagtaactcaaatagatgattctaaatattaaaatgggaagagataaaaaactcaaatcaacaaatatttacggagggcttactatgcacaaatagtgaagctacttacaatccacattgttaagtaggtatgaaatgagcaattagctgcaagttaaagacactcaaaatcacagtgcttcaaatgagacagaagtttactttgctttcacaaaaaaagtctggaggtaaagtgctcctgagctgatgtagtggttctgctttataaaatacctaggaacccaggcgtcttccaacttctcactccgccaccttaggtgtggccttatcctcatagtccaagatgccagctagagttccaaccatgacatccacattccaggcagcaggatagagccaaagtgtgcaggtagactaacttttatggaagtttgcaaaagttacccaataaaaatttcacttatatgtcattaatcttacttgcatctcaaagcataattacagctgcaagggaaactgggaggtatagctgctattactgttggtcattaatttagcaggattctgtttttagaagacaaggacaattcatattggaggcaacatctcactgtcacatctctctcctgcatgtttcccaaaactcaaatttctgaatgttctgtgtctattctgcccagccatgctgtaggaggcagcatgaagcagctcttaaatatttctatatttaaactgcctggatttgaatacagtctccaatgggtcctcatctgtgaaatggagataacagtaagatctactcctaggagctgtaaagattaatcagttcgtacatataaagcgattggcacagtgactgacacactgaaagataagcgcagcatatattactatcattatatcaatttagtcaagaggaaatggaagtaacttaactacaggcttaatagcttcctacacaggatcatgggaggcagtcagaagaacagagttaccactacagttttcatggtgagtcctgctgccaccccagtaccgtccataaagaaaatagagaggaactgacttgtataaagtgtcattttctaaaaaaaaaagctccttattcataccacattaataaagttaggcagaaaatctaaacatacagatcactccccaaaccttcctcagacgatacctgggataaactggtatttcaccctgccaaagagaagtaaaatacggataaaggaaaagcaattacggcaatttgttaaaggcatccagcaccaaagctaagatctgaattcaaaatccctccccactaatcctgtggacaaaatggtggaattcatacttgctgaaaccacctttacttataaatattatgaaaatactttaaaccacaaatcaagcaataaaaatcaggtttagggggaaattttctgggtatttttttcccacacacattcaaaattgcttttaagtctttactgacaaaagtgacattgttttttaaaaataaattgggaatacagaaactgccagattactgtgttggagtagtgttgctgggatatcacctctcttccatatttcccagtcttctaatgttaaatttaggctcctgttggcaaactgtttttcttcttttatggcacaaaatgattatcttacttcaactgccaaagtccaagcttgagacatgcaggataaagaaaagtgaataaactgctgtgtttccattttccaacatcacttgcaggcagcaggaagtcacaagcataaagtcacagggaattatcacaaagacaaaacaattcatttaaggctatttagaagcatatttttttatttttgctcccaaatgttgtctagtcatagtattgtgagaatcaacaaaggattctcctccaactgggggagggccgggggagggacagaatgggctagttcagatttggaacagtgacctagaaggcagttctatcactcagctattcaagtgatgtggccatctgaacatctttcccttccttggtagcagagtgagatgaatatatatgtgttaacattcttgagatgagatatagtatctttcctagccaaacataacttctccaaagccaactttttccacatgctttagagtaagaaagataatatttttagagatgttgagaacttttaggctttatcactaaaactgaattcacccagtgaagaggaaccctaaggaaaatttcaaacataatgtcttcccagtgaatttcatctttactcctgaatctgaggcaataggctactttctcccttattaaacataaagaaaaataattacttaatgagagaatatatagccattctcaataaaagcaactgggattccacaaacattactatgtcatgactgaatgaatgaagtgctaagataaagagtttagaaagaatgaaaaacctaattacttataggaatctgtgtgattaagtctagaaaaataaaaggaagaaaagtgcattagtctaatgagatgtagacaaaatatttaaaattggctcaaagtgtttggttgaattatcttgaataataaaagattaaatttcctagaaaatctttgttccaaagtaaaatgattttctgattcatgcttttgaaactttataaagtgaaacaaaagggcattttcctattctttttagtgttgaaaaatggtaactgggcctcagcagaactgaatttgggaacctaaatggcaaacctaaaaattcacttaaagaaggtgaattaggaaactttgttcctcataacagagctccagtgcttgagaactaaagcataaaactactttctgtgaactgtagagatagatttctgtaagatgtctgactcctccattaggaactagtgatccacatttttaaataagcaggaggttcatggatacagatcccattttttgagaaatgttgacctaaacaacacttacctgttctgttgatgcagaatgaaatcaggtaaactgccctaagcttcctcaagatctactcaagctcagtttatcctgttagcctatatctatctctttttctttacacattttttaaaagcaattttccctaatttcatatcccatgatttggagtcgattgtccactctcaataagaaggtatttctcctacagctctaactctggaactgttttatgaaagcttgcaaacagttagtaagcattacactcacctctgaaagatttttcctacctgtaatttaatttagctccaagctatagcacgtgaatgcccctgcattctttatatgactctttacgtcaagtctctacacactggattatatgaagatcccctatgattcacacagtcaataaataaatcaacaaaaatgtagaaaggaaggaggaggatccagttttagatagtaaagatcagaaagaatagtctacatactttatcaaagcgtactgcaatgaaaagtgtaagcatgactactttcaaatgcagattcctagcatgttcatttcctttgttcttcaagtattcatggaattaaagaaacaggaaacaatcagttatgtatattagtgcttccttcactgcactaggtcatcataagcttctgatgaccaaacagaactaagactaaaatggctgatgttcctaaaaacctcccagttgacccagataataagctaggatcaaaaataacaacaagccaatgcagcttttttctctaagaaattctgttattgctgttattagatttacagttacattgggatgctaagatttcttgctgtatttttatggtaattgcagttttatatacataatatcatcaacagctcatatattctgtgggctggttttatgctgggttggatttaaatgctcttcaaggaactgtacttttttgtccccatttaaaaagactgtagacaggtcagataataatagcaataactcagaaacctgaagattagaaaattgaataaggctgattctaaaaaggcatggaaatttcatacccatgctattttgttggctcactgagtacatgatggagtaaaaagaacattgaaactaaaatctgggaacatcagctctaatttcagctatcacactgtcctttaaggtcactggcctccttgggcctcagttgcctcatgtgaaaaatgagaggtctactagattatacatggcacttactttcatctctcacatcaattacaatcaactgataatggctggctgaagcactgtgttaagaaggattatgaggctgattctggacaaaagtagagtgtcatgggtgatttgctaagtcttccataaggacattgaggaaatagctgtacatatgcaatatattttccttatttgacccaaaggaccactaggatttcctttagttacagtctataaagcatattttacaataaaatatcataagatcctttatacaaaatgtttggtcttgttgcttcctccagccacccaagctgctgaaaggaaagaaggccaaggcagagaaggtggttctagtcccttatcataaagaagcagaaggccaacaaggtggtgaatcccctgtttgagaaaaggtctaagaattttggcattggacagcacatccatctcaaaaggaacctcacttgttttgtcaaagggccccactgcatctggctgcatcagcaaaaagctatcctctatgaatggctgaaagtgcctcctgcaattaaccagttcatctaggctttggactgccaaacagctactcaaatgctgaaactgacccacaagtacagagcagagacaaagcaagagaagaagaaagctgctggcaaagaagatgttcccactaagataacacctgtcctttgagcaagggttaacactgtcaccaccttggtagaaaacaagaaggctcagatggtagtgactgcacgtgatgtgggttccatcaagctgattgctgagggctcgccctgtatcctaagatgggagttccttactgcactatcaagagaaggcaagcctaaaagacatccagtccccaggaatacttgtgccactgtggccttcacacatgttaactcagaagacaaaggagttctggctgagctggtggaagctatcagtactaactacaaggttagatataatgagatctgtcagcactgaggaggcaacatcctgggtccaaaatctgtggcttgcattgccaagctagaaaaggcaaagactaaagaacttgccactaacctgggttaatgtacactgttgagttttctgtgcacaaaaacaatccaaattctttaaaaaacagcttggttgtatagattatctataaaatgatttctatattgaaaatcacttaacttcatgacactgtttcctcaatagtatacacacacacacacacatatacacacacacattgatgagaaaaaaaaatctactgccagccagagccactgtcagtatggggtttccacattctccccatctgtttgagttttctcgtgggacaccagtttcctcccgtatcccaaagatgtccacattagattaattattgtatctacaatgtccaagttggagtgagtgtgggagtgtgtgtatgagtgaggctgcaatggaatggagtcctgtcaagggctggttcctgccttgcaccctgacctgccaggataggcaccagccacccacaaccctgaacaggaataagcaggttggaaaatgaatgaatataaattattgtaaaataaatttattttgacaccaaacagtggggtccaaaagtgctcagcaagcctgccatatttattgtttgtttttgaactgtgtggtgataggaggtgctccttataattctcactttgcaaacatttattccttgattcaacccatcaccactacaaccactatcactcactgattcaccaaaacttgggtaaataattatcttacttgtttttattaatctttcttgaatgtatgtttggctcacatttatttcaatgtttaatattaaaagtgttttgagtctttacttagaagtttgatatttctatgacaaacatgctgtaggagcttactgcttgtttatgtaaattagcctaaggtaaagttagttttattacatatcattttgcttaaagttgtagtctccaagaacctatcgacaacgttgagaacttactgtgtgtaaatgtgtgtatataaccttgttttattgtgcctcactttatggcacctcacaaatagtgtttttttttttttttacaaattgaaggtttgtggcaaatcggtgtcaactgctatttttccaacaccatgtgctcacttcctgtctctgtgtcacattttggtaatttccacaatatttcaaacttcttcattattattatatctgttacaatgatctgtgatctatgttaccatcgtaattgttgtggggcaccatgaacagcacccataaaagaaagtgaacttaattactcaatgttttatgtgttctggctgctccaataaccagttgtccccatctcctccatctctccttctcctagggcttttttattccttgagatacaatgttgaaattaggccaattaataatcctaaaatgactctaagtgttcaaatgaaagaaactgtagcaggtctgtcactttccaccaaaagctaaacatttccttaagccaaaacctaacccagagcaagacctacctcttttcaattctatgaaggctcagagaagtaaggaagcttcagaagaaaagttggaagctcgcagaggttggtttataagatttagggaaagaagtttccttcataacataaaagttcaaggtgaagcagcaggtgctgagggagaagctgcagcatattatccaggagattagcccagataattgatgaaagtggctacactaaacaacagattttcagtgtagacaaaacacccttttagtagaagaagattccatctaggactttcagagctagagaggaaaagtcaatgcttggtttcaaagcttcaaaagacaggtggactctcttgctggggctaatgcagctgatgactcttaaagtcatcaacttaattgaagccaatgttcatttaccatctgaaaatcctagggcccttaagaactgtgataaatctactctgcctgtgctttataaatgtaacaaagcctagatgacagcacatttgtttatggcatggtatactgaatattttaagctcactgtggagacctactgctcagaaaaaagattcctttcaaaatattacagttctttgacaatgcacctggtcacccaagagctctgatagagatatacaaggaaataaatggatttttcatgcttgctaacacaacatccattctgtagcccatggatcaaggagtaaattcaactttcaagccttattatttaataaatacatttcataggctatacctgtcatagatagtaattcctatgatggacctgagcaaagtaaattaaaaaccttctagaaagaattcaccattctagatgccattaagagcattcacgattcatgggaggaggtcaaaatcagcattaacaggagtttggaagaagtcaattccaacctgcttgaaaaactgtgagggcttcaagacttcaatggcagaagtaacagtaaatgtaagagaaatagcaagagaactggaattagaagtgaagcctgaagatatgggtaattgctgcaatctcatgataaaacttgaatggaggagtagttgcttctactgggtgtgccaagaaagtagtttcttgagatggaatctactcctggtgaagatgcagtgaacactgtttaaatgacaacaaaggatttggaatattacataaacttagttgataaagcagtagccgggtttgaaaggattgaccacaattttgaaagaagttatattatgggtaaaatgctatcaaacaacatcacatgctatagagaaatttttcattaaagtaacagccaattaataggtctaacttcattgtggccttatttttaagaaattgccacagccacccaacatacggcaactattaccctgatcaatcaacagccatcaacattgaggtaagacccttcactagcagaaagatcatgatccactgaaggctcaaatgatcattagcatttagcaataaagtatttttaaattaacatatgcacagtgtttttggatataatgcaattgcacacttaatgggctacagtatagtataaacataacttttatatgcactgggaaatcaaaaaatttgagcgacactttattgcaatatttgctttattgcagtagtctgaaataaaacacacaatatctccaaggtatgcctctatatataaagagagggagacctaggaaaatacttgaaatgtattaattaatttgtttcatcttcaggagccagattgtgttaggctattcttgtactgctgtaaagaaatacccaaggctgggtaatttataaagaaaacaggtttaattggttcacagttctgcagactgtacaggaaacatggagctggcatttgcttcttgtgagggcttcagtgagcttacagtcatggcagaaggaaagggaagctggcttgtcacatggtgacagcatgagcaaggtgtggggggaggtgccatatacttttaaacaatcagatctcatatgaactcaaagcaagaactccctcatcactaaggggagtacaccaagccatttatgagggaccgagggacctgcccccatgatccaaacacctcccaccaggccacagtttcaacactgggaattacatttcaacatgaaatgtggaggggacaaacatccacaccatatcagagaccaattcttctctttattatacaaatgccaataaagcccaggagagaaaataacagaaaaaaaaattgtagctaatggcaatcactgataaggaatcataaatgagactcagaatatcttaaaatagttgtgcaaatgacaggaaaatcaaaacaaccttcttccagtaaatgtctcatgaagcaattgtgtataagcaaactgcagtagcttgcctacaatagctaacaacatcatctcacttaagatggatgaggtaaaagacatttctgccaatcttgctgtagccaccaaaaagcaaaaaatatgtaacagtcttttcgatgtcaacatttctttgatgatatctgtaaacatttgtttccatgtaacaagcaacctattcttcaaccaatgaatacagcatgagataagagtcataagacttgaagtttgctcccctctttcatggaatcattggggtcttcataacccacctaacctcagctgcctcaataaattatgaaagttgaccaatatttctcttctagctcataagaaaatgaattgaagtcttgtagaatggagaagtggctgagttgcaaaaatccttggagaggctctagaccaggtactggttgtcacctttacatggccatggtgggcttcttgcaatcactcattcttcaggataaattctatccctgagcaaagaaagcaaaatcttgtccttattaagactatatttttattgtcttttttttccaaagtggacataaatcctagcttacctattagtaatgcacacataatcacatcaagtttgggcaaagctaatgacttatccaatatcacatggtggttcaataaagaaattaaatatcacaattcccagatcttgttccaactaaataatggcaatactgaagcaaaattaggatatacacgatatatcctaaggattataggcaaactcaaaagcctacaatgtttagttgttggagttagagtgacaatcagaaatgttaatgtttatccaactccggtattccataaaatatcccagtttcatgtcaaataagttatacctacaatactttttactacggagaactagaaaaatctaaaatgaaaagagaactaaatacaacatgttctgatatattatgctctaggcaatgatcatgttcctaatttacaaagtccatgaaaagaatactcttatgttgaaatagctgttattaaaagtgagtgctcttacagtgaaaatagatcagatgtaacatatctctaagaaattattgttgttctagccattactttgtgaagatgtgctttgttttgattgatttagaaaattgtaataaataagaactgttcagttggaatatgatgtttattccttatgccaatatacgaccaaaaatattttctcacttcagcctagaaagtgagatgtgtattatttatctccaaataaatgtgtaaaaagatgtgtgctttcagtttttcttctttatcccaaaatatttaaatgcctaataaaataatattgttcattaatatattaattgtcctgcttatattttcagtatccaattagtcatttcaagtatgagatatagaaaagaatgcttggaatgtttgctatggctttgtacaaataaaatataatacctaacaagggcaggaggaaggaggagggatttataagtttgcttattgtatttttaaaagtcaaatttcatttaaaattatgtttaaataatattaccagaatattccaaaataaaagtcaaaggtaagaaaaataatgttaaaatcttctcaaatttatgaagaaaaaatgaagtaaaaaataaaaaatcttgtgaaatttatctggtctttcctgaagctctttggtatctccatagacatggtttgaatgcaaaaaactgcccatgcagtgtctatgataagattgcctttaacacactcagcatgctaatatatcaggttcaaaaaatgatttcataattgttttacttaagactaacaggcaaagattgtcctgaatttgctgctctgctgtgtttttgtaggaccaaatcccaggtgcagtttggcctctaagaggcataatctgctccaggaaagccaatcaggaagtcttccttttaactatggcacaaccgttcagattcacctgctactgctgtttccccagaacttctactctaattgaatgtatcaagttgttaagcaattttacataagatgtggcttaaaataagtagctttttatatagaatgaaatgttctgatgaatatagtattacactttgaaaaggaagaaaaacatctagtggatattgtcatgtttgatatttctttttggtgtcaatggaaactgaatagtacatttttttcaacttttactacatattaaagggatggaggaagtagaagcgtaaacagagtaaacagggatggcaagacaaaggagtgttaagtcctcgaggattttacaatctagttattgaaataagacatataggtttttatttattttttcaatttttaatttttgtgggtacatagtaggtataaatatttatagggtacataaggcattttgatacaggcatggaaagcataataatcacatcatggaggatggggtatcaattgtctcaagcatttatcctttgtgttacaatcaaattacacttttagttatttcagaatgtataattaaattattattgactatagtcactctgttgtgctgtcaaatagtaggtcttattcattctttctactttttttttgtacccatttaccatttccatctctgcgtcacctccccacaactacacttcccagcctctggtaaccacattctactctccatctacatgagttcaattgttttgatttttagatcccacaaataagtgagaacatgcaatgtttgtctttctgtgccttgcttatttcacttaacttaatgatctccagttccatccatgtggttccaaatgacaggatcttattcttttttatggccaaatactactccattgtgtatatgtaccacattttctttatccattcatctgttgatggacacttaagttgcttccaaattttgtctattgtgaacagtattgcaacaaacatgggagtccagatatctcttcaatatattgatttcctttctttggggcatatacctagcaatgggattgctgcatcatttggtagctctatttttagtttttgagaaacctcaaaactgttctctataatggttgtactaatttataatcccaccaagagtgtacaatgactcccttttctccatatcctcattagcatttgttattgcctgtcttttgggtataagccattttaactacggtgagatgatgtataattatagtcttgctttgcatttttctgatgagcaatgatatttagcaccttccatatgcctttttgccatttatgtgtcttttttttgcctcaaactccatctattctacatagctattccagttttcttttgattcgtagtttcccagtatatattttttattcttttaatttatttatttttcttctttttttttttttttttttttagacagagtctcactctgtcgcccaggctggagtgcaaaggcgcggtctcggctcacggcaagctccgcctcccgggttcatgccattctcctgcctcagcctcccgaatagctgggactacaggcgcccaccaccatgcccggctaattttttgtatttttagtagagacagggtttcaccgtgttaagccaggatggtctcaatctcctgaccttgtgatccacccacctcggcctcccaaagtgctgggattacaggcgtgagccaccgcacccggcctgttggttgtatctttagctgagtgaatgatttgcaacttgacgtgatcccatttgtcctgttttgttttaggtgcctgtgcttgtggggtgttactcaaggaatctttgcccactccaatgtcctggagattttctccaacgttttctgtagtagtttcatagtttgagatcttagatttaaatattcaatccattttgatttgatttttgtatatggaagagataggggtctagtttcattcttctgtacatggatatccagttttcccagcagcatttattgaagagactgtcttttttcgccaatgtatgttcttggcacctttgtcgaaaatgagttcactgcaggtgtgtgaattagtttctggattctttattctgttccattggcctgtgtgtctgtttttatgccagtaccatgcagtattggttactatagctctgtagtaaatttgaagttaggtaatataatttctccagttttgttttgttttgtttttttctttttttggatggctttggctgttctggctctttcgtggttccacataattttccttttcttttgagtctgactcttgctctatcacccaggctagagtacagtggcacgatcttggctcactgcaacctctgcctcccacgttcaagcaattcttgtgcctcaggcttctgagtagctgggattacaggtgcaccaccatacccagctaatttttgtatttttagtagagacagtgtttcaccatgttggccaggctggtctcgaactcctgacctcaagtgatctgcccgccttggcctcccaaagtgctgggattacaggtgtgaggcaccgcgcccagcccatataaattttaggatagtttttttctatttctgtgaagaatgtcattggtgttttaatagggattgcattaaatatatagattactttaggttgtatggacattttaacaatattgactttttccaatccatgaacatggaatatctttccattttttggtgtcttcttctatttctttcatgagtgttttatagtttccattataaagatctttcacttctttggttaagttaatttctaggtatttaattttatttgtggctattgtaaatgggattccattttaatattttttcatattgttcactgttggcatatagaaatgctactgatttttgtatgttgattttgcatcctacagctttactgaatttgtttatcagttctaacagttttttggcagaatatttagatttttccaaatataagatgatataatctgcaaacaagcataatttcacttcttcctttccaattggatgctctttattttttctcttgtctgattgctctatctaggacttccagtactatgttgaataacagtggtggaagtgagcatctttgtgtgttccagatcttagtggaaaggctttcaattttttctccattctatatgacagatccccagctagtataacactacagcttttattatattatatattttatattttattatattatattaattatactttattttattatagtataatactatagcttttattatgttgaagtatgctcattctatacccaggttttttagggtttttatcatgaaaggatgttaaattttatgaaatgctttttcagcatcaatttcaattgaaatgaatgtatgatttttgtccttcattctgttgatatgatatatcacattgattgtttcatgtatgttgaaccatccttgcatcccagggataaaatccacttgttcatgatgaatgacctttttaattaattgttgaatttggtttgctagtattttgttgaggatttttgcatcaatattcatcagagatattggcctgtagttttctttctctttttttttctgatgtgtctttgtctggtttttgacatcagggtaccactggcctcaaagagagagtttggaatttttccctcctcctctattttttggaatatttttactagcattggtattagttcttctttaaatgtttactaggattcagcagtaaagccactgggtctgggcttttctttactaggagacttttactacagcttcaatcttgtcacttggtattgatctgttcaggttttttatttcttcatggttcaatcttgataggttgtatgtgtctacgaatttttccatttcttctagattgtttcaccttattagcttatagttgctcatagtagccactaatgatcctttgaatttctgtggtatcagttgtatgtccccctttttcatatgtgattttatttatttggatcttctctcctttttcttactctgcctaaaggtttgtcaattttgtttagctttttaaaacaccaactttttgtttcattgatcttttatattgttttcatttcaatttcatttatttctgctctaatctttatttatagtttcttctactaatgtggggtttgcattttctctcacttttccagttctttaaaattcctcattatgttatttatttgaagtttttttttcttttttgatatagacatttatagatataaacttccctcctggtactgattttactgcattccacaggttttggtatgttgtgtttccattatcatttgtttcaaaaaatttttcaatttccttcttaatttcttcattgacccagtggtcattctagagcaggttgtttaatttccttttatttgtatagtttccaaaattcctcctgttattggtttgtagttttatttcttgtggtcagagaagatgcttgatatttcaattcttttgaatgttttaagacttgttttgtgacctaacacatggtctatccttgagaataatccacgtgctgaaggaaagaatgtgtattcattggatgacatgttctgtaaatatctactagatccatttggttcatagtgcagattaagtccaatgtttctttgttgattttctgtctggtagatctgttcaatgctgaaagtggggtgttgaagtctccagctattattaggggcctctctctttagctctaataatatttgctttatatatctgggcgcttcagtgttgggtgcatatatatttaaaattgttatatcctcttgctggattgatgcctttatcattatatagtgactttctttgtctcttcttattgttttcgccttgaaatctattttgtctgatataaatgtatctacttctgctcttttttagtttccatttgcatggaatatcttttcccatccctttatttttagtctatctgtgtctttataggtgaagtgtgttttttgtaaggcacagatcaatgggtcttatttttttatccattcagccactcaatgtctttcgattggagagtttagtccatttacattcaatgttattattgttaaaaaaggacttactcctgccattttgttgtttgttttctagttgttttgtggtcttctcttccttctttcttcccttcatgtctccctttgaatgaaggtgttttctctggtaatgtttagtttcttgttttttttattttctgattgtatccattgtatatttttggtttgaggcttccatgaggcttgcaaatactatcttataacctattattttagcctgataactacttaagttgtttgtagaaagaaagaaacaaacaaaaagaaaactaataaaaactctatactttgttccctcactttttaacttttttgtttctatttataccttattgtactatctaggtctttaaaagctttgtagttattatttttattggctcatcctgtagtctttccacttaagagtagtttatgcaccacaattacagtgttataatattatgtgtatttctgtgtacttactattatcaatgagttttgtaccttcaggtgatttcttattgctcattaatatacttttctttctaattgaagtactctcttttccatttcttgcaggacaggtctggtgttggtgaaatccctcagcttttgtttgtctgggaatgtttttatttctctttcatctttgacggatgttttcaccagatatactattctagagtaaaagtttttttttccttaagtgctttaaattaaattaatgaataaatggaccttattagaacagacgaggcttggaccttaaagggcacactgtatatggacaagtagaaaatatggagagagaaacttctagttataagtgagtttctgcaggccttcctaatctcgtggcgatagatgagagttcattaatagaaataatccaaatttcttccctcaactatctaatgtcaggtctccttcctgaagaatttctgtgaagccttaaagagtgtcaagatcattccctcatgaacttacatttagaaaccctttcccactgatatcaatgccacatcattgtccctcctgcttgtgccctcagcttgagacagcagatgtgatactcaaagagctgcctgcctccaagggaccacagaggcattctatttcctgcagtcctccctgagtcagaatcactctaatgagttaaaattatgagaatttttttattattggaggaagttattttatctaattcttgatctacttataataagtaatcctagaatttttttttttttttgagacagggtctcattctgtctcccaggctagagatctcagctcactgcaacttctgcttcccaggctcaagcgattctctagcctcagcctcccaagtagctgggactatgggcatgagccaccaatgcccagctaatttgggttttgttttgttttgttttttgtagagatggggtttcaccatgttgcccaggctggtctggaactcctgagctcaaagccattttcccacctcagcctcccaaagtgctgggattacaggcatgagacactgtacccagccagtaatcccagaatttttacaaaagctcctattgttgcataatgaaacagtattctcttgccattatttaaagtcacttttttcactttctggtaaaaaaattcgttcaatcattgacaaatatttgctgaacacccactctgtgccgtgtactactatgttaggtgctggatatatgttgatgaatgaaacaaactgtatccttgtagaatttgagtctgctgaactcagaagtaaattctttgaaagttaggatggatagtaaagttgagtactcttagtttcaatatttaacatgttgctcttatcaattttttagtaaatgttagtgtacaaaggtaatttaggttttgaggtgtatccagaaaaatctggtttttttaatcaagagaatccactcaagagactactcatagaaaagaatttatatgatgcatcagatagaaagtaaaatttagtgttttcctgaaaaaaaaaaaaaaaacacaaaaaccaaatacaatggaggcttctcttccacattctgtggcatttgttttttcaactaaacaccaacactacactcatgaaaacaactccttcagcactacctgtactctgcttcaccaaaccagaaacgtcaatataaaaaacaagcagcatgccaaaggtcaactgatcttcaacaagggtgccaaaaatacacaatggggaaaggatagtctcttcaacaaatggtgtaaaaactcatatccatatgcaaaaacatgaaattgaacccttacaccatacataacattcaactcaaagtagattaaagacaaacataagacctgaaactataaaacttctagaagaaaacatagtggaaaatcttcatgaccttggtcttggcagtgatttcatgaatatctcatcaaaaacacaagcaacaaaagcaaaaataaacaaatgagcccacatcaaaggagaaagcttctgcacagcaaaggaaacaattgacagggtgaaaacgcaacctacagaataggaaaaaatgtttacaaaccatatgtattagtccattctgcattgccataaaggaatacctgagacagggtaatttataaagaaaagaggcttattttggcccactgttctgcaggctgtacacaaagcgtggcaccagcatctgctcccagtgagggcctcaagaagcttccaacaatggtggaagggaaagggggagcctgcgtttcacatgataagagagagagcaagagacagagggaggaggtgcccggcacttttaaacaaccagatcgcacatgaattcacagaatgagaacccacttgttactgcaaggacagcaccaagattttcataagggatctttccccatgacccaaacacctcccattaggctcacctccaacattggaggtcacatttcaacgtgagatttggaggggacaaaacatccaaaccatatcaccatatatctgataaggagataattcctaaaatatataaggaactcccacaactcaacagcaaaaagactaataacccaattttttaaatggggcaaaaaaacttgaacagactatgtcacagtatctatgtgaaaatatacgcaacatcattaatcatcaaggaaatacaaatcacaaccacaatgagatatcatctcacacctgttagaatggctattatcaaaaagatgaaagataagtgttgtcaaggatatggagaaactggaacctttgcacactgtcagtggaaatgcaaaatggtatggccgctatggaaaacaacatgaagtttttttaaaaattaaaaatagaactaccatatgattcagcagtcccactctgggtatttatccaaaagaactgagatcaggacttcaaagagcaattagcattcccaggttcattgcagcactatctacaatagctaaaatgtggaaacaatctaaatgtccatcaacaaatgaatgaataaagaaaatgttgtatctatatacaatggaatattattcagcctttaaaaagaaggaaattctgcaatatatgacaccagagatgactgaggaaattgtgctaagtgaaaaaagccagtcatcaaaggacaaatactgcatgattccacctatatgaagtatcgaaaatagttaaattcatagactcaaagaatggaatggtgattgccagggactcaagggagaagaaaaagggaagttgataatcaaggggagtaaagtttcaattaatcaagataaataagttctagagatctgctgtacaacattgtacctatagttatcaatactatattgcacacttaaaaaatttgttgaaagtagatctcatattaaatgttttacaacaataaaataacataaaaaataaaatgacaaagaagcatgctgtaatggctattccaggttatcttccagtaggctttgctaattgatttcctccaacctcagcctagagctcccaggcaaagcaactccttatgacctacacagttgttcaacactcatactcagacatggattaatcacacttaagtgggaacccctacacaggaggattaaggtaaggtatcagggcactcagtatatcagcttaattatgtcagaagatttgtgatgatgaactgtgacagacaaggctagtcaaataagatgagtcctgttgcagatggtaatttaattaccaatttcgggcatgtattgagccctgaccacttgtgcaaaatgttttatttaggtcttatcatgacctatttgaaaatgacaaactgaggtttagctatattaatctgtcaaggtcactcagctagcgtgtggcagagctgagaataaaaccatgcctagtgaatgtcagagtctctgcccttaactactagaccataccatggttgtgagagaatcagtaaagggtcatgaacaaatgttggtatgaagaaagcaccattatagaaagactggattgctggggacaatgtataggagagaaagatagttggaggaggggaaacttgttgctttcatttaatgttaattagtaaaagttcagtcctaatccacaataatatttatactttctcatagcactagtgtgtttccttaataaatggactaaagcagtagcttggaataccagcactaaacttaagtttttaagattataaccataaagatctgtgtgaatgatgaccaaatggttagtaaaaaaaaaaaaaaaaaattatgtaataaaaaacccaccaccaacaacaaagaaaattacccaaagatgactgagaaacatctttacaccactatttgcctaatagaatgactaaataaaacaaacaatgccagatgctggtgaggatgtaaagcaactggagctctcataggttgctgatgagaatagaaaatggcatagccctgtgaaaaacagttttccagtttcttataaagttaaacatatatttagcatattacccaaaaatcctacttctaggtatttacccaagtgaaaacctctattcatacaaaaaaaaaaatctgtatgtgaaaaaagtatgtgtatatatatatatatatatatgcattattcataattaccaaaagctgtaaataacctgcattcccctcaaatagacatgtgtttttaaaaatggtgatacgcccatagtgtgaaatagtatccaacaataaagataaataaactattgatacatgcaacaaagggatgaatctcaaatgctttatgctaagtgaaagaagtcagactcaaaaggctatagtatgattccactcattcatataacattctggaataggcaaaacagatgagtgggtgtcaggtgttaaaggtatggggaagatttgacttcaaagggagaagataagagaatattagaggaggtatattgaaattgttctttatcttaactgtggtaatgggttacataactctacctattttccaaaactcatagaaatatacaccaaaaaagtcaattttactgtatatgaattaaaactacactttcaaataaaaaatctcttctacaagaaagcatacagcaaaagtttcacatattctaaatgttataaaccacgaaacatttcacaaagcaccatctacaaaaaagataatgtaactgagtatttaaacaaaaaaccaagctataattttttaaaaattatatacaaggcataaaacatgcctattaaaagcataagtagttggccagcgtgttgtttaccacctctgaatagctgtaaaatgtttatagatttttatacctttcatgaataaagcagagtaaattaatgcaaagttatttttctgagagaagctgtcaaactcctttctggccaaaagggaatttgtgacttcctgttatgttaaatttggtactaaagcctgaatgaaccacctcaaatgggctatttactatgataaatactgtttcctaacaagaggaaaagtggtggcctgggaagataactgctgggattttaatgcactctctgaaacactctgacatactctgttagagaaaataatttaatattaaccagaagtcaggcttaacattccatttcctgaaaatgatcatcaaaagacaaatgcaatttaattcaccaaacatgtattaagcatttaatatatgccaagcactgtgctaggcattaggtaaacaaactgaaaataacacaatatttgcctttaaagattgcacaaactagcaggggatagagacaagtaataagcaaatatacttccatacaataatctaagtgtgatgatagaagtgtgatcgggtacggggacaaccaggggaaaaagtgattgtctgagttctaacaaaaagcacatcaaccagatcctaggactccctaaatctgccttcagatgattaaaatgctaacaggaacaaatagaaagctgcatgatttgaagaggccattccttttatatttaccaccaccatcttccatgacagttttgaaaacactgagcaaggcatacctgtgctgatgtatttattccttgacttgaaataatcctccaggtgatgaaattcccacaggacaaaggaataataatctaaagtctccctttccagaaagtggaaaagttccaagtagtattattccttactgaaacctaagatccctttatgcaaaagaataaaaaaaaaaggtctcatgcctcatgctaattcactgtggctaactacactacttaaaattaagatagaaaggtatgaatgttccatttttcctgtatgttagcagtgatcatatctaacacataattccaattcactgttactacgaaatgtaactattgctccagtactctcacaacggattaaacaagtaaaagtaagcattccgaaataatggaactcctactatctcctgtgtcttcaagcccttccctgaaactactagccctaacagagaagaacccagtagcactttctttcctctcttctttctatcctttccattctatccgtcacagaaagtagcatcttttttccttcatcctttttattctatccatcacagatattaattccaggtatgtacacaatggccaactagcagaaaataaatcattagaaaatgttaaaagcaaaacagtgggaaggaaaacctaagtgtcacatctttgagggccagcactacgtttccaaaatgggaaaggttttatagctagaagatctgggctcagatcctgcttccgccacttactagctctgtagctttagacaacatattcacctgtctgaatgtcagtgttcacttccacaaaatgtagatgataggaactgctactttgcataattattcttgagattaggtgccatacaagactgattctcaatcccactgcatgctaaaattcgggggcaccactctgagactctgttttcattggtctactgtggggcatgaactacaaaaagagagagagaagaagcagcacatctccaaggtattcaactttacagctgggcaacaacctctgcattatagtaactgcaagaactccctaaactttaattcagtgcagcatttcacaatttattattgtattttaaaagtaccattgaactcatcctgttatgcacgttacatagtcttaaagattgctagtaattcaatagttaaatttgatgtttacttagaatgcctcccttgacaagcaaatcatcattttcaacaactgagaattgttacaaggagctgagaaaacaagatatatacattaaatgattaaagtcacttcttaggtgccaaaaatgaaaggagtatgatgatgggataagctttatgatgcttgaggtcaggtaccatgatttttaaaaatagtttcagcatcaaggacagtgcacagaactcaataaatatttgttaaataagtagatgaatgtgtgagtgaacggatgaatgtaaagatttccacaggaatttaccaagagtcatcactaaagactggaatgaagaggaaggtattttcattggaaaaataagtctcagccactgccaccaatgaagctgcaatgtctctaatgaagagaccgaacttcaggtttgaaaggtaaattgcagtccttgcattttcagttaaatctttcaaacagcagcccactccgcctccattcttggtcccaattctgactctcctccaaacttctaacattaacaattggcacaaggctagctttctaaaacaaacatttctcattactaggaacattacaaaagtcttgctttctgagcattggatacctgctttaagagctagttaatgcacagtataaaacaaggaagacaaaagacatgatctacccagctgggttagccaaggggcctgggagataaattgaccaactgcctgtgtagcatcttacattctccaaaataaccctacaaggttgctgcagatctcagattaagaaaaatttattgctgagtttattatttttaacatcctttgtctgagcacctagcaactaaagtgataagtaccttcaacttgcaaggataaatgctgcaaatatcttggctgaattacccatttgtatgtatgtttgtaacttgaattattcatttacattttttattttttaaagaggagaataaaactagaaagagaagagatactaaaaaatctcattgctgtagatttaaaggttttccggtggtaggaagccaaaaggccccttcagcaataaacaatagatttattctacaatctaattaatactcacaaactatgttacttatgaaacaaacaatatatctagggaatgcaattgcatccaagcaaaagtatccatattaataaggaaaaatcttacaaaagtaggcttggaaaagtatgtgcagcaaaaaagttatggtttttctttaaaactgtatttgaatactaacaacaatgggtaggtcccatttaattgctggtcttacaataaagcaaacattttaaatttgggtgacgatatgagctttccctgaaaactttgctaataacaacctagggtatctatttcttatttgaaaaggaatgaagggtttcctacacctatgtgtaggtgataatgcaagaccatgaaaattctagacccataaacctaccatagaaaaaaatttaatcccttccaaattaatactttgctattgtccaaatgatagtttaagattaacattgatttatttatttgttttcttattaacaataacaccaccactttgtcaatggttgtcaaagtggggtatgtcattgtgatgtgagaagaaaatatcagaacttctacttgtacttatttttatcaaaaacagaaagaaattaaactttattgatattttaaaaagaaattacactgaccccattccctgtccctatatcaaatgtaaacaagacaggcagatttcatgagataggcagaaggaagtagttgttggtgaaacactcactcatctcctagctttcatcaggttgcaaagtaccatactgtgtgtagccacgagtagtggatttactgaatacattacctagttttatttaaactaaccctacaaaacaaaaaagaaagaaaaaaattcttgcaaagaatcatggaatttatgattacacaaataattgatgattgataataattggtggctatacaaataatgtaagcacaaaaaaaaaggtggagctgtaacttctgctcctgcggtgagttcttcatcattcctgagtaaatcagcctgacaagaagtcaagcaaaaaaaaaaaccttttcataatattaaaatatgaacattcatccaccatcattaaaagtcaaggtagctttaagtatatagaatgccttgagatattatgcaatgataatacaaagctatcatcgttttcaaaccgtttaaaaatgttgattacttcacctttatcccattcttccctttatatattgcactgtgtacaatctgtattaggtcagtagtacatatgcataattcatagtgaagagggaatcccagaccttattctccaagtcacactgcccttctcccagcctccacaccatcatctacaggagttagagagtatcaaagttctatatctgtctccacaacactcatagccttacaactttaaagaccatcaagagaaattccatcaacctctttatcaccacaggaaacccaaagttcctgggttttccctcactactaggtctctggtctatgcatccttaatttcaccctgtcttcccaagttcagagcccattacactatgtcctctggagaacataaagtccctcatgttctatctcctcctgaatactgcctccacctctttgctgtaaataaaagccagttattccccaaggactctcttcccctgtagggtccacaaatgatggctattttctctctcatattccaactatcactgtcctacttcctcatcattgtagaaaactgtgtcccttctacctccctccaaaaatccagccttgcaactcatgccatcaaattagacaacttttactactactggctgcagttaacttcagtttctataactgctacaagattttgattatgattttatcatttgcatctgtcatttccacataactgaatctcccagtaccctcaatcctcagatccttaaattgtaaacttcaatgagcttgtcctcagccatttcatggtgatctggacctcttttttattatcaataacagcagccctccatgacctcaactccaagtatccagttccaaaatattacttcccatttttccagctcacgccctctcattctttgataacaatccttaatcaactttttgctgtattttacctccttctgttctagttacattgcctccttacttagcttagattccatggtccatcattacaatcagctccctggtggccctctcttcccttgtttaatcaacctggtaaaacttatactttgactaaatacagctttccacccacttgaacccaaatatctaaacatgggctgagaggattacacaccatccttactggtttcactttaaattcataatgataatcttcaatggggcttcagttcctcccagtgatcttttatgcatttctgcagtcaattcattctcctacacaaccgtttaacgtctctttcctcaaacctccaacattttctctaccatcctcactataatagatgaaacatattcacagatatacaccaccatatctagcagcctagcattcatacacccactagtgtaaactatccaagctcttatctaagaaaacctctccacatgtatcctaacttttaactctcctcactgtctgaaatgcattactctcttcctcttctctctcattgtatcaacactattttctcaattgtggatcatttaatttacatcaaacatgatgttatatctcccagaagataaaatatatctggaaaacccaagagaatcaactgaaaaaaatactataaacaatatgagaatttactacaatatcatgatgcatattaatacagagaaagcacaaggcttcatatattcaataaaatatgccatttacgatagcagaaaagacactagagtaaacttaatagaaagtatgtaagatctataggaagaaaacctaacaacacaactgaaaacacaaaagaagacttcagaaaatgaaattacatcagctagaaaaacacaacatcataaatatgtcaattcttcttaagataatttataaatataaaaccatcataataaaaatacaacagttggtttgggggacttttgatgttattcttttatttttgaacaaagtagctgaccccaaagttcttataaatagtaagcatgcaagaatagcaagggaagctattacaaagaacaataaaggggtgagggtatgagcaccaccatacattaaatgagaaaaaaagaagagccaaaacaatgctaaaaaattaattttaaaagtccaagaacttgaactgtctgacttcagaattcaacataaagcctcagtaatcaccgcaacacatttttgggttgaatatagacatataaattaatggagcaaaatacagagtccagaaataaacctggatatatatgaataattaattttcaacaaaagagcaaagcaatttgatgagaaaaggataatattttcaataagccatgctggaagaatgactaaccatatgcaaaaaaaaatctccacacttacctcatgatacacaaaaattaattcaaaatgggtcacagacctgttaaattttagagttaatactttaactcctagaagaaaacatagaagaaaatcttagtgatgttgggtctggcaaagatattttaagcagggcacgaaactataaaagaaaactgaactggacttcatcaacactaaaacattttgcttctcaaaagacactattacaaaaatgaaaaggggatcttggaccagatggccaactagacacagccaggaaacatctgtctcaccaaggaaaaaacaaaatatggggtaaaccatcacactttgcacagatcttttgagagaaaacattaaaagttgacaaaaaagaaccacagacacccagtttgaagaaggaggaagctaggaagcctacatagagtccctgagtgccagaacaagctcctagtcctgcaaaggccctaaagaaggggtgagttaaggaattctggggacctcaggagtcctagctacaaggataccctgcccaggtatcttctacacttgacctactacatcaacagaccacccatagacataccccacaacccattctgactcttgccaggcacagaggaccagtgggtcgtcagagagttgtaagtctccttacaactgaccttcagctcaggcttcccccaaaagagaaggaggtgcagcccaccagggacccccttggggctaaggaaatgcaggcactgcaacagtgattaaagaggtctcccccaaggccccagaatggatttggtaagggggtcatcacttgcacccaccccctcgtcttctcctccccagaacactgctgtgaacagaatgaaatataagagacatgcatggctgagcaagatcctatctgctagcccttactcttaagcaccatctaatagaatgcagcctagatgacaccacgaaaacataaataaattccataaatatgcatcacctgtgaaacccaatgcagcaaaactaatcacaacgaaggaacccatacagagccttggttctctgaaagcacctagaaaaaggaccaattgactatatacagtcaaaccctcaagtgaaaaaagtacaaaaacaaaaaggcccattcaaatgacataactttaaaaaaaaaaaaaaagaaagaaacaaagaaacactagccctctcaggtgagaagaaatcagtacaatgactctggtaattaaaaaagtcagagtgtttccttaccttcaaaagatcacactacctacccagcaatacaccctaactagattaaaatgtggaaatgacagacatagaattcagaatctggatgggtaggaagctcgatgagattcaagaaaaagttgaaagccaatccaaggaagcaagtaaaacgatctaagagttgaaagatgacatagtcattttaagaaagaaccaaactgaacttatagaattgaaaattttactgcagaaatttcaaaatacagttggaagcttcaataacagactagaccaacctgaggaaagaatttcagagcttagtcagacaaaaataaagaaaaaaattttttgatgaaccttttaaagcctcaaagaaatatgggattatgtagagaccaaatctatgactcattggctttcttgagagaggagagtaagaaactttgaaacatatttgagtacctagtccaggaaaatttcccaagtctcactagagaagtcaacatgcaatcccaagaaactcagagaaccctcatgaaatgctaaacaagaagatcattctgaaggcattttgtaatcagacttttctaagtcaacaaagaaggaaaaatcaaaaaggtagctagaaaaaagggtcagattacttcaaaaggcaaccccagcaggctaacagcagacttctcagtaggtttctacttttcaagcaagaaaaaattgggagcctatttttggcatccctaaagaaatgaaattccaatcaagaatttcaaaccccaccaaactaagcttcatagtacaggagaaataaaatcttttctggacaagcaaacactaagggaatttattaccactagcccggctataaatgagatctttaagggagccctaaacataaaaaagaaagaacaacacctgctaccataaaaacatatgtaagtacagagcccacagaccctataaagaaacaatgcaattgagaatacaaagctacaagctaataatatcatgactggatcaaaacctcacatatcaatattaatcttgaatgtaaatgatatagatgccccatctaaaaggcatagagagcaagcaggaaaaaaaaaaaaaaaaaacaagaaccaaatgtcttctctcttcaagagaccaatcacacataacagccataggggcaaagtaaagggatggagaagcatctatgtattagtcagttttcacattgctataaagaatacctgagactgggtaatttataaataaaagaggtttaattgacttacagttctacagactatacgggaagcatagcagcttctgcttctggggaggtctcagggagcttccaatcatggtggaaggcaaagagggagcaggcatcttatatggcaggagcaagagcagagagggggaggtgctacatacttttaaacaatcgatctcatgataactcactcactattgcaaagacagtaccaagggaatggtactaaaccattcatgagaaatccacccccatgatccagtctccactcaccaggccacacctccaacactgaggattacaattcgacatgagatttggataggaacacatatccaaactatatcagtctatcacataaatggaaaacaaaaaagagcagtgattgatattctttcataagataaaacagactttaaaccatctacagtaaaaaaaaaaaagaacaaagaagggtattacataatgataaagtgttcaattcaacaagaagacttaactatctaaaatatctctgcacccaacatcagagcacccagattcagaacacaactgcctatagacctacaaaaagacttagatagtcacataatagaggaggacttcaacacaccactgacagcattagacagatcactgaggcagaactctaacaaagaaattatggacttatatttgacacttgaccaactggatctaataaacatctacagaatactccactcatcaaccacagaatatacattcttctcatctgcacacagaacatactgcaagactgatcacatgctcagccataaagcaagtctcaaataactttaaagaatgaaacataccaaccatactcttggaccacaatgcaataaaaacaaatcaataccaattaaacatcccaaaaccacacaattacattaaaattagacaacttgttcctggaagacttttgggtaaacagcaaaatcaaggcaaaaaatagaaaattatttgaaattaatgaaaacagagatacaacataccaaaatctgtgggatgcagcaaaagcagcattaagaggaaagtttagagtgcaatatgcctacatcaaaaagtcagaaagatctcaaattaacaatctaacattgcaactatgggaactagaaaaaacaagaagaaactaattcaaagctaacagaaaatataaatatctaaaatcagagcaaaactgaatggaattgaaaagtgaaaatccacaaaaagcagcaacaaaaccaaaagttggtctttgaaacaataaacaagatccatacactgctagtcagaaacaaagaaaaaaggaagaagatccaataaacacaataaaaaaatgacaatggtgacattataaccaatttcatagaaatacaaaagatcctcagaaactattatgaacactatctatgcatacaaactagaaaatctagaggaaatgaatacattcctggaaacacacaacttcccaagattgaaacaggaagaaattaaaactctgacctgatcaataacaagttccaaagttgaatcaataataaaaattctaccaaccaataaaagccctgaaccagatggatttacagctgaattctaccagggatacaaaaaagagctgctaccaatcctgctgaaactgctcgaaaaaacagaggaggagaaacttctccctaactcattgttcaaagccagcaacatcatcataataccaaaacctgacaaagacaggatgaaaaaagaaaactacaggccaacatccctaatgaacatggatgcaaaaatccccagcaaaatactagcaaaccgaattcagcagcacatcaaaaagttatttcaccatgatcaagtgagcttcactccaataatgcaacagtgattcaatatatgcaaatcaataaatgtgatttaccatataaacagaattaaaaacaaaaccatatatcatcttaatagatgcaaaagaagattttgccaaaatccaaaatcccttcatgttaaaaaacctaacgagcatatctcaaaataataatagccatctatgacaaacccacagccaacatcatactgaatgagcaaaagctggaagcattcccccttaagaactggaacaagaaaaagatgcccactctcactactcattttcaacacagtactggaagttctagctagaacattcaggcaagaaaaagaaataaaaggcattcaaatagaaaaaaaaaaaaatcaaactctctctcttcagagatgatatgattctatacttagaaaaccctgaagtctctgccaaaaggtttctagaacagataaacaacttcagcaaagtttcagaatacaaaatcaacgtattaaaatcaataacatttctatacaccaataacactcaagctgacatccaaatcaagaacacaatcctatttattaatacaatatccacacacaaaaataaaagacctaagaattcatctaaccaaggaggtaaaagatctctacaaggagatctacaaaacactgtttcaaagaaaccagagatgacacaaaataaaaataaaaataattccctgcttattgacagaaagaatcaatatcactaaaatggccatattgcccaaagcaatctacacattcaatgctattcctatcaaactaccaccgtttttcacagaattagaaaaaaaatttctgaaactcatataaaaccaaaaaagagcccaaatagccaaagcaatcctaagcaaaaagaacaaaaccagaggcatcacactacataaattcaaactatactacaaggctacagtaaacaaacaacatagtaccagtataaaaatagacaaattcaaaagctagcagaaggcaagaaataactaagatcagagcagaactgaaaaagaaagagacacacacacacacaaaaaaactcttcaaaaaatcaatgaatccaggagctggttttttcaaaaagatcaacaaaatagatagactgctagcaagactaataaagaagaaaagagagaagaacaaatagatgcaataaaaataatataataataaagggaatatcaccaccaatcccacagaaatagaaactaccatcagagaataccataaacacttctacgcaaataaactagaaaatctagaaaaaatggataaattcctggacacatacactctcccaagactaaaccaggaagaagttgaatctctgactacaccaataacaggttctgaaattgaggcaataattaatagcctaccaatcaagaacagtccaggaccagacatattcacagccaaactcttccagaggtacaaagaagagttggtaccattccttctgaaacaatttccaaccaatagaaaaaagagggaatcctcccaaactcattttatgaggcagcatcatcctgataccaaagcctggcagagacacaacaaaagaagagaattttaggccaatatgcctgatgaacatcaatgcaaaagtcctcaataaaatactgacaaacccaatccagcagcacatcaaaaagcttatccaccatgatcaagtcggcttcatctctgggatgcaaggctggttcaacatatgcaaatcaataaacgtaatccatcacataaacagtaccaatgacaaaaaccacatgattatctcaatagatgcagaaaaggccttcaacaaaattcaacagccttttatgtcaaaaactctcaataaactaggtattgatggaatgtatctcataataagagctatttatgacaaacccacagccaatatcatactgaatggcaaaaactggaagcattccctttgaaaattggcacaagacaaggatgccctctctcaccactcctattcaatgtagtgttggaagtcctggccagggcaattaggcaggagaaagaaataaagggtattcaattaggatacttcagcaaagtctcaggatacaaaaccaatgtacaaaaatcacaagcattcctatacaccaatagcagacaaacagagagccaaatcatgagtgaactcccattcacaattactacaaagagaataaaatctaggaatccaacttaaaagtgatgtgaaggccctcttcaaggagaactacaaaccactgcccaacaaaataaaagaggacacaagcaaatggaaaaacattccatgctcatggataggaagaatcaaaatcatgaaaatggccatactgcccaaggtaatttatacattcaatgccatacccatcaagctaccactgactttcttcatagaattggaaaaacctactttaaaattcatatggaaccaaaaaagagcccacatagccaagacaatcctaagcaaaaagaacaaagttggaggcatcacactacctgacatcaaactatactacaaggctacagtaaccaaaacagcatggtactggtaccaaaacagaagcatagaccaatgcaacagaacagaggcctcagaaataataccacacatctacaactatctaatctttgacaaacctgacaaaaacaagaaatggggaaaggatttcctatttaataaatggtgctgggaaaactggcgaaccatatgtagaaagctgaaacaggatcccttccttatatcttatacaaaaaataactcaagatggagcacagacttaaatgtaagacctaacaccataaaaaccctagaagaaaacctaggcaataccattcaggacataggcatgggcaaagccttcatgactaaaacaccaaaagcaatgacaacaaaagccaaaatagacaaatgggatctaattaaactaaagagcttctgcacagcaaaagaaaataccatcagagtgaacaggcaacccacataaagggagaaacattttgcaatctacccatgtgacaaagggctaatatccagaatctaaaaagaacttaaacaaatttacaagaaaaaaacaaacaaccccatcaaaaagtgggcaaaggatatgaacagacttttctcaaaagaagacatttatgcagccaacagacacatgaaaaaatgctcatcatcactggtcatcagagaaatgcaaatcaaaactatgatgagataccatctcacgccagttagaatggcaatcattaaaaagtcaggaaacaacagatgctggagaggatgtgaagaaataggaacgcttttacactgttgatgggagtgtaaattagttcaactattgtggaagacagtgtggcaattcctcaaggacctagaactagaaataccatttgacccagccatcccattactgggtatatacccaaaggattataaatcatgctactataaagatgcatgcgcacgtatgtttattgcggcactattcacaatagcaaagacttggacccaacccaaatgtccaacaatgatagactggattaagaaaatgtggcacatatacaccatggaatactaagttcatgtcctttgcagggacatggatgaagctggaaaccatcattctaagtcaactatcacaaggacagaaaaccaaacacttcatgttctcactcatagatgggtgttgaacaatgagaacacatggacacaaggcagggaacatcacacacaccagggcctgtcgggggttggggggctgagggaaggacagcattaggagaaatgcctaatgtaaatgacaagttgatgggtgcagcaaaccaacatggcacatgtatacctatgtaacaaatctgcatcttgtgcacatgtatcctagaacttaaagtataaaaaataaaataaaataaagaaaagaaattcactgacattcagaaaaaaaaatagacacatagtcacctgaggtcaggagttcgaggccagcctggccaacatggtgaaaccccgtctctactaaaaatacaaaaatcagccaggagtggtggcacatgcctccaatcccagctacttgggagggtgaggcaggagaattgcttgaacctgggaggcggaggttgcagtgagcaggaatcctgccactgcactccagcctgggtgacaagagcaaaacttcgtccaaaggaaaaaaaaaaagacacatagattaatgggacagaatagagaacagaaataaggccacacacctacaaccatctgctctttgacaaagttgatgaaaacatacaatggggaaagaactctctactccctattcaataaatgatgctgagataactggctatccatatgcagaagaataaaactggacccctacctctaactacatacaaacattaactcaagatggattaaactatcctctaaaactgtgagaaataaatttgttgtttaggttaaaaattttcaaaaagtttaaaaaaaaaggtggattgcagacttaaatgcaaaacctaaaactaaaaatattctagaagaaaagctaggaaatgcctttttagacatcagccttggaaaagaatttatggctaagtcctgcaattgcaacaaaaatgaaaaagtgggacctaattaaactaaagtgcttctgcaaagcaaaagaaactatcaacagaataaaaagacaacctacagagttggtgataatattcacaaactaggtatccaacaatggtctaaaatccagactctataaggaacttagaaaattcaacaagcgaaaaacaaataaccccattaaaaagtggacaaagaacattaacagacatttctcaaaagaagacatacaagtggccaccaaacatacgaaaaaaatattcaacatcattaatcaaaactatgagatcccatcttacacaagtcagaatgtctattaataaaaagtcaaaaaaaaaacagatgttggtgaaggctacagagaaaagtaaatgcctataaactgtttgtgggaatgtcaattagtttagccactgtgaaacacagtttggagatttatcaaagtactaaaaatagaattaccatgcgaacagcaatcccaatactagggatatatccaaaggacaattattcattcaaccaaaaagacacacacacccagatcttcatcacagcactattcacaatagcaaagacatggaatcaacctaggtgcccgtcaaaagtgaactggataaagaaaatgtcgaatacagtatgcccataaaaaataacgaagtcttgttttttgcaccaatatggctgcagctggaagccaatatcctaagtgaactaatgcagaaacagaaaaccacatactgtatgttcttgcttataagtgggagctaaacattggatgcacatgggcataaaaatggtgacaacaagagtgcggaaaaagggagaaaggaaagtgttgaaaaactaatcattgggtactatgctcagtatgtgggtgataggtttaattgtatcccaaatctcagcatcacacaacacacccttgtaaaaaacctgcgcatgtaccccttgaatctaaaacagaagctggtgggaaaagggcttacagagctccaaaaaaaatgaatgaaaaagtacaccacggaatgggagaaaatattcgaaaaataaatgtcccacaaaggacttatacctagaatatttaaagaagttttacaacttgatagaaggacaaacaaaagattgaacctaacaggcatctcaccaaagaagatgtagagatggcaaataagcacgtgagatgtttaacatcattagttattaaggaaatagaagttaaaaccaaattgagatagttctacatgctcactagaatggctgaaatttaaaaggctgaccataaaaagactattggcaaggatgtggaccactgaaactctcatacacagatagtgggaatgtaaaatggcacaactcctttggaaaacagtttgatgatttcttaaaagtgtaaaaatacatctaccatgtgactaagccactgcactcctagatatttgctcaagataaatcaaaatgtctctttacacaaaaacttaaatacatgaatgttcatgacagttgtactcgtaatagcctaaaactggaaacaacccaagcatctatcagcagctaaataaataaacgaataatggtatccatacaatggaatactatttcacaatatttaaaactactgataaacacaacatgatggatgaatctcaaaataattatgctgagtgaaaaaaagctacataaaaagagcacatgttatataattccatgtctataaaattccagaaatgtgaattaatctacagtgacataaagcagatcagtggttacctgtggagaggaggaagagagacacaggaggcagaaaagggaaacattgcagacgggcaagagaaaactttagggagagattggtacatttactatcttgactatggtgatggtttcaccatcgacatatttcaaaactcatcaaattgtacacttaaaatgtatgcactctactttaggggctgaagcagggggatcttttgagcctaaaagctagaaggtagcctgggcaacacagcaaaaccctgtcactaaaatatgtatgtataatgcattacatatattaaacctcaataaatctatttttaaagccttggtaattaaaatactgatgctgtaagatgaataggaagaattaaaaatccaaaaatagattcaaatacataaacgaatgcattctgtgaaaaaagtgatatctcaaacaagttaggagacttgctggtcaagacttgctcttggaaaaactggataaacatccagaaaaaattaaataagattgaatccatacctcacattatatcattatattccagatgcatatattctaaatagatcaaagatttgcttgtagaaagtgcaaccatgtgataattccttttcaaccttgggcctgcgagctaactatgactgagtcaataaaagaaaaaaatgtataaatctgacaacaattaaaatcttctccatggcgaaaatacaccataagcaaattcaaaagacaacaatctggaaaaagtgtaattgcaagtcatattacaaagagttaatctactcaatattttaaaagctcctaaaaatcagtaagcaaaagaagtccagtaactcaaaagaaaatgggtaaagaatgtgaacaaatatgcatatgtacagataaagatgcttaacctttctaataaaaaatgcaaattaaaataacactagataatatcttttgcctatcagcttagaaaaataaccaaagttaaagacactgttagttaggcttcagcatgcaggtattctcatacaccatgagaatgtaaattagtaccaccattttggaggacactttggcaatatctgtacaaattacaaatgcatatgccctttaaccccaaactttcacttctgagaatttatcctacaaataacacttgcatgcctatgaagttgtatatatgcatgtgtaggtgtgtctacatacttaagtgtatgtatgtatatatgtatgtatgtgtgtatatatatagttattacttacattattctgtgtaatggcaaaagattgaaaatcattaaaatgtccatcaataaaggactggtcaaacaaattttggtatgtctatataattgaatactataaagctgttacaaaaaataaggcagatctctatatgctgatgtggaaagatctccacttgatttttttttattcaggtttcatcattttacttttttcacaaaatttgtgtatgtgactcacatcaattcattttgatatataatttatttctgatattttgtttatttgaagtgacaggtaactgggtaattatctatactctgcttttaccatgtattttatttctaggtaaatttgaaaaatctgaagtatttttctaaatttgatcatggtttatttgacagtttacaagtacttgcaggcatgtgtttgcatgcgaataacgacaaatagctaagaaatcttacaatagtatagtttcataatttgggggtcctggttatacattttacatctgtaggttaggaatgcatattgttaatttcccttcatggttccttataactaaactctgtttagtaagattttctacttatcaaaggcataataactcactatttggtatatttgctctttaatgtgacatatgacatattttctgtggataaggagaactctgtatttgtgtgtatatgtacatataatgttttcaactaatcactatttcagagaaaaaacagatgaaaagaaacttgtttgcattacattaaatataatcctatacatgttaagaggaagttttttttgtttttttttttttttgagacagagtctcgctctgtcgcccaggctggagtgcagtggcgggatctcggctcactgcaagctgcgcctcccgggttcacgccattctcctgcctcagcctcccaagtagctgggactacaggcgcccgccgctacgcccggctaattttttgtatttttagtagagacggggtttcaccgttttagcctggatggtctcgatctcctgacctcttgatccgcccgcctcggcctcccaaagtgctgggattacaggcgtgagccaccgcgcccggccaagaggaagttttacagcaagaaattgttcctttttttcttcccatttttctttttatatatacatattttttttctattatactttaagttctagggtacatgtgcataatgtgcaggtttgttacatatgtatacatgtgccatgttggtgtgctgcacccattaactcgtcatttacattaggtatatctcctaatgctatccctcccccctccccccatcccacaacaggccccagtgtgtgatgttccccttcctgtgtccatgtgttctcattgttcaattcccaccaatgagtgagaacatgtggtgtttggttttttgtccttgcaatagtttgctgagaatgatagtttccagcatcatcgatgtccctgcaaaggacatgaactcatctttcttatggtgtcatagtattccatggtgtatatgtgccacattttcttaatccagtctatcattgatggacatctgggttggttccaagtctttgctattgtgaatagtgctgcaataaacatatgtgtgcatgtgtctttatagcagcatgatttataatcctttgggtatatacccagtaatgggatggctgggtcaaatggtatttctagttctagatccctgaagaatcaccacactgtcttccacaatggttcaactagtttacagtctgacctacagtataaaagtgttcctatttctccacatcctctccagcacctgctgtttcctgactttttaatgattgccattctaactggtgtgagatggtatctcattgtggttttgatttgcatttgtctgatggccagtgatgatgagcattttttcatctgtctgttggctgcataaatgtcttcttttgagaagtgtctgttcatatctttcgcccacttgctgatgggttgttttttttttcttgtaaatttgtttgagttctttgtagattctggatattagccctttgtcagatgagtagattgcaaaaattttctcccattctgtaggttgcctattcactctgatggtattttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctggggtttttatggttttaggtctaacatttaagtctttaatccatattgaattatgaaatgaagcgtgaagagaagtttagagaaaaaagaataaaaagaaacgaataaagcctccaagaaatatgggactatgtgaaaagaccaaatctacgtctgattggtgtacctgaaagtgatagggagaatggaaccaagttggaaaacactctgcaggatattatccaggagaacttccccaacctagcaaggcaggccaacattcaaattcaggatatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcagatctctcggcagaaactctacaagccagaagagactgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagacctcctgaaggaagtactaaacatggaaaggaacaaccggtaccagccactgcaaaaacatgccaaattgtaaagaccatcgaggctaggaagaaactgcatcaactaacgtgcaaaatcaccagctaacataataatgacaggatgattcacacataacaatattaaccttaaatgtaaatgggctaaatgctccaattaaaagacacagactggcaaattggataaagagtcaagacccatcagagtgctgtattcaggaaacccatctcacatgcagagacatgcatagctcaaaataaagggatggaggaagatctaccaagcaaatggaaaacaaaaaaaaggcagggattgcaatcttagtctctgataaaacagactttaaatcaataaagatcaaaagagacaaagaaggccattacataattgtagagggataaattcaacaagaagagctaactatcctaaatatatatgcacccaatacaggagcacccagattcataaagcaagtccttggagacgtacaaagagacttagactcccacacaacaataatgggagactttaacacccaactgtcaacattagacagatccatgagacagaaagttaacaaagatatccaggaattgaactcagctctgcaccaagatctccacttgttaagtgaaaaagatctcccacaatgttaagtgaaaaaaagcaagctacagaggagttgtatagttgttacttttctgtaaaatgatggggtaataagaatctatatttatgttttcttatatatataaagagtctctggaaagatacataagaaacacataattttgattaccctgatggatgggtggggttgtatagatgagggcagagaagtcaagggaaacttcactgtacatttcatatataatttttctgatctgtttatatatctgtctctcccctgaaaacaacatgctatgccccatggggtcaggcacttagttgtaatgtttaatgtaatgtttatgtttatctccagtgcctcaaatggttcctagcaaatggtagaacttttgtaaaacttattttttgatagaagtgcacattttaaaaactttcagaccactgtagtaaattatgtctagatttccttacagctctagagtaggtttcagcaaaatttttctataaagagccagatactaaatattttaaggtttgttggccatatggtctctgtcacgattactcaactctgcttttatggtacaaaagcagccacagacaataagtaaacaagtgggtgtgactgtgttctaataaaatattatttataacaacaggtagccagccagatttggtccaagggctgtagtttgcccaactctgttctggaattttgtttctctgattatccatcagttgaaccttgaaaggtatgtaagatttccatctttcaaaataaaaaaattggataacgaatgaacgaataaataaataaataaatattaaccaacttttccataaggaagagttattcatattcttattcatccgatcttattcatcagatttacttcttttatattgggctatatgatactgtatctctaatgagacttttttgctttaaatccactgcattttattttattaatttataatttttattggtacatattaggtgtatatatttatggagtacatgagatattttgttacaggtaaataatgtctagtgaggtgacttttgaacagggacttgaaggaagtaaagcagcaatctatatggttagctaagggaagagggcctcagggagaagaaacagtcaacataagctacttgaagagaaaatttgcttggcttgtcttaaaactatttttaataatttcattaaagcaaaaaattctacattatagaacaccaaatatacaacttatttagtttaatatacaaatatatatctcttaagaacacaactccaaaatgaaaatatttagatattaagttaggacataaatagactaatcatttaatgatacaactccaggaggcacatagccctaagacatgtttgacaccgacatactaaaagttgaagatgctatttattatcctgcccaaattatttaaattattttagtgtatgcttggtcttgccatgattgtgagaagagcacagagacatcagaggatctagtttcttatcctaactctaccactaactagccatgtgacaagtttttaatggtaaacacaggagttgaactagataatgcctactcttcctatataacattcagcaatatctggataaattattgggtatcacaatgagtcaaggtcagggatgctcttaaaaacctgcaatgggccgggtgcagtggctcatgcctgtaatcccaggactttgggaagccgaggtggacagatcacctgaggtcaggagttcacaaccagcctagccaacatggcgaaaccctgtctctgctaaaaatacaaaaaaattagcctagctgggcgtgatggcatgttactgtaatcccagctactcgggaagctgaggcaagagaatcgcttcaactcgggaggcagaagttgcagtgagccaagagcactccaccctgggcaatagagcaagactctgtctcaaaaaaaaaacaaaaacctgcaatgcagaggacatctcacacaataattattcaacactaaatgtcaatagtgccaaggttaagaaaccctgtcctaatgaaaaggattcttctctacttcattgaaggtggtcaatgactatcatatattaattaggaatccttctggctaacaaaacctgaaataaatggtagtttaattttctgaaaacaaattcataagggtggctgccaacaacagaacagcttcaagaactcataggctaacccccaaagtgatgatattagaaggtgggaccttttgggaggtgattagttcaggaaggcggaacccttatgaataggatcagtgctcttataaaagaggccaaaaggaacccatttaccttctaccttgagagaacagagcaggaaggcactgtctatgagaaagtgggccctcaccagctgccaaatataccagtgccttgatcttaaacttcccaaactccagaactgtgaaaaataaactccagttgtttataagctacctagtttgtggcattttgttacagcagaccaaatggactaagacagggagaaagcagtagtactagccacatctatgtcttttatcaggaaagcaaaatctaacaccttaggggacagaactaccttcaagggaggtcaggaaagtcacttaaccctcactgcctgcaagggaggctggactagtaaacacttagcttccttagacttcatagtggagtctggcaaaagagaagaggattggaaattggtcttaggttaatcagttaatagagcctaccttatagtcaatatcctctcacatgaattaagatgaatactaaataataaataagtcctcatcaaacagttgatttctgggatttcctccttggtagagatgaaagaataggtgcgtaaggactacaaatctaattcatatagctcaccgatgctctgtggacaatgtcatttaaaaagtggtgctttcttctttaattgacccactgttcacacattcagctttatgttatgctatggttagatattaagttaggacgtagacaaaagaaactagtaagccaagtatccctctttcatagcagagtaagagacaaactaaaaagctatcaaccagagactaacatcgtgaaaaatcttggaaaccctcttaagggaactcttggaaaagtagtttaattacagagaacaatctcaattgctgcaggaaaagccattcctaactaacctgccagggcacttcagagatattacagccttgatacgagaaagtcaatacacatcaaagctcaaagatatatgttagagcccatagctatgatgccttttgaatctgctcagcgccatccaagcaagtggtataaattcaagattatttggcttatatttaaaatgaaaaaggcatgtttgcattccagtgcacagataaaagtgctctcttcctctagggatgaatatatcctaaccagtttaacatactttagtttggatttctgtttggtacagtaacaatgtagaccctgctaaactttatgtaatccacagtagatgtaatatattcagattttcaaacagacctaaaaagatttaacctctgagattgctgttaaaaagaaaaccttctgtactagaaagtagaatgtgtatgtagcagcatcagggagaagaaagaagatgtatattaaggaaagaatgagaagtcaccaataggaaaatttgtcagaataagttaagagtagggactagttgaaatctcctaggtcttttcagtttagcatttccttctctagagggaaattctatgaagtacttttctattataaacttgaatttctcatcctaatactttccaaataaaattattttacactaacattcaacgactgatttaaagtacagggtctggaaatttggggataaattgttttaaattttttgcaggttgctgaattctgagatgtttttgctctaactattctttctctataaaaagagcttattttaaaaaaaattttcattgacatataataattatatacatttatggagtacatagtgatgtttcaatgcctataatgtatggtgatcagagcagggtaattagcatatctaccatctaaaacatttgtcatttctttgtgttgggaacattcagtttcttccttctaggagtttgaaactacataatatattattgttaattatagtcatcctacagtgctagagaacaccagaacttattcctcctatcttgctgtaactttttttttaagagacagtcttgctctgtcacccaggctggagtagtagcacaatcatagctcactgcagccttgaactcctgggttcaagccacccccacacttcagcctcccaagtaactgggactacaggcgcatgccacaaaacaaggcttctagctttaattttgtaccctttaacaaatctctatcaccttcttccccctacccttctcagaccctagtgtcctatgttctactttttacttttttttatgttttaatgttttgtataattacagtgatatttgttccaaacctcaaactgggacacttaatataacaaaagattttaaacattttgagaatttttaaaattttaacttgttattttgaaataactttagacttacaaaagagttgtcataatgatacagagagtttctgtatatctattgcccagctttctcaaatgttaacatcactaatgttaacatcctacataaccaggtatggttatcaaaactaagaaacgaatatttgtgtagaacactattaacaaatgccagactttattagagttctaccattcttttttaatggatgtccttattctgtttcagggtccaatcaaagatgttatgaaacattttgtggtcatcttcttttgtctcctcagatctgtgagaattctgtgagaaagacagtctccatctttcctgttctttcataaccttgacatgtttggaaagtccctcatccacgtatgacttagaacatgcagtttttaactgtctgttcctgacttatttcacttaacagtgtcctccagttccaaccatgttgctgtgaatgacaggatttcattctttttatggctgaatagtgttaatggaatatatacacaatggtgtatatataccacattttttatttaatagatcattttatgccctttagaatttatttagttgctatcataataagtaacatataagggcaattccattgaagcattctggactttggctaggtaactgaacaattatgagatacatgtcaaataatgggcacttgatacatttctgttgccatttgtcattttcaattgtcgtttgtctacattgacaaatgcagagcttcttcactgtgtttgtgtacctaactgcatcaaccatttaaaaggtatctaaaaatctatgtctaggaattctaaatacaagatttgaccttttgtggaaaatactacatatgtcttaaaatatttctctgtttaaaacataatattacattattataaagttgccatgagcataattctgtcttttattttttaatactcatccaaagaccacattgtatagtgaaaatagcatagaagtaggagtcaggatgcctgtgtttcagctctagccccccgcttggacaagtctcttaaaatcctcaagcctcagattcatcttctacaaaacgaaggtgatataacttccttgcctagttcacagggcaactatgatcattatatgctatgatccttatgaaagtgtttataaattgaaaggcattatacaaagatattaatatagttaaatataaacaagaatatggcatataacccttggtggggaaaatggactaaaaatatatttagaaagtatcatgcgaatatgaacatcacattgcttttcccaaaggtaaagcaaacaagtttatactttaaaggctcttggtaattttttaaataggatcaataggtgacaggtccacacttaatacaagccatctgatctagaataggaaatccaagactttagagtacaatgaggtgaaaatcctaaaccatgagtagagcatagaattagtctggagaggccgggcgcggtggctcacgcctgtaatcccagcactttgggaggccgaggcgggcggatcacgaggtcaggagatcgagagcatcccggctaaaacggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagtgagactccgtctcaaaaaaaaaaaaaaaaaaaaaaagaattagtctggagagcaaacagaacacttacagtaggggcattatgcctgttatcaaactaatctaatttctatgtaaggcaatgttcttttgtattttgctgaagaagaaataagaggaatctgagaggtcttagaaactaatttttgaaagattatattttcattcaaaatggatcagataaagttctaaagtctaagaaaatctaaggtacgatgtgagcaacatgaaatttttcattccacttagaaattctgaaaaaagagaacatactataaccagtgaaatgggaatgaaaattcaagtaaaaccttttcatgaaagattattcaataaataaaagaatattcctggagattaactgtaatcttccaagaggcataggtgcataggtggctcctttcatgggttgtgtataaaagttaattcaacaaatatgcattgagttagtacctaaaatatcataggtaatagggaggaaacagtatgtggcatgacctgtacttatgaaagactaaaggatcaatatcttttacaactaagagaaagtttgatatactcaactgtctaaatgaatggtacatattctatatgcacagatgcttccacatttgttaatgagtactaagggcaaatagggaagacgaaaacagtaggaatacaaaagaagggtttcatgaagaagtggaggccagagactggtcttacagaactgatatgatttgagtaagggagagagcaactactataaatggagcaaattccttatttgcaatcttggaaggaaatctttaagaagttactttagtcttcatttttctatttcactttgtactttttagtgactaaaataggttagcagagagcactaagagaaatataataccaagaattagaatcctaaaacctcaagggcttcaggtaccatataacaaatctattgccctgaactcaagctccattaccacagtcctgatgactgtctctctgctgattgagtatctccttgaaccaagagctcaccattttatgaaacaattcccttccttgtttcagaatagtctacagatatgaactgaagatcattaaagtattttaagtacacaaatcaatattcccatttgctagccataaaaacactgaaaagtcaaggggaaacatctgcataataaaattaaagactttcatataacttttaggtttcaaaatgaaactacgtgtaaggagactaaaacccagactttcctaaggccacaaagcaatttagtggtaaaaacattctctataaattcaatcttcttaacatctttccagtatgtgttactgtcccacatattctaatccaaaagactctattttgtgtttcatatcaagaactacatgctctgctccacagccttctgaaaatgaaaaaaaagaagtttaatgatctattcagatgtgtttcccttccttcgtgcactgtaattatttccaataaaaatttaaggaggttaactggaagatctgacacaaagcttgagctaaatgtaccaccctctcctcataccaccaccctcccctgaccctctttcatataaaaaatagtacattttaacttcaaagaagttcctgttatctgtgtactctctgcccatggaaattacatatacaacatacatacagtctccagatactccatttctatataggcactttcaaaggaggaactcaggcattaagttctttctagaattgaaaacgctcactcagaaatagcacctccagccctttctgacaggtgaagccctgtctatcaatcattgccctgctgccttgttttctttctttttttttccagtccagtgtgatcaactgaaacaatatcactatccagctctgagcatattcattttacttacatgtacattggaagttctttggtgactaatacttaaaattatatcagtttacttaaaccatgttcaatgaaaaatagataatcaaaaagatttttttccacagaagctgtttgactaacagtttatgagaattcaatgttagtttctttcattctaactttttaattatttttaactaaacatagttaagaaatggaggtttctgtcagcaatccaagtctctcaagttttccaggatgttttatctactgaattcttgaaatgtctactaagaacagtgcaataatttccataagcaaaggatgcctaccagtacagaacccaaagcactaagccctgctaaggcacagcattcacatggcacactaaacaaaaattttaacaaaattgtattcatttttatcaatttataatttatcctatcaattttcaaaaaactttaaaacagtgtaggataaatacatgtataaaataagcagaattaaaataaaaatcaactaaaaatcaactaacaaaggttcatgtgatagaaattatattagaaaaatataatatgtatttgtaggaactactaaaattaaggtttcattaattgttatgatcttcttgacaacatggctctcatcatctgctataagtggacccatctgtttcttactatacatacatttatacatgtatgtgtatatgcctccctgtgttggtccatttgcattgttataaaggaaataacctgaggctgggtgatttataaagaaaagaggtttatttgactcatggtttatttggctcattctgcagggcttctggtgaggcccaggaagcttttactcatagcagaaggtaaagggggagccagcatatctcatgatgaaagcgggaacaagagagaggagggggtgccaggctttcttaaacagtcagatttcatgtgaactcatacagtaagaattcattcattatcacaaagactgtatcaagccattcatgagtgatcagtccccaagacccaaaccctaccactaggcccacctccaacattggaggtcacatttcaacacaggattttgaaggggcaaaacatccaaactacatcactccataagttgttaatgcagtgtttatcaaaggcatgacttaatgtaagtcttggaactgtattcattgcttagttttaatgttacatattatacatattatataatctctattaataaattctcattaaaaattaagaacaattaattgttaatgtactaggtgatttgtttaaaataaatttctaaacaggaagtataatgttctcattcatctatttattcatttattcaacaggaagatgaaaaagccatggtacctaccccgtggcaagcaccgtgaacaaggcattacatgcgtaatgctatttaatcttcacaacagtcgtggtaagaaagtattgccatacccatcttacagctgaggaaactaaagctcagaaagattagaatataccagtaagtagtggagttgggacttgaactcatttgcctagctgcatattaagattctcaccactacataatgtagtctcacaacaagtactaacttaccatttatgtagtaccaaagaccaacttaaaatgtagtgtagactcagaatcacaactagaatgtggtccttgatttttaaggtgtttacagtccactttacctcactaacctaactagagctatgctaggcatatcttggagttcaatgattagttaacaataaatttaaatatagaatgagtcagtagatataatattgagtttctattatatggcagctgcatgcaaaacattgtatatgatgaataaggtgaaaataacccacttctaacattaaacagtgacgtttactagaatctttgatgtaggtaacagagaagtaaaaataatctgtagttgctttttaactttttccttcagactactgaggaaattatgttccacttaatatcaaaccagctttcttgatttattttctaagccaaggttaatgctcttatactaagggtcactaacagattccttaccatttacaccattagattgtatagcattaagataaatctacactagcgtgagaaacattactgttttgctccttatcattacttatatatgtatatatcaccttgtgccagaaaggatataaagtgttttataaggatacataaaacacaaattagcataaatttaaagttggttaaaaaaaaataaaggtaaagacaaagtaaggtcgctatacatcactgtggtggctgcaaatttggctcctttctttctagcaacctacctgaaataagaaaacttatcacttattgaatttacaattccaaaggtatttttctcattgcttaaggaatatatgatatccttggaattaagatgttttaatttctccaaacctcttttaaaaatatgtgacctaataaacaactattttcatgcttcatccactaaatatatgcattatcttcatagacatggtttttcttgttccaggaataaaagaaaaggtactgagttacatgtttgcattcttctagattcccactacttacacacacaccacccactaaaataacagattcttgtttgtttgataaattcccaggtcttcttccattgtgcaggctcaaagttccaggggagcccaaaactgaaacagctccctaaggctaggcagaactgtttaataaaactctgagccagtgaagaaagggaacaaatacaggaagctcgtatgactcagtttagagaaaaagctttctgagagcttagaaatagagcatggaatgagaggaagaaattaggcagctgctacatatagaagattgtaaaaatgagagaataaggaaaaaatatttaagaaagccttactgagtattatgcaattattcccctttgcctatttgataagaaaaagtggtaaagatttgaatttcttttcaattatttttgatgctactttgttgcttctttcaatgtgaatgccaccaaaaaggcctattttgataagaaaaagtggtaaagatttgaatttcttttcggttattttacatgctactttgttgcttctttcaatgtgaatgctaccaaaaaagggcctattttgataagaaaaagtagtaaagatttgaatttcttttcaattattttatatgctactttgttgcttctttcaatgtgaatgctaccaaaaaagggaaagagatggcttgctttatgcagcttatagtctaatgacctcagtatagaataatggcatcccagggcctcctgtggctccagccatctgcacacttgtggttgacaagggacttctccttctgtccagaattcacttatgcaagaatgggactttttaattttttcaaacctcagaagttttctttcagaaactagaaaaagcataataaggaaacttgaaccaaaaagaacacttctacctaatatagtttttgaggtgcccctaatctctattgagacccagaatctttcagtgatcacacattcatcaaagtaatggttttcagccttcttcacaaactctaatagaataaagtttgcaccactgttacctttgattgtacaaatatctatatgtgtatagttaaaaacactagtttaaaggaagaaggaatcatatataggagaattacccaactcttcacccttttttttctcttccccacttcattctcctaaaccaaggctgcatgtgaaacttgagcattctgagcgcaaagcaacagcaccatcagagcaagacagctgtgtccaggaactacattcctacagagggtttggcagccagtgtggtcccacagtgcctggtggggatataccctgaaggatctcaaaaaaaaaaaaaaaaacctggggagtgttggaggacagcagaagtttcacagtcatgcaagtggaagctaccagcctgtgcacgggagctttaatattaatgtgacctcctggtcacatacagtgcagtaaagggacatttaaataatatacaaaatggaaataccatcaccttatctgcttatgtctctacattgtttcgagcatctaaaaatgaaatgcataaaaaggcactcagaaactataatgtacaatataagtatatgccaatattctaacttccaaataaaacttactcataaattaggtatagggttagacctgattctgaattctttacattgccatgcaccatagggaatgtgcttctaaaaatatgcaataagttatttggacagtctgacgaaagcataaggagttcttactttttataattacacattgaatttcatctcatttatttacgttcggtcctgttttcaactacttggaattcttctgagcagaaatttttctttatacagacattacataactcacaggtctcaggctactcaccccctccatgtccatctccttctgcccctctaacataccacataccacccttcttaccctctcttcagatggtaaaatgggcgtttctcacattcttttacctaagatctgacttcaacacttgtttgaactgagttgaaagccttcattaaacatcagcagaaaaaaagactgacaatagatcctagggggaagtgaacaaaaaggaaagaaaaacaaagcactgaggaagatcatcttaaaggaaaaagatagaaaaagtcttatactttaatcccaatggcctttgtatatgttttaagaatagtgccagaacacgaaaaatgaggggtttcatttacttatgactgaaatactgagaatgataaaggtaggaaatagtgtctgtcacttaatgattacatgactgataattaccttaagaaagttggccatgcacattaacatgagttccacataatgttaataacaaagcaaaccacaagttcctttttggttaattcaagtctgatcaaaagcaagtgaaagcacatacaattctcacaaaagttaagtatttgttaagacctcattccaaaacctccgtcctaccttcctatccttctttaaatcatctgaagttctgatctgtaacaagaagcccgttagttgagggaggacccaagacggccgaataggaacggctctggtctacagctcccagcgtgagcgacgcagaagacgggtgatttctgcatttccaactgaggtaccaggttcatctcactagggagtgccagacagtgggcgcaggtcagtgggtgcgcgcaccgtgcaccagccgaagcagggtgaggcattgcctcactggggaagcgcaaggggtcagggagttccctttccgagtcaaagaaaggggtgacggacggcacctgaaaaatcgggtcactcccacccgaatactgcgcttttcctaggggcttaaaaaacggcgcaccacgagagtatatcccgcacctggctcggagggtcctacgccccacggagtctcgctgattgctagcacggcagtctgagatcaaactgcaaggcagcagcgaggctgggggaggggcgcccaccatagcccaggcttgattaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaaccagcagactgcctcctcaagtgggtccctgacccctgacctctgagcagcctaactgggaggcaccctccagcaggagcacactgacacctcacatggcagggtattccaacagacctgcagctgagggtcctgtctgttagaaggaaaacttacaaacagaaaggacacccacaccaaaaacccatctgtacatcaccatcatcaaagaccaaaagtagataaaaccacaaagatggggaaaaaacagaacagaaaaactggaaactctaaaaagcagagggcctctcctcctccaaaggaacacagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgacgtgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactccttgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaaaccagaagagagtgagggccaatattcaacattcttaaagaaaagaattttcaacccagaatttcatatccagccaaactaagcttcataagtgaaggagaaataaaatactttatagacaagcaaatgctgagagattttgtcaccaccaggccggccttacaagagctcctgaaggaagcgctaaacatggaaaggaacaaccagtaccagccgctgcaaaatcatgccaaaatgtaaagaccatcaagactaggaagaaactgcatcaactaacgagcaaaataaccagctaacatcataatgacaggatcaaattcacacataacaatattaactttaaatgtaaatggactaaatgctccaattaaaagacacagactggcaaattggataaagaatcaagacccatcagtgtgctgtattcaggaaacccatctcacgtgcagagacacacataggctcaaaataaagggatggaggaagatctaccaagcaaatggaaaacaaaaaaaggcaggggttgcaatcctagtctctgataaaacagactttaaaccaacaaagatcaaaacagacaaagaaggccattacataatggtaaagggatcaattcaacaagaagagctaactatcctaaatatatatgcacccaatacaggagcacccagattcataaagcaagtcctgagtgacctacaaagagacttagactcccacacattaaaaatgggagactttaacaccccactgtcaacattagacagatcaatgagacaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataagaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacactcaaaagctagcagaaggcaagaaataactaaaatcagagcagaacggaaggaaataaagacataaaaaacccttcaaaaaattaatgaatccaggagctggttttttgaaaggatcaacaaaattgatagaccactagcatgactaataaagaaaaagagaagaatcaaatagatgcaataaaaaatgataagggggatatcaccaccgatcccacagaaatacaaactaccatcagagaatactacaaacacctctatgcaaataaactagaaaatctagaagaaatggataaattcctcgacacatacactctcccaagactaaaccaggaagaaactgaatctctgaatagaccaacaacaggatctgaaattgtggcaataatcaacagcttaccaaccaaaaagagtccaggaccagatgtattcacagccgaattctacaagaggtacaaggaggaactggtaccattcctactgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaaccagaagcattgcctttgaaaactggcacaagacagggatgccctctcttaccactcctattcaacatagtgttggaagttctggccagggcaattaggcaggagaaggaaataaagggtattcaattaggaaaagaggaagtcaaattgtccctgtttgcagacgacatgattgtatatctagaaaccccattgtctcagcccaaaatctccttaagctgataagcaacttcagcaaagtctcaggatacaaaatcaatgtacaaaaatcacaagcattcttatacaccaacaacagacaaacagagacccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccacgctcatgggtaggaaaatcaatatcgtgaaaatggccatactgcccaaggtaatttacagattcaatgccatccccatcaagctaccaatgcctttcttcacagaattggaaaaaactactttaaagttcatatggaaccaaaaaagagcccacatcgccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctgtttaataaatggtgctgggaaaactggctacccatttgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactcaagagcttctgcacagcaaaacaaactaccatcagagtgaacaggcaacctacaaaatgggagaaaattttcacaacctactcatctgacaaagggctaatatccagaatctacagtgaactcaaataaatttacaagaaaaaaacaaacaaccccatcaaaaagtgggcaaaggacaagaacagacacttctcaaaagaagacatttattcagccaacagacacgtgaaaaaatgctcatcatcactggccatcagagaaatgcaaatcaaaaccacaatgagataccatctcacaccagttagaatggcgatcattaaaaagtcaggaaacaacaggtgctggagaagatgtggagaaataggaacacttttacactgttggtgggactgtaaactacttcaaccattgtggaagtcagtgtggtgattcctcagggatctagaactacaaataccatttgacccagccatcccattactgggtatatacccaaaggactataaatcatgctgctataaagacgcatgcacacgtatgtttattgcggcactcttcacaagagcaaagacttggaaccaacccaaatgtccatcaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtggggggaagcaggagggatagcattgggagatatacctaatgctagatgatgagttagtgggtgcagcgcaccagcatggcacatgtatacatatgtaactagcctgcacaatgtacacatgtaccctaaaacttaaagtataataataaaaaaaaaataaataaaaataaaaataaaaagaatgtggccatgatgacagggaggaagatttacctcagacctgcagtatggacttctactcatcaatatttactggtcacagaaactgctgaattcaaaatctgccaacaataccatctgtgtgctacagaataccttattcaggatcatattattactcataccatcattgttgaccaaggaatttattttacagcaaataaaatgtggcaaagggcccttgctcatgaaattaactaatcttgccatgattttcttcatagcatggataatagtatggtggaatggctttttgaagactcatttatgatgtcagccatatggcaacacttttcagagctgaagtaatatccccagtatattctgcatggtcagcatacatgtgtggtgccatatcgcttacagtccaaatgtatgggtcaaggaatcaaaaggagggaaaaaaaattagaatgtactatcactatttcttcaggtgatatactagcaaacttttgccgctcattgccattattttaggccctgtgagtttagagatcttaatttcaaaggaagtaatgcttctatcaagtgataatgcaataatgattgcattgaactagacattgagacttgacccagccaaattagggccttcaattaacaggcaacaaatggggtttctgtactagttggagtgattcttctagctatcaaggtaaaattaggtttctactaaaaaataaaaagatatatatacctgaaatggaggagatcttccagagtgcttattagtattctcatttcttgtgattgaaatcagtggaaaactagcacagctcaattcaggatggactgataatcacccagatccttcagcaataatgatttaggtaacttcatcaggcaagaaattaaacaaactgaagttcttgctgggggcaaaggatataaaaatggtagtggaagaagctgtttaaacataccagctataacgatgagaccagttgcggatatatggactaacttaattatgagtatttcttatctttatataaatatgactcttttgtgtgtgtgatatcacatacacaatgtttactttattttctttcttccctcattccctaatcatgtaaaataagatgtgttaataatgcttaactttatatctcagtatttaaggtacaccgtatcaataatggagcatgaatagaagaatgaatatcaaaaaaaaaaaaagaagcccgttagttaaatcagtatgggaagtgggcaatgctgtaaaacagcagctgacatcagtattgtaaaatacataaaatctttcataaaatgaaagatagcacagacagctataagaggcatgtttgctttgaaataccccttaagaatcttagcactacacagtacctgccacagagttacctttttacaaagaaagagtaattctccaaaatcttacaacatttctgcacaatactggctaaggtcattctgatccagtatgacccagccagatattgcattataatacctgtattagaatgacaattctcacctccaggatgttagtaaaataccaatctgattactaattcaaacaaaaatacagggagggagcatcaaatatccataaaaattatttacagcaactgtagttattcaggtcatttttacagaaagcctatcccctgggccaatgtatttgtggcatttttttttattactacatagctcaaaagtgcctttcatgctcagcaggcacatcataggcaaagaactgacaaattgaaaagctatcataagaatataaatcaaaaattctataaaatttggcttatatgcccaaagatgtcaaaaacatgatatactacatcagttattcaccatcaacaaaaagaaacattgaaagcatctattttaatcctgatttttacacttgcagattttcccccaccaaatttatcttaaataattcttaagtacactttctcctcatatatattttattggctttcccttaaacatgaaaaattatagcagtttctctacacatctaatcaactcatttcagtaaaaaccataaccaattaaaatttattctcaaaaaaaggaatctaattcttaaccataggctaatgatgcttaaaagaattgctttgcagcttgaccagcagatgggacatcactttagactgcaacacaaggagaaattgatgagaaaaaactaagagactttctgttaggagaaaaactgtaagggacaccacaggaaggagccatttataatcattttctcctccacataatttaaagctgtgggccaggagccaaatgatggcaaggaacacacctcccaccaagcaagaattaagataaccagctctaatataagcaacacaaaactaattattctcataaattcccttcatagtgttaacacaaaacatcaacactatggtgctgacagcagcaggcagggaagtggtagaaaatttagatccagcactttcctttaaacttagattagtacatcatagcaatatctatattggaaaagtacaaacagaactaacagaagcataatggaacaaatttcagaatgtgaatagtaggaaacattttcagattataacaacatatattctaaatgatgacattacataacaacaatagttaagattttttaacatttccattaatcccactatccaatttaatcccccaacaacctatgtggatagaattatttccctactttacaaacaagaaagtagaggatttcagggtgacctcaaggcaataattagtttaatggcaaagccacaagtcttggtttccatttcagagctctttccaatatattaagctgcctatctatgtatattttttagtattattaacagtaaatattaaattaacatttaaaaacatcactttaaatgtatgtttgtaaaataaaagcagagtatatttttaaagaaagatcattgaaaattttaaatgacataaaaatttctttagatgattactgtaaccaaaaagaaataatcacaaaactatctgaaagcaaataacaacatcaacttgtaaacatcaattattcagaaaggaaacagaatatatcctaggaagacacaaagttgaaactcaatatgaatctagaaaaataggattatatgtttaaacttataatttatttgatgatgacactataaaaaagaacattcaaataaaatattaaataagatgcttctgacatttgactaaattcaatagatattatcattattaatatggtatcatcatcaaaattatcatattggtaaaattatcattccagctatgtaatttgatcatgttttattataagcatcaaaatcaatgtacagatgaccactgaataacatgggagttaggagtgtcaaaccccacacagattttcagctgcatataactttcaacttccccaaaatttaacaggaatgtctactgttgatcagaagccttaccaataacataaacaattaacaaacattttgtatgttataaagcaagctaaagaaaagaaaatgttgttaaaacaatcataaaaaagagaaaatatatttattatttgatatggtttggctctgtccccacccaaatctcatcttgaattgtagtttccataatccccatgtgtcatgggagggacacggtgggaggtaattgaatcgtgggggcagttaccccatgctgctgttattgtgatagtgagtgagttctcacaagagctgatggttttataaggggctttcccccgttttgattggacttctccttcctggcaccatatgtttgcttccccttcgccatgttgtaagtttcctgaggcctccccagccattctgaaccgtgagtcaattaaacctctttcctttataaattacccagtcttacatatgtctttattaccagcatgagaatggactaatacagtatattggtaccacagagagtggggtgctgctgtaaagacacccaaaaatatggaagcaactttggaactgggtcacaagcagaggttggaacagtttagagggctcagaagaaaacatgaaaatgtggggaagtttggaacatcctagagactaggagagctcagaagacaggaaggtgtgggaaagtttggaacttcctagagatttgttgaacagctttgaccaaaatgctgatagtgatatggacaataaagtccaggctgaggtgatctcagatggagaggaggaactttttgggaactggagcaaaggtgactcttgtcattctgtaacaaagaaactggcagcattttgcccctgccctagagacttgtggaactttgaacttgagagagataatttagggtatctggcagaataaatttctaagtgacaaagcattcaagaggaagcagagcataaaagttcggaaaatttgcagcctgaggatgcaatagaatagaaaagcccattttctggggagaaattcaagcctgctgcagaaacttgcataagtaacaaggccaaatgtaatcaccaagacaatggctaaaatgtctccaggccatgtcagagaccatcacagcagcccctcccattacaggcatagaggcctaggagaaaataatgatttcatgggcagagcccagggcccccctgctgtatgcagacttgggacttggtgccctgcatcccagctgctccagacatggctaaaaggggtcaaggtacagctcaggctatggcttcagagggtgcaagccccaagccttggcagcttccacatggtgttgagcctgtgggtgcacagaagtcaaaaactgaggtttaggaacctctgcctagatttcagaggatgtatggaaatgcttggatgtctaggcagaagtttgttgcagaggcagagccctcatggagaacctctgctaggaagtgtggaagggaaatgtggtgtgggagcccccacacagagtctccactggggcactgtcaaatggagttgtgagaagagggccactgtcctccagaccccagaatggtagatctgctaagagcttgtggctggaaaagcagcagacactcaatgccagccagtgaaagtagccaggagggttgctataccctgaaaagccacatgggcagagctgcccaaggccatgggagcccacctcttgtgtcagtgtaccctagatgtgagacatgaagtcaaagagcattttggaactttaaggtttaatgactgccctattggatcttggacttgcatggggcctgtagcccctttgttttgaccaattttgcccacttggaacaggtgtatttactcaacacctgtacccccattttacctaggaagtaactaacttgcttttgattttataggctcataggtggaagggacttgccttatctcagatgagactttggacttgtacttttgggttaatgctggaatgagttaagactttgggggactgttaggaaggcatgattgtgttttaaaatgtgatgacacaagatttgggaggagccaggggtggaatgatatggtttggctgtgtccctacccaaatcttatcttgaatttagttcccataatccccacgtgtcatgggagggtacctggtgggaggtaattgaatcatctgggtggttacctctacactgttgctttcatgatagtgagtgagttctcatgagatctgatggttttataaggggcttttcccccttttgcttggcactcctccttcctgtctccacgtgaagaaggacatgtttacttccccttctgccatgattgtaagtttcctgaggccttccagccatgttgaactgtgagtcaattaagcctctttccttcataaattacccagtctcagatatgtctttattagcagcatgagaacagaacgaatacactattcattaagtggaagtggattatcatgaaggccttcatccttgttgtcttcacactgagtaggatgaggaggaggagaaagagaaagggtgggtcttgctgtctcagtgggggcagaggcagaagagatggaggaggcagaaagggaggcaagagagacaggcaccctccatgtagcttttattttttaaaatctacatataaatgcacctgcacagttcaaatccttgttgttcaagggtcaactataaacgaatttgttagagtgacagacaagtaccacctttgctcaaattgtaaaaccaatattattaattttatagcattttatcagcattttttcattaaatgaatatacaattgtcacattaaatcccctagactctcatcaaaattgtaaatcatttcattagtaatcaaataaaatttgcagtttttggctaagtcattgacaacactccatgctctgtcccatcctaactctttcaacaccattttctaccatgtaatccaaatatactgggcattttatgctttctcacttttacaacatctcccaaggttttttccaggtagaacaccctccatttctccttgttaaaataatacctgatcttcaccacccaactcacatcctatgtccttagttcagacttccctgatcctgtcaactgttggagatcttttcctccattaaggtacttaccaaagtttgtcttatgtttctgataattttcataagtctcaaataactataagcattatggtaaccaagactgttttaaacttttgtatctcccaaaatacttcagtaccatagatcaagtacacattcatgaattctgcatctactacatagtcagaaaagtggaagaatttctatagttatattttaattacaatttttttttattatactttaagttttagggtacatgtgcacaacatgcaggtttgttacatatgtatacatgggccatgttggtgtgctgcacccattaactcatcatttagcattaggtatatctcctaatgctattccctcccacctccccccaccccacaacagtccccggtgtgtgatgttccccttcctatgtccatgtgttctcattgttcaatttaattacaatctttaaaatcacagaaactcttgaatacatataccaaaaccttcaagatgccaataagaattttactctgttgtgagtgcttgtcatttgtaactatattgttcccacatctaacaatctatcacccataaacatgtcaaagtactgtgacaaagtataacaaatgattctccaatattttgaatagatttacttttaaataaatgttacagatgtattatgaaataagaaataagcttacaaatacatttattttaacatcttgtgttgattatgagaacaataaaaatgagcaattcacgggaaaataatttcagatagattttgtctccctacaaatgggcatcctgatattcactctggaataaatactttaggaagaagatgatattgagatcatatccctttgtttggtaatcaaaggcttatttttcatgtggaaaattttaagtgctaataaataatccactgcaaaccacataatttttgaaaataacccccaaattatatacacaaacaagtaaattttagtgaatgtatgcaattgctattggcagttattagatcctaattacttttcaaaagtggaattaataatatgtaatttaatgtcttacaggatattataaagatgtaattttattggactttgcttctaatacactgaaccataaggctaaatttaaaaccacttagaaaagaatattagaattaaattacagagaaatttacaactaaattaagaaactctatcaattaaaaaactttgctgtcatcctcaaatgtgagtgcttatctaataatatgatcctggactaagtgttgtgtatacttcagatataaaattttcatataggctattcctaggcaaatacaaaaagtaaacaaaaacaaaacaaaaaatactgatgactagtgatcacattaaaataaatgacatcataaaagtgacccttttccccttccacctcccaccacattaggacagcaacagagcatcagcttggaagcaaaagcagccctcacaagatcacacctgtcagtgccttgatcttgaactcctgagcctccagaactatgagaaataaatttctgctctttaaaaaccacccagtttcagcatatactgaaaattcaaaacttgccatacttttaaaatatagattgggactagatacagtcagaaattgccactcccacagaaagagacccaatttaatatacaccaacataatttgaacaaatcttcagagagaaactaccaaacatggattgagaaaagatgcagtcccagagactgaagaagaaggaagttaggcacccaatgtggggtgcctgaatgctaaggctgatttccaaactggaaaggtacctggggaaggggattggtccagtaaggatatgggttatttccataccagacctctccctaagggagccccgtggccccaaagacctaataaaaacaacaacaaaatcgaaggtacagtgctagtgattggatgtggctcccccaagcagacctgatgagggggtcatctatttcccccttgcactgcagaacacagctgcaaatgttaacatagacaaaggaaccacaaggctgagtagaagcctatctactgcccattgctctcaaggaccatctactagattgtagcccaaactacaacaccaaaatcactttactaatcctgcccttgcaaaaccaagagtaagaattctgcaacgaagacaccatacagagccttagttctctaaaaactttcagaaacaaagccaacaaagtacactcaatttacaccacaattaaaagaataccatccctcccagatgagaaagaatcagcataagaactctggcaattcaaaaagccacactgcccccttacctccaaatgagcccactagctccccagaaatgtttcctaaccagtctgaattatctgaaatgacagacatagaattcaaaatatggatggcaaagaagctcattgagatcaagaagaaagttgaaactcaatccaaggaagccaagcaatccagtaaaatgattcaagggctgaaaggtgaaattctcacttaaagagagacaaaaacttaatttcttgagctgaaaaattcactacaaaaattacataatataattggaagtattaacagcagaatagaccaagctgaggaaagaatctgagagctcaaagagcaattctttcaattaacacagtcagacaaaaatacagaaaagagaattgagaaagatgaagagcagagagtgggccgagacctccaattagaagtagctatggtgcatggcactcataaagaggaagaaaagcagtgagtaaatacagcaccttcaactgaaatatccaggttttcgcactgggactgatcagggaaataaccaatccacagaaaacagagaaaagtagggcaggatgatagcccacctggaagtgacgcaaagccaagggaacccccaccccagccaaggaagtggtaagtgaatgtgccaccctgggaaaccacatttctcccatggatctttgcaaccctcagatcaggagatcccctcataaacccactccaccaggaccttgggtcagatacacagagctgtgtggagtctcagcagggcagccactcaggtatgcacagagacccaggagatttacataccccagccacaggatccctggcaaaggtgactacaactcagtcaaggcgggaggtccatacatacccctaggaagggggccgaatccagggagctgaacagcgtccatctgtgggccccatttccaaggcacctcacaaaataagacccactggcttggaacttcagccagccaccagcaacagggtagtgcctgcctgagatggaatggagctgccagggaaaggggtgggctgtcacctttgttatttggacaactcagctgttcaagtctgtgggctttggagagtccaaacagtctggacaagtaagggacccccagcacagcacagcacagctgctctatgaaaatgtggccagactacttctttaagtgggaccccaatccattccaccccactgggcaggacttcccaatagggacctccagccacccctgcccatattctaggaaagaactctgatctctcccttggctggagtgcccagtggggagggatgagctgccaatgttgctttgagcccattccagcctgtaggctttgcagaatccaagccaatacaggcagagatggatccccagcaacgcatggctgttttgtcaaggtgtggccagactgcttctttaaatagaaccccaatccattcctccttgctgggcaggtcctcccaaccagtgcttccaaccaccctcacccatgttctatggctgacaaagttctaatttctccctgtgatggagtgcccagggggccaggtgggctgccacctgtgctgtttgggcatctcacccagtccaacctgtgggccttggaaagtgcaaaactatatgggggtgaagggaagccaaacacagcacagctgctctacaaaaacgcaggaaggctgcttctttaaggaggtccctgatcccattcctcctgactaggtgagacctccaaaacagggtttccagccacatcctatgggtgcattcaggctggcaacaggtcagtacttctctgggacagagctctgagaggaaggggcaggctgccatctttgctgttttgcagccttcaccggtaatacctacaggtactgaaaaaactgaggtgactagggtctgaagcagccgcccagcaaatcatagcagccctacagaaaagtggtcagactgttcaaagaaaaaacgagcaaaacaacaagaacaacaacaacaaaaacccatccaaaggtcaacaacctcaaagatcaaaggtagataagccaacaaagatgagaaagaatcagcacaaaaacacagaaaactcaaaaatccagtgtgctccctttcctctaaatgaccacaacacctctccagcagggatttagaactggactgaggctgagatggctgagatgatagaaataggattccaaatgtggatctaaaaaatgaacttcactgagctaaaggagcactttgcaactcaatgcaaggaagctaagaatcatgataaaacaatgcaggagctgacagccaaaatagccagtatagagaggaatataaccaacctgatagagctgaaaaaaacacaacaagaacttcacgatgcaatcacaagtattaatagcagaataggccaagcagaagaaagaatctcagagcttgaagaatgtcattctgaaataacacaggcagacaaaaatagagaaaaacaatgaaaaggaataaacaaaacctccaagaaatatgggattatgtaaagagactgaatctatgactgattggggtacctgaaaaagatgaggagaatgggaccattttggataacataattcaggatatcatccaggagaacttccctgacctacctacagaagccaacattcaaattcagaaaatgcagagaaccccagtaagatacttactccacaagaagatcgtccccaaaacatgtaatcatcagatcctccaaggtcaaaatgaaataaaaaatgtcaaaggccactggaaagaaaggcgaggccacctacaaagggaagcccattggactaacagtggacctctcagcagaaaccatgcaagccagaagagattgggggacaatattcaacatttttaaagaaaagaaattccaatgcagaattacatatctagccaaactaagcttcataagagaagaaataagatccttttcagacaagcaaattctgagggaatttgttaccaccagacctgctttataaaagctcctgaaggaagcactaaatataaaaagggaaaactgttgccagcctctacaaaaatacactgaagtatacagaccagtgacattataaagcaactacataaacaagtctgcaaaataaccagctagcatcatgatcacaggatcaaatccatacataacagtattaaccttaaatgctccaattaaaagacacagagtaaaaagctggataaagaaccaagacccactggtaagctgtcttcaagagacccatctcacacgcaaaaacatacacaggctaaaaataaagggatggaggaaaatttaccaaccaaatagaaaacagaaaaaagcagggattgcaatcctagcatctaacaaaaaaagactttaaaccaaaaaatatcaaaaaagacaaagaagagtattacataatgataaagggttcaattcaacaagaatagctaactgtcctaaatatatgtgcacccaaaacaggaacacccagattcataaagcaagttcttagagaccttcaaagagacttagactcccacacaataatagtgggagactttaaaaccccattgacaatattttctaatatctctatcatcaagacagaaaattaacaaaaatattcaggacctgaactcaactctggatcaagtggaactgacagatatctatagaactctacaccccagaacaacagaatatacattcttctcattgccacacatcacttactctaaaattggtcacataatcagaagtaaaacactcctcagcaaatgtaaaagaactgaaatcataatgaacaatctctcagaccacagtgcaatcaaattagaaatcaagattaagaaatgcattcaaacccacataatatggtttggctgtgctcccaccaaaatctcctcttgaattgtacttcccaaaatctccacctctcatgggaggaacctggtgggaagtaatcagaacatgggggcagtttcctccatgctgttctcataatagtgagtgagttctcaggagagctgatggttttataagaatctgacatttcccctgctggtacttctctctcctgccaccttgtgaaaaagaacatgcttgcttccccttctgccatgactataagtttcctgaggcctccccagccatgtggaactgtgagtcaattaaacctcttttctctacaaattacccagcctggggtatttcatcatagcagcatgaaaacaaattaataccccacaaaattacatggaaattgaataacctgttcctgaacaactgttggataaataataaaattaaggcagaaatcttgaaattaatgagaacaaaaatacaacataccaaaatctctggaacccagttaatgcagtgttaagagggaaacttacagcactaaattcccacatcaaaatgttaaaaagatctgaaattaacaacctaacatcacaactaaaagaactaggaaaccaagagtgaacaaataacaaagctagctgaagacaataaataaccaaaagcagagctaaactaaaggagatagaaacatgaaaaacctttcaaaagatcaaaaatccagaagctaattttctgaaaaaaagttaataaaatagactgctaactagactaataaaaaagaaaagagagaaaattcaaataaacacaatcagaaatgacatggaggatattaccactgacccacagaaataaaaacgaccatgagagaatgttatgaacacctctatgcacacaaattgaaaatctagaagaaatggacaaatccctggacacatacaccctcccaagactgaaccagaaagaaactgagtccctgaacagatcaacaacaagctctgaaatcaaatcagtaatgaatagcctatcaaccaaaaaaagcccataaccagatggattcaccgcttaactctaccagaggtacaaagaagagctggtaccattcctattgaaactattccaaacaattgaaaagcagggactcccccataacccattctatgaggccagcatcatcctgatactaacacctggcagagatataacaaaaaagaaaacttcgggccaatatccttgataaacattgataccaaaaatcctcaacaaaatactggcaaactgaatctagcagcacatcaaaaagcttatctaccatgattaagtagtcttcatccctggaatgcaagtttcgttcaacacacacagatctataaatgtgatttatcacataaacagaactaaaaacaaaaaacacatgattatctcaacagatgcaggaaaggcctttggtaaaaattagcatcctttcatgtaaaaagctctcaataaactcggttttgaaggaacatacctctaaataataagagccatatatgagaaacccacagccaatatactgaatgggcaaaagctggaagcattccccttaaaaactggcacaagacaaggatgccctctcttaccactcctagtcaacatagtattggaagttctgaccagggaaatcaggcaagaaaaagaaataatgtgtattcaaataggaaaggaagaagtcaaactctcttcgtttgcaggtgacataattgcgtatctagaaaaccccactgactcaccccaaaagcttcttaaggtgataagcaacttcagcaaagtcttaggatacaaaaatcaatgtgcgaaaatcactaccattcctgtggaacaacagcaggcaagtagagagccaaatcataaatgaactcccattcacaattgccacaatgagaataaagtacctaggaatacagctaacagggaagtgaaggacctctttgagaagaactacaaaccactgctcaaagaaatcagagatgacacaaacaaatgggaaatcattcaacaacaggcaagtagagaaacaaatcataaatgaactcccattcacagttgccacaatgagaataaaatacctaggaatagagctaacacggaagtgaaggacctcttcaaggagaactacaaaccactgttcaaagaaatcagagatgacacaaacaaatggaaaatcattccatgctaatgaataggaagaatcaatgttttgaaaatggccatactgtccaaagtaatttatagattcaatgctattcccatcaagctaccattaacattctttacagaaatagaataaaatattttaaaatcaatacggaaccaaaatagaactcgtatagccaatcctaagcaaaaagaacaaagctagaggtaccacattccctgacttcaaactctactacagggctacagtaacccaaacagcacagtactggtacacgaacagacacatagaccaatggaacagaatacagaacccagaaataagactgcacacctacaaccatctgatattcaacaaacctgacaaaaatgaggaatggggaaaggattccctatttaataaatggttctgggagaactggctagccctatgtagaaaattaaaactggaccccttccttacactatatataaaaatcaactcaagatgaattaaagacttaaatgtaaaacccaaaattataaaaaccctagaagaaaacctaggcagtactattcaggacataggcacaggcaaagatttcatgatgaagatgccaaaaacaactgcaacaaaagcaaaaattgacaaatgagatctaattaaactaaagagcttctgcacagcaaaagaaactatcatcaagtgaacagataacctacagagtgggagaaaatttttggaaactatgtatctgacaaaggtctaatatccagcatttaaaaggaacttaaatttacaaaaaaaaaaaaaaaaaagccattataaagtaggcaaaggactgaacagacacttctcaaaagaagacatacatgcatgtggccaacaaacatgtgaaaaaaagctcaacatcactgatcagtagagaaatgcaaatcaaaaccacaatgaaataccatctcatgccaatcataatggcaactattaaaaagtccagaaacaacagatgctggcaaggttgcagagaaataggaacacttttacactgttggtgggagtgtaagttagtttaaccattgtggaagacagtgtggtgattcctcagagatctagaggcagaactaccatttgacccagcaatcccattactggttatatacccaaaggattataaatcatgctactataaagacgcatgcacacgtatgtttattgcggcactattcataatagcaaagacatggaattaacccaaatgcccatcaatgatagactggataaagaaaatatagtacacatacactatggaatactatgcagccataaaaaggaacaagatcgtgtcctttgcaggaacatggatggagttggaagctgttatcctcagcaaactaatgcaggaacagaaaacgaaacaccatatgctctcacttataagtgggaggtgaatgatgagaacacatgaacacattgaggggaataacacacactggaggctgttaggggtggaggtggggtagggggagggaaagcatcaggaagaatagctaagggattctgggcttaatacctaagtgttgggttgattgtgcagcaaactatcaaggcaaatgtttacctatgtaacaaacctgcaaatcttgcacatgtactctggaacttaaaataaaagttgaaggacaaatattttttaaaaagaaatgcaaatcaaagccacaatgagataccatctcacaccagtcagaatggctactgttaaaaagtcaaaaaataacagatgctggagaggtcgtggagaaagaggaacacttacacactgttggtgaagagtggaaattagttcaaccattgtggaagacagtgtggcaattcctcaaagacctaaagacaaaaataccactggacccagcaatcccattactgagtatatacccaaaggaatacaaatcattctgtaataagactcatgcacacatatgtttactgcagcactattcacaatagaaaagatatagaatcaacataaatgcccatcaaagatagactggattaaaaaatgtggctcatatacacaatggaatactatgcagccataaaaaggaatgagatcatgtcacttgcagggacatggatagagttggaggccattatccttagcaaaccaacacaggaactgaaaaccaaacaccaagttttcacttacaagtgggagctaaatgataataacacatagacacatggggggaacaacacacactgggtcctgtcaaagggcaaggggtgagaggagggagaggatgaggaagaatagctagtggatgctgggcttaatacctgggtggtggaatgatctgtggagcaaaccaccatggcacacatttacctatgtaataaatctgcacaacctgtacatgtacccctgaacttaaaataaaagttggaaatataaaaaatagtgttggcaagagtacagagaaaagggaactcttccacactattggtcagaatgtaaattagtacagccttatggatgatgcttccccccacccaaaaaaaaaaaaaaacccacagaaataaagctaccatatgatccagcaatcccaatatgtaataaagtatgtcccactactaggtatatacccaaagtaaatgaatcagtatttcaaagagatttctgctcccctatgttcactgcagccaagacacaaaatcaacctaagtgtccatccacagatgagtagataaagaaaatgtgttatatatacacagggggaacctgttcagccttaaaaacaaaggaaagcttttgatttgccacaacattgatgagtctggagaacattatgttacataaaattagccaagcacagaaagacaaatactgcatgatcaaacttgtgtgtggaatccagaaaagtcaaactcatagaagcagagtaaaaatagtggttaacagaggctgggagtgaggagatgggttacccagaaaaatgctggtgaaaggatacaaaatttcagttagacatgaagaataagttcgagaaatgtacaacatgaggaccacagttaatggcaatgagttgtgtaccttaaatttccaaagacagcagattttaagtgttctcattacaaaaaaatgaaaagtatatgaggtcatgtgtatgctaattagcttgatataatcattccacaatgtctacatatttcaaaacatcatgttgtatgccataaatatatacaatttttgtcaagtaaaaatttttaaaggccgaatttactcaaaggttaatttaatatgaccaaaactgagtggttcaagggatttgcttataggcatttctaggtcattgactcaattcctttttatggtcatagttttcagtaacttggctctgtgtagcagcccattccaaatgaggatctgtaccctgttatatttctgttttgtccacaactgagaagaatattcattggattgtgtatctgagttaggggaaagtctagtgcttctagaaaactccatgacaactgtagatcaatgcacagttttctgccttgaaacttgaaatttcaattgtaagacaatattaaatagaataaaaaatgatactctggcaaatataacagagttttccttttttgtgggagtgtcagattttgagttttacaggagaactaggccttctaattctgatttgactttccaactaacatcaaacttagagctccatatctgagggataactggactggtgattgtgcaaaatatttctgtcttgcatttaaagttgtaacgaattgatagaaatcaatcttaccagcactggctgtcatttaattcttattcttaactttggtgataaaaaaaaataaatctgttgaatctgtgcaaagaagcctttctgagaccaaaatggcagctaaaattatttctgtaattaatttctgccttgtgtgtcaatgttctttagaatataaatgattttgtaaatacttggcagcaatttgtttaatttggaagggcacaaagtacactccattgagttggcaaatgcaacatccttctaaatatttttcctaaaacatcaagtatattatatgtatttaaatttatattacaacacttttctgagaaagtgtaatttttaattatgacctaagtctgactacatgcatgtctttgccttcttgtttcatgcattcattagcaatttgaatagaattttaataaaattcaacaaaaagaaaaatgaacaaaacatctgagaaatatgggattatgaccaaatatatgattcatcagcattcctaagaaataaggagagagaataagcaacttgtaaaatacatttgaggacacaggcatgaaaacttctctagtgtcactacagacattgacatgcaaatccaagaaatacagagaatttcagccagatactatacaagatgaccctacccgaggcacatagtcatcagaatcaccaagatcaatgcaaaagaagaaatctaaaaggcagctagagagaaagtgcaggtcacctacagagggaatcccaccaggctagaagcagatttctcagaaaaaaccttacaagccagaagagattaggggcctattttcagtgtccttaaagaaaggaaattccaaccaaaaatttttatatcctaccaaactaagcttcataactgaaggagaaataagaggcttctctgacaagcaaatgctgagggaatacgtttaaactagagtagccttacaagaggtccttaagggagttctaaacatgaattcaaaagaatgacacctgccaccacaaatgcacacttaagcacatagctcacaggcactataaagcaactacacaagaaccagctaacaatacaatgatagaatcaaaatcacatatatcaataataaccttgaatgtaaatgggctaaacagcccactcaaaagacacagagtggcaggctggataaaaagacaagacccaaccaatctgttgttttcaagagacccatcttacatgtaatgacacccacaaactcaacgtaaaagtatgcggtaagatctaccatgcaaacagaaaacaaaaaagagcaggtgtcaccattcctcatcattcattcattcttcatcattcaattttcattcttcatctttcatcattcattcttcatgtttcatcattcattcttcattcattcatcattcattcattcatcagataaaacagattttaaacacataaaaatgaaggacaatgaagggcactgcataacaataaaggatacagtccgacaagaagccttaactatactaaatatatacacacccaactttggagcactgagatttatacaacaacttcttcttggcctaggaaaacacttaaacaaccacacaataatagtgggagacttcaacaccctactgacaacattagatcatcaaagcacaaaactaacaaagaaactctggacttcaactcaacacttgaccaaatgggcctataaagcactccatccaacaaccacagaatatgcattcttctcatctgcacacagaacatattcaaagatcaaccacatgctcagtcataaagcaggcctcaataaattcagaaagaaattgaaactataccaagtatactctcaaaccacagtgtaataaaactagacatcaataccaaaatgatctctcaaaattacacaaataaatggaaagtaagcaacttattcctgaataactcctgggtgaacatagaaattaaggcagaaatttaaaaaattatttgaagttaatgaaaataggaacacaacttaccaaaatctctgagatatagccaaagcagtgttaagaggaaaattaatagtcctaaatgccttcatcaagaagttagaaaggtctcaaattaacaaactaactttgcacctacaggaacaagaaagaaagagaacaaaccaactccaaagctagcaaaagaaaagaaataactaaaattaaagaagatcttaatgaaattgagatgcaataaaccatacaaaagaccaatgaaaccaagaattggttctttgaaaaactaagactggtagaatccctaactaaatcaacaaagaaaaagaaagagactatccaaataagcaaaatcagaaacaacactaatgatattacaactgatcccacagaaatacaaaagaacctcagagactactatgaacaactctaggcacacaaattagaaaatctaaaggaaatggataaattcctggaagcatacaatctccaaagatggaatcatgaagaaattgaaactctgaatagaccaattttaacttctgaaattgaatcaataataaagaacctaccaagcaaaaaaagccctggaccaagtgaattcacaccccaattctaccagacatacaaacaagaactgatactaatcctactgaagctattccaaaaaactgaggagcaggggctcctccctaacttattctataagacaagcatcagcctgataccaaaatcaggcagagatacaacaacaacaacaaacttcagactaatatccctcataaacacagatgcaaaaatcctcaacaaatattagcaaattgaatctagcagcacatcaaaaagttaatacaccacaatcaagtaggctttattcttgggattcaatactgaaatcacatttgttgtgatttgtgatttgctgtgttgcaagattgcaaatacttgcatatgttgcaaatcatatttgcgtttgttgcacatgttgcaaatcaacaaacatgattcaccacacaaacagaatcaagagcaaaaactataggatcatctcaatagatgcagagaaaccttttgataaaattcaacattccttcattataaaaatcctcaataaacaaaggaacatacctcaaaataataaaagccatccaggcaaacccacagccaacatcagactgaatgggcaaatgatggaaatatttcccttgagaactagaacaagacaaggctgcctactctcaccacttctcttcaacatagtactggaagtccttgccagatcaaccaggcaagagaaagaaataaaaggaatttgaaaaagaaaagaagaagtcaaactcttttcactgacgatatgattttgtacctagaaaaccctaaagactgctaaaaggttccaagaattaataagcaactttagcaaagtttcaggataaaatcaatgtacaaaaatcagtatcatttctatacaccagcaacatccaggctgagagtaaaatctagaacacaattccacttacaatagccacaaataaaatgaagtatctaggaatacagctaaccaggaggtgaaagatctctataaggagaacaacaaaacattggtgaaagaaatcagtgataatgcaaataaatggacaaacattccatactcatgaattgaaagaatcaatattgttaaaatgaccatactgcctaaagcaatttacagttactgctattcctgtcaaactactaatgtcactgtttacagaattagaaaacactattttaaaattcatatagaacgacaaaagagtgtgaatagccaaaacaatactaagcaaaaggaaaaaagacagagacattacactacccaacatgaaactgtactacaaggatatggtaatcaaaacagcatggtattggtacaaaaatagaaacatagaccaattgaacaggttagagaacccagaaataaagccacacacctacaactatctgatatttaacaaggctgacaaaaataagcaatggggaaaggactccctattcaataaatggtgctgggataactggctagccatatgcagaagactgaagctgggcccatactttttaccatatacaagaatgaactcaaaatggattaaacatttaaatgtaaatcctcaaactataaaaatcctagaagaaaacccaggaaatagtcttctcaacattggccttggcaaagaatttatggctaagtccccaaatgcaactgcaataaaaacaaaaatatagtgagaactaattaaactaaagagcttctgcatggcaaaaaaaactatgaacagagcaaagagacaacctatagaatgatacaagatatttgcaaacaaggcatccaacaaagcctaatatccagaatctatggtaaaaaataaataacaagcagaaaataaccccattaaaaagtggacaaatgaccaggcgtggtggctcacgcctgtaatcccagcacctttgggaggccgaggagggtggttcacgaggtcaggagatcgagaccatcctggctaacacagtgaaaccctgtctctactaaaaatacaaaaaattagccgggcgtggtggcgggcgcctgtagtcccagctacttgggagactgaggcaggagaatggcgtgaacccggggggcggagcttgcagtgagccgagatcgcgccactgcactccagcctgggcgacagagagagactctgtctcaaaaaaaaaaaaaaaaaaaaaaaacaagtggacaaaggacatgaacagacacttctcaaaagaagataagtggccagtaaacatatgaaaaaatactccacatcactatcagagaaatgcaagtcaaaaccacaatgaaattctacctcacaccagtcaggatggctattattaaagagccaaaaaaacaacagatgcagaggctgcagagaaaaggaaatgcttatactctgctggtgggaatgtaattagtacggccactgtggaaagcagtcgggagatttctcaaataatttaaaacatagctaccattagacccagcaatcccactactgggtatatatgcaaaagaaaataaatcattctaccaaaaagacacatgtacttgtacattcatcactgtgctagtcacaatagcaaagacatagaatcaacccaggtgcccatcaatggtagattggataaagaaaaaatagtacatatacaccatggaatactgtgtagccataaaaaaaaatgaaaatgtgacttttgcagcaacatggatggagcccttggaggtcataatcctaagcaaattaatggaggaacatataaccaaataccacgtttgcacttataagtgggagctaagccttgtgcacacatggacatcagtatgggaaaaatagacattgtggactccaagagggtggaaggcaggggatattgggttaaaaatctacctaccaggtactaggctcactacaacagtggacgggatctataccccaaacctcggcatcatgcaatattcccatgtaacaaatctgcacatgtaccccctgtatctacaagttgaaattaaataataacaataataaaaagtaaaagtgcctggggtgggggaaggtattatcaaggtgtaagttttcagagtggatctaccctaaaagtccttatagaaagccggtttattttattcaataaaacaaaagaaaggaaataactctaagacaaaagatagggttgtcacatgttgtaaatataatcttcattcatatacaaatccaattaaatttaaatccaatttaaattggtttaaatccaatttaaattggattaaatccagtttggattgggttaaatccaatttcgaacccatccactgtataaatatgaggaaaatatgttaaattttttatatttatatctctccatttaaattcttacatattgtgaataaaatcaaattttattgacatattggcgaagcataattcaatattaaagcatatgtccacacaaaacttttacacaatgttcatagcaacatttttcataagagcccaaaagtggaaacaacccaaatgtccatcaactggtaaatggataagcagcatggagcagaatatccatacaaagaagtattacttggcaataagaaagaatgaagtactgatacatgctacaacatggataaaccttagaagaattatgccctcacattctccaccatagtgcaacctttgttcatcaaagaaaaatgaaataacgtcttttattcctttattattttggaaagcaagagaaagttattaacagtaacatgacaataaatatcatatggaaaagtttcaaactgaccaattcaccttgcacattgttcattcaaatgtaaattagtgcaactattataagaaatagtatgaagttttctcaaaatcgtaaaaatagaactacaatatgatccagaaatcccatttctgggtacatataactttttgtcaaagagatctgcattctgatgtttattgtggccttattcacaacagccaagataagaaatcaacctgtatctatcaacacataaataaatggataaagaaacaggggtatacacacacaattgaatactatttcactgtaaaaaaaaaaaaagacaatattgtcatttgcaacaacatgggtgaacttcaagcatattatgttaagtgatatgtcaggcacagtaagagaaataccacatgatctgacatatgtagaatctaaaaaaagttgaactcacacaagtagagagtagaatgctagttaccagggtcaggggcattattggttaaagaatagaaaatttcaattagatggaaggaataagttcaagaaatctattgtaaaacatgtagtagaaaatccgtgcaaggaagtattacaacagaataacaacgtattgtatttttggaagttgttaagagaataaatcgtaagtgttctcaccacaaaaaaaatgataaatatatgaggtaatgaatatattgattagctcaattgaactatttcacaatgtgtacatattttaaaatatcattcacatgataaatatacataatgtttatttgtcaattaaaataaattttgtttacaaaagaaaaaacagtatgcatatttatatttttcaggattcttgttacattgactttgtttccaatagtaattgtgaggttcttcatgaactgtgcccatgggctccagtgattggtaaattattccacctctaccatggtgactgaattaaacaagatcctcaggtggttcatgtgtacattaaaatctgagaaacacttaaaaaacaaaaaatggaacaatgaagacatttaataaaataaatcttaaacaaattatataattagataggacaatacaataacatgcattatccttgtcttaaaaccaaaaggatattttttcttccaattttcttatttttaaatttatttttaatttcaacttttattttagatacagggggttcatgtgcagatttgttatgtgggaatattgcatgatgttgaggtttggagcatggacctcgtcaccctggtagtgagcatagtgcctgataggtagctttttaacccacccagcccacttcaccctctagtaatctatacagtgttgattgtttttttccaattttctacatatgcctctagagtaattctgtcatcaattacaaataaattaaagcgctttctcatatctctgaaggatgtaaatgaatattagcaaaacagttggtcttcagaaatttagaaactaatgtaatttgaatctttcccttgccagggaacatacatgccaatctagatactcaagagctatgattaaaatttattcttttgtaaaaacaccagtacagtagctatattcacataatcccttttcttaaattagtcacatatctgatgcactagtgttcttccagagttaaacaggatttttttttttttgacagtctcgctctgtcgcccaggctggagtgcagtggcacgatcttggctcactgcaacctccacctcccaagttcaagggattctcccacttcagccacctgagtagctgggactataggtgcccaccaccatgcccagctaatttttgtatttttaatagagacggggtttcaccatattggcaggctggtctcgaactcctgactttgtgatccgcctgcctcagcctcccaaagtgctaaacaggacattttaaaagccaacatcagctaataagctaacagcattttatttttactaatgaaaaaaacatttaaatctatctgtgtagttttttatttcaatcctctaaaacaaaatcaagaactaacaaatggttaagtgaattatgcatgatagtatgattttttattataattaaaatgctctttttcaatatttctaaattataaataattttaacatatagtacaaaaactttgcagcaataagtcagcataactggtaactgaataaagacaatttattatgatcctggactcacaagacagattctctgggttcaaatcccagctctgccttttccagctgcatgacattggagagtactttaacctctctgaaccacatctgaaactaggaagaatattagtacctacatcagagggattttaggagggttcaatgggctaatacatgtaacacacttacggtgtttcctggcacataatcagtactacatgagttagctcacattattatatttattttatttattttctcagagcacagagtattatctttattttccttattactattatcctttcttattttattgttattatcttcagttatatttcatgagcaaagtagtattatctttatttattttcttagagcacaaagtattgttatacgatattaaaccaaattgtaaaatagttgtttcttattattgatattaatacgtataaagttcaggggttaatgagtctcagttgaagtaaagagtgtcttttatcaaacttaatagttttgttgttgttgttctaaagaaaataattcaaatttacttataataaaataatgagtatgccacagacacaaggtacatgttaaaggcctcttctttataatgaaataacatcaccttcatcttatcattttagaacatcatcagacatctccacttcactaaagtctagggaacaggaaaggaagaagttgaattctcctcatttatctgaatcaaaagacatcaataaaatctatggagcatgcctcctagattgacaaagacatggtctttcactaaaaccaaagtgaaagaactaaagaatttgaaatatgtctgctactttgcaggttgcaggatgtgagaaatgtctgtataaaatagaaaatatccatcatggattcagctgtggagattttccttatgattataattccatggataactcacaaagttaatttcttactacaacccagtatttcagggtgtttttgttgttattttttgtttttgttttgtagaccaaactgcatctgctctaacatcctcatagattgtatgtacaagtaaacatgtctcaggtagaataacacatcagcttcagaagactacccacaagggcacctttcccattgtcacatggggaccatgaacacctctctacacatcatgggctttgggtttttaggtacattaagcactcaatttacacaacccttctttgggtttcttgaacaataaatctgaataatgatttcttcttagatttcttacaaattttaataaattatgttttttcatcacgaaatgaaagaagctaatcagattaataagacttttctgatacagatattttcttctactctttctgaattctccagaatgactgataaggtattctgcatgttatataaacttaaaaaaaatactgatataaacaaacaaatggactagtattggtggcattagaataaactcattgttttgaaaatatatacatagaaatatagatgtatgtatatgtatgtgtgtataatatcactaatattgggacaaccaacatcatgctcacactgaggacacaatatcgctttgtgctattgttatcaaaaatgcatagtctgaatttaatcatgaaaacatcagacaaactaaaaacacaaacacaagacaaactgagaaaatcttccacattaaatgaaactaagggaaaaaaattcagtacaatgcatgaccctggaatggatcctggactgtgaaaaataaatagacataatctggggacaactgacaaaatttgaatatgtgtggactctaaactagataatattatatcaatgttaaatttcctgattttgataactgtattgagattattcaacacagtgtccttgttcttagaaaatatacaataacgtatgtaagggtaaaggggcagggtgtctccaacttactctcaaaaagtccagaaggaagagagagagaatgagaaaggaaatgatatacattgtaaacaattaatgaatctgagtaaaatgtgtatgggtaaacaagagcttcttgtactatttctccaacttttttgtaattttaagttaaactgaaatgaagttaccccagatatagcttagatttgtctccccactcaaatctcatgtcaaattagaggaggggcctggtgggaggtgattggatcatgggggtggatttcccccttgctgttctcatgatagtgagtgagttctcactagaactgatggctaaacatgtgggcacattctcattcactctctctttctcctgctccaccatggtaagatgtgcttgcttcctcttcaccttttgccattactgtacgtttcctgaggcctcccagccatgcttcctgtacagcctgtggaactgtgagtccattcaacctcttttcttcataagttacccagtctcaggtagttctttctaggagtgtgagaacaaactaatacactcccccaaaatattaatctgtcaaaaggaatagaggaatgttctttctaaaaggcctagtaattaaacaaacaagaaaaggttgatcttttaaatagaggtgatttccaatatactcttagattttatgctctttggtaaatttattatgcaaagtgatatgaaagcctagatttatttgaatatattaaggaattttctttaaataagccacccaaacaattaggctttgcatatatttgtggtagacatccgttgttttacctgctagcatctcttagtccttcttcaggaaacagcacctctctcctccctccccaacccccagttagcactctgccctttcatcacttcatatgactataaatgctgtcaatattttcactttatctttctctcctaggagtagcacacaacctcaattgaccaaccagaacatcttgtcccaagattttacatgacccaggcagagccaataagaatgtttagagatattgacatagaagaaagagggtaattatcagctaataaaaagaaccatggaagcctaaggtttcaaggaactcgctttgctacctcatagagaagtcagcctgagaacagagccaactcagaggaaaacaacagctactttgggttgttttccgaagacaaagatttatctaattcaaaaagatagacactaaacacttttcagttttaaatcaaattcaaaatgagaactagaatattcattttattttcttattgcaaccttctccccaccaaacataccacaaaaagaaatgaatcaacaacacaatagtaatacatgagacaaagttaacattattgatgattgataatggagtgtattattctctcagattcatagaacagggccccacctatacaggcagtgccaagaaaaggacttggcacatagtgtgctcaatcaatgtttgctgaataaatgaaggtcggggactcttcaatctttacaagttactattgttatcaaaaacgaaagtgcctcaaaataataactgatagagaatgagcatatcatcttcccttagaaatatattctaaatttcaaacatagctctttctggatcttcttattatgaaagcataaatgctgttctagtcaggaaaaagaatcaataaatactcaaaaaattaccaggacctacaaaatgtgggtcaaatgtcaattaacacagtcagccctaatgagctgttctgttaccatctctcaccttcacccattatctgtaggtgtgcgactgatgaggatgtttaaatgaacagataaaggggtccctgcttctatacatttcatattactgttgacatttatcaccaagctttcaaccccaactgtctttgacaatagattttaaaagataataaaattcttcaacaggctttcaattcaatcctcttgtcattgtaacaaaacagcactaaaaatgaaacgaaagccagatatgacagaaactgctgaggagctaaggatgtatgatcattctttttaatgttgatatttacatatgagtttttgcttttcctaccaaaccataaataaaaatttcaatagaaaataaataagttaattcattcttcttatcaatatggtttctatagcatttcatttattaatacctttaaagataactgaaggattctgattatataacatttgctaaggcttcaaggtaccctagataaattttccaaaaactttcttttttatattttgaggcaaacaatttctaactactatttctttccaaaacagaaaaaatagaatcatcattatactcaataattttcttcctagcacttaactctctaaacaattatttctatatttatttgtctaattatgctcatcgactaaattgtaagttccatgaacagagattgtgtttgatgatgttgtcaatctttgttacccaagcatcaaacctggtccatagttggtgctcaatcaatgtttgttaaatgaatacataggtctgctaactttcccacttcttttgaaaatactcaaaaaacatttaatttaatccaaattcattcagtccctaatactatttttaaaaagcgtgtattagaaatgttttcggaattaactgggggcttagacatcagtgtgtcactcaaagcacttagtataatgcttcaaaagtactccctaaatgttaaattgaaataaattacatgtaataaaagttactttgcttctacctgtgaaatataagaaaaatttaacaacatagcaaaactaaaagatgtcttaattaacttatttttgctcattttgtggtgtctttcattcattcaatatttattgaaggcttatactcagccatgtaggtgctagacatacccaaatggatgagatatagtttagtgaaggagacaggtgaacaaacaacaatggtataatatgaaacctctgtaatagaagtatacacaaaagagctgctggagcacaatgcagcagagaggcactctcaatgacaggaaggaagaaagtttcaaaaagagatgggtgatcaggcagaaaataggaaattattaattccatacaaagaatatagtacattcttggttctgcagaactggaatgctttttctcttcatctgttttttgaagaggaaaaaaaaaccgtgcagaagcagggtatagccactaggaatttacttttcctttatttgctatcaaatatggtggcaagcaatatccatatattagctgctttgcctcagcccgccatctgaaggtagggttcttcaagtgcccaaatggtgcaaaatctcgaagctgatatcactcactccataatgagatgaatcacagaggggtcttttgctactcacagctgggccactgtggccatgcatcaccactcatagagaagggggatggagagaggtgttatgaccgtttttgttgctttttgtggagtgaaaattatcagcctatggtgttttccaaccacaacattcttacctcatatactcctccatgctgcagagagacatcctgtttctgggaagggccttgaagactagagaccttggcttatttgagaactagggtcaccctctgtttattgcatagccctatggggtgtcacaggtcctaaggaagagactttccttaaaggtcataaagcataaaacacacacgagtgttccagcgcatgaaatgttcagagatcagcaagaattcccaaatgggtagaaaaaacatagaacaaatgagtagaagaagcagaaaatgaccttgaactaacatatgaagagatttatattctaggataatgaaattattatgactttatcctcctagcaatgtggaaccaacaacacttttgaagcaaagaaatggagcaaacaaatatgtctggctgataactatggtggtagcaagaaagatggattgaaagagaacctaaaagcaaaggggaaaactatttctgatttccaagtgcaacttattaacagttcctcatgaactgtagataggaaatacacaaaattaaagcaaatgatgctgtttgtaataatagtaagttgtaatagaagaaagagtagaaagttggtaaaggatgagttcatgtcctttgcagggacatggatgaagctggaaatcatcattctgagcaaactatcacaaggacagaaaaccaaacaccgcatgttctcactcacagatgggaattgaacaatgagaacacttggacacagagcagggaatatcacacaccggggcctgtcgggaggtgggagcctgggggagggatagcattaggagaaatacctaatgtaaatgacgagttgatgggtgcagcaaaccaacatggcacatgtatacctatgtaacaaacctgcatgttgtgcacatgtaccctagaacttaaagtataattaaaaaaaaaaaagaaagttgttaagtagtagcaacttgcaaggaaatcttgaaataaagatgcaatttaaatagctaactacttagtgcatttatgatacatgctgaaaattttcaatgtacaggaagaaacagtattttttccagattcagtcatcaagagacagttaacttaattttgaagatgagttttcatttcttattatttaacttagtgcgtggtaattaatttttaatttataaatgaacagaaaccagatggtttcacttgatggctttaacaaaattactgtatgtcattaatgattctatctgattctttatgggtaccaggcatcttttgggggatgtttaaaagatctaccaattttgcttctataaaaggctaaataaaggaggggtgactgggcacacagtatggctagtttctccaacagtcctcactcccaagagtgaggagatctgcttcatatacaactgtcctagaaaatccactctgagtcaaagccccaaataagttcctatattcctggagaatcttcctggagggagatatgccaggggaagggagtactaaaaagtgtaatgttgtgattagatatgtcatattgtttgatatcattaaatagcaattagatattcttgccttaaacaaaattatgtcatgttttggccccttctctttgtaaaaattcaaaaaactcatattactgccgagaaagctcactgccttctcgagattatttttcctctcaacttaaactgtggatgtagatacttttctcatacgtattatgtgtatatgaatatatataattcttatataaagtaaactaagatccaaaatatttaactctgttaagtgcaaagtctcatttttataaatcaataaaatgaccagggcaaaaaactagacagtgagctgggggtctgaggattcagatccattcccagctgagctttgacaccacctgttgaaggctgtcctcaccagagttcagtatgcatggggatgattctgggcccagaagatgggtggacttgcagaaaataatgatgcttacagaagacctcccagttggttagctctagttctgttagttcaatagagggagacagcttagtgaacagtgaggtctcaaggtccacctttcatctccctgcttctagagaaaaaattttcccatgaaaagtcttcttccccctcaggtctcccatagaaattcagtccactcttttgagaacaagggttaagaggaaaataggacccaattttaaattatattatatccaagtaagaattcaaaacaattaacataaacattcatgaacagccttcatatggatataagatattgaatatcccttgacttgacagtacatatgtagtagttcagaaataacaattggcatcctaggtaagtatgatgaattaaatgctcttatcaaattccatagtttacctttataattttggagtaattttagtatttacaacatttttctactataataatatacaataaaaggaaattatttatatatcattaatgagttgaagacacgtaaatgaacaaatcattttaaaatgggccttagtaatagaattagagagatgtaaattaattaagaaaatactttaataggtttttccaggaacacaactagaataattgtagttgtaaagggaaatattagcattataacatagcttaataaatggacaaatacctggggagatgagttaattactaaagtagtttcattccaaacataagtgactgtgatggttaacactgagtgtcaacttcattggattgagggatacagattattaatcctggatttgtctgtgtgggtgttgccaaaagagattaacatttgagtcactgggctggggaaggcagatccacctttaatctggtgggcacaatctaatcagcttccaatgaatataaagcaggcagaaaaatgtgaaaaggggagagatggggctagcctaccagcctacatatttctcccttgctggatgcttcctgcccttgaacatcggactccaagttcttcagtattagaactcagactggctctccttgctcctcagcttgcagacaggaccttgtgatcatgtaagttaatacttaataaatgcccatttatatatatcctattagttctgtccctctaagagaaccctaatacactaatacagtgacactttctttactcctgcaaacctcaaataatatacttcttccagaacttgattatgatgtttgtttttatccttacttggatatggcaatcacacattaactctacgaattagtttttgatttgtgtttgtctagtattaagttacttactagaactttggcccctccttacaaataaaagccctaaaattatcaaaatcaacccttcaaacttttctcaaatgctttcattaaaatagattaagaataaaatgatttagtttgcatccatatttctcccatattcttatatattttacatcttttttataaaaggcaaagagcctgaatagaaataacaaattacaatttgactataatagtggtggtgcaatgctatcaatgaataagtgtataaagacccagagttctgttttcttaataattttgaggacaattagaagagattaatgattccccaaagcaagaaatacaggcatttatttgtgttgtatatagttagctaaatagaactcattattagctagtagaactcagcaacattccaaaatagtctgatcattatttatttccatttgtatttgctagaaacagagaaacaaaaggcaacatcaagaaaaagtataaaaacatccaaatcccttatttttgcctgatcaattgtgtaggtttttttctacatgtcgaggcctttttgataaagcaaattgtctatcagagcccaatccagcatctctccactccaaactggtaaggcaattatctagaagactattctcctgagaaaaccaattataaatgttctctcaaagtaagtaagcataccaatttggatgcacatgtttttttggttagcacttaaaagagaaacaaaaaaagtgtgctgagaaaaaaagatctctgtctctctcactcgacacaaaccaaagaatcatcaattgagggaattaccaagaattaactgataaaggaaaaagacttccattgatagttctccataaaatttatttttggtgagaagagtatattactttctcttggtttgctctgccaaatctcttgtccaaatcctttatatttcattttcaagcaatgctacttggctcccacctctatagtcctcctactcttaaacattccaaatatgaccaaaaatacaatgttctttatctgttgctttagccacggaagtaaacaattcacaattacccaattcagctcaaggagcacagttggttcctagaaaagtgctagattagaaatctaaagacctggactgtagtcttggatataaatttaccagctgtgtaatcaaggcagtatcacttcaactcccctagtgtccattttcacatatgttaatggtggaggttgaattggactagatgtcctctaaaatctcttcccattaaaagaagtatgggatcttattattgtgattaggaacttctactccaaagggcaattttatatttaatagtagaaggaaatgatatatttaatagtacccagaatttttttttactttcctaatacaagggagatggaaggagataataggaaaatggttatgatcccctccttcatgtatactcaggtccaggtcattcatttattcaaaaatagttattaaaacttggtatgtgctagacatatcaagcattagacaacagtaaacaggtgtgaaacatcctttaatgcagcttagggtctaatgaaagattaaaatactgtatatgcaattatgggctggaaaaaatggtcctcttttaatgaatgagcatgactcaaacataactacacacacacacacacacacacacacacacacaccctcacacatttcgcctaaaaagaaaactgttctccaagtgggcaagaaaatcaccttttgtccccagcctaaagatattatctttagcaaagataaataaatttgtcattcttgctaaattcctctgagtttgtttataattgaaacttcagatagctccttaagttaacaaaatgggtaaatggcattaagcatgaatttgaccattaagggaaggctattgtcctgttgctcctgcctatcatctttctcaaactgtcataggtattttcacctttggatatcagttgaagtcaaccactaatggactatattaatttttcttctgatgtcagcaactgaaggaacaagtacatcccatgcctgaaatggaaaaggatggtggttatcagtgcagctttattccctaggaactctaaacttgtcttggaaaacaattccctttgcagttttcagggtctttgaccgcagacttaacatatctcagaatcagagtatctgctcatgaactacctttactggttgtttcaggtactcttctaaatgctttaagaatagggacttatttagtccttctaacaaaccccatgagatagatacctatgttatcctaattttacagatgagcaagcagttctcacagcttgtatggcagaaatagaattcaatccaggtagtctggccccatgtagatacttttaactatgtagatacgggtacaaaatgcagcaaatgacaagaagatgcagcctgaagggtacactgagaatatgaaataacccaaaatggactctggggtaacatgtacagcattcttattatattaaatacccattaaaccaagatgaacaaatctcctcttgtttaagagacacagggttagaagtgttaatttttttaaggaatataaataagattgaaaatgaacccacatggcttaaaatgaaattaatcaaacaggagcctttccaaaaatggaagcactatctcatagggactttaatcccataattcaaaatggaatatcattccccaaaacatgtttctcctccagtgttcgtattccagttatggcaccactactctcttaattagaaacctgggaaccatctgaactccaccttctcctccaacccacatattcaacctataataacttagattcaaaaaatgaaattaaaaatattttgaactgaataaaaatgaaacagcatttcaaacttgcaggatgcaactaatgcagtgtataaaggaaaatttatatcgctaaatgcctatattagaaaattaaaatggtctggaaccaattaactaagctcccacctttaaaactagaaaaaaatcaagttaaagccaaaataaaccaataagaaagaaataataaagataaaattagaaattaataaaacagaaaatgtacacttacattaaaaatttcatatatgtttctgctaaaaaactttagtacctatgtttctattagtttcctgaggctgcttaaacaaattgctacaacctttgtagcttaaaacaacgtaaatttattctctcacagttttagaggccatgaatccaaaatcaaggtgtcaacaaggctgcacaccctatagagagatgctgtaagagagaatctcttctttgccttttccagctcctggtggttccaggtgttccctggcctgtggtgctatcactccggtctttgcttctgtcttcacatcactttctcctctatgtgcctgtgccaaaactctctctgcctttttcatataaaatacatatgattgcatttagatcccaaccagatcatccaggataacctcatcctcatgagatccttataatgtgatcacatcatttaccatataaagtaacattcactcttttgccatataaggtactattcacagattctgaggattaggacatgaatttatctttttgggggtcaccattcagcccatgacaacgatcatgagagatatagtttttctttcttgcaatgtttctgtctgattttggcatcagggtgatgctgactttatagactgatttggggagttttttctacaatttttctagaagagtatgtgtagcacttgtattattttttaaatatttgatagaatgcatttttaatttccttcatgaacttttcctttgccttcacaacttggctgtttggcacaagaggcccagctttcagcctgtcttagattttgacataccttcctcactgaacttaactatttttagctttttacttaaagtgagagacatgcaactcttcctttcatttgaacactttgaggcaactgtagggttattaattgacctaatttcaatgattttgtacttcaggtaatagggaggcccaaggagagagacacagatggggaaaggctggttagtagagcagtcagaacacatacagcatttgttaagttcaccatctcaaatgggcttggtttttggtccccaaaacaattacagtagtaacatcaatgagcactgatcacaaatcaccataaaaatgtaataataatgaaaaattttgaaatattgcaagaattaccaaaatgtgacacagacaggaagtgaccacacgctgttgggaaaatggagctgatacacttgctcaatacagagttgccacaaaccttctatctgtaaaaaatgcagtaactgcaaagtgcaataaagtaaagcacaataaaacgaggtatgcctgtgtttctttgtattgcctttatcaaacacattgaacatttacagtaagaattcaatgtattgaatgtatcaaattaatatgtatgaaaatatgtattggatgaatatatcatgaaaatgtattgaataaataaaatgaatgaataaatgaacaagtgaataaacaagtgaaagttcctgtccgtgccatcatcatatattccttagacaccacttcgcacaatagctttaagtggacaaatatgaatcaaccctagccataccacctctctaaaaatgaagtgttcaaaaaattattttcctgaagtttataatcctacatctactaagtactaggcagtcagaactgcctggatttcttgaacttccctctccaacacaccctttctcacctctgagatttctatctagcctgggtacaatctcctcaatacacttttataattttgacatttcagtgacattttcatttgaaccacatattagtctttcttgtctcctctattaatctgaaactccttcaagacaggcttttgactattttttaatatattcctaaaacctaaaagaacaaaagagccacagctttggaatgagtcagaccttaatttgaatcctaagtgtttctgttaacttgcaagctgagtagccttgggtaagttacctcaactctccatctcaatgtcctcatttgaagttggcaataatagtatctatcttgtaaggttgtcattagtactaaataggataaggtccataagcccctatcacagtttctagaatactaataatgccatcaatagtacttaaagtatgggtgcttaatgaacactacaattatttttcctttaggaaaacagaaagcttcacaaggtacacattttaacagtgtcgagattaaatctatttaaatccagaaagcatcccctattatttgctgaatggcatttactgactataaaaactcaggcggtgctatatatccatatatgtgtgtgtctgtgtgtatatgtttaagcccattgtaataaagaaattgctcaattagactcaaagaattgcctaaaatatgtactgccagcagctcaactatattcacaccaaaacccaagcgacatcatggaaatttaaagctgaaacctataaggaatcctaaaaagcacctgattcgcttcttcatttttctgataaggaacctgagtttgatgaaagtcatgacttaccaagtcagcatagtgagtacataggagagccttgttgctgcctcccagatttgaaagtattactgtttcatatctaaacccacattccctctatcttcaatcacctgagtacctgtgaaatcagaaagtaaccttagcaataataaaggagtagatgtatatacaggtagcctccgaagcagtgtgatgttatgcctattgttccgatatattgctataggaatctgctccatgttctacaatttacaaataaagcatttctttttgttatgtattcaaatgttcctagctttttctttctctcattgccttttatttgtaactagtgctcagacataaaggtttctttttctattaagttttaagcccaatttcaacagtaatttcaagtgtaattactgctcctttctggcaacagctctgaagtaaacccacattcatactgttcagcaacatagacaaactcaaacatccatacatccgctttcacattttactcttaaagactgaatttgaacataccttaatgtaataaaagccatctgtgacaaacccacagccaatataacattgaataaggaaaagttgaaagcattctctctgagaaagggaataggcccactctcactgctcctcttcaacatagtactggaagtcctagcgagagcaatcagacaagagaaaaaaaatgaagggaatccacatcaataaagaggaagtcaaactgtcactgtttgctgacaatatgatcgtttaccttgaaaaccctgaagattcctccagaaagctcctagaactgatacaagaattcagcagtttctggatacaagattaatgtacaccaatcagtagctcttctatatactaacagcaactaagcagataatcaaatcaagaactcaatctcttttacaatagctgccaaaaaaataaaatacttaggaatatacctaacaaagcagtcgaaagacctatacaaggaaaactacaaaacactgctgaaagaaatcacacacaacacaaacaaatggaaaaacatcccatgatcatggaggggtagaatcaatactgtgaaaatgaccatactgccaaagacaatctacaaattcaatgcaatccctatcaaaataccaccatcattcttcacagagttagaaaaaacaattctaaaattcatatggaaccaaaaaagagcctgcatagccaaagcaagagaaagcaaaaagaacaaatctggacacatcacactacctgatttcaaactatactataaggccatagtcaccaaaacagcatggtactggtataaaaatagacacatagactaatggaacagaatagagaacccagaaataaacccaaatacttacagccaactgatcttcaacaaagcaaacaaaaacatgaagtgaggagaggacacccttttcaacaaatggtgctgggataattggctagacacaagtaggataatgaaactggatcctaatctctcaccttataaaaaatcaactcaagatggattaaggacttacacctaagacctgaaactattaaaattctagaagataacattagaaaacccttctagacattggcttaggcaaggatttcattaccaagaacccaaaagcaaatgcaataaaaacaaagataaatagctgggacctaatcagactaaagagcttctgcacagcaaaaggaacagtcagcagagtaaacaaacaaaccacagagtgggagaaaatcttcacaatctatacatctgacaaaggactaatatccagaacctacaatgaattcaaacaaatcaataagaaaaaaataaacaatcccatcaaaaaatgggctaaagacatgaaaagacaattctcaaaagaagatacacagatggccaacaaacatatgaaaaaatgctcaacataactaattatcagggaaatgcaaatcaaaaccacaaggcaataccatcttactcctgcaagaatggccataagcaaaaaatcaaaaaacagtagatgttggcatggatgcggtgatcagggaacacttctacactgctggtggaaatgtaaactagtacagccactatggaagacagtatggagatttcttaaagaactgaaagtagagctaccatttgatccagcaatcccactaatgtgtatctacccagaggaaaagaagtcattattcgaaaagatacttgcacatgcatgtttacagcagcacaattcacaactgcaaaatcgtggaaccaatgcaaatgcccatcaatcaatgagtggataaagaaactgcagtaaatacatagatggaatactatgcagctataaaaaggaataaattaacagcatttgcagcgacctggatgagattggagactattattctaagtgaagtaactcagggatggaaaaccaaacatcatatgttctcactgatatgtgggaggtaagcaataaggacccaaaggcataagaatgatacaatggactttggggacctgagaggaagactgggagtggggtgagggataaaatactacaaatatggtgcagtgtatactgcttgggtgatgggtgcaccaaaatctcacaaatcaccactaaagaacttactcatgtaaccaaataccatctgtaccccaataaatttaataaataccccaataaatttaataaataccccaataaatttaataaaatttaaaaatataaaaattacacaaaaaaacaactaattttagaaatgatctaatcatgtaggaactacaacctatgtaactggccatttgagttgtaatataaattagtaaaaatttttcactttgtctttcttttatcaatttcttagtaagaaaaaaagaaatagaacttaaatattcttagatatttttaaggttgatgtggtaattagttttataacttttttctggaatgaaatgaaaataggaaaaaagagctgttttagctaactttctgactgggtataaaaatggtaaaataagcctataattactttttctggagaaatatgaaataaaagatttaaatttgctaaagaaaaatactgaatttgaaagggcaacaaataatggcttggaggaaaataaattaagataaaataattataaaaatggtagaattttggtataaaaatggtagaataagcttataattactttttctggagaaatatgaaataaaagatttaaacttgctaaaaaaaaagaaaaagactgcatttgaaagagcaacaaataatggcttggaggaaaataaataaattaagaggaaagggtcagggagcactaccgactcacagccaagttgtttttcccacttactggcataagcagtacttggcagtttgggcatgatgggaatgttcccaccacccctcctaaaagaagaaaaattgtatgtcaacatacaagaggcaaggctgccaaaactatcaataaagtataaatttcatgagggtagaaatttttgagagtttcattcactgctgaaatctctcaggacagtatctgacacacagcaggctctctctaaacatctgctccgtgaaggcagtacatagaccttattggcctcagcatcagatcctgacagtgaaactccttacaacaccactagcatctaaaattaaatattcaagggaggagcaagatggccaaatagaagccaccatcaattgtccctaaagccggaataccaaattttaacaactaactacacacaaaaaagcactgacataagaacaaaaaatcaggtaagcaatcacagcacctggttttaacttcatattgctgaaagaagcactgaagagggtatgaaagacagctttgaattgctggtgccacccctccccaatctccaggcagtgaccatctggcacagagagagaatctgtgcacaagggggtggaagagcacagtggctggggcacttgctgccttgaaggaagattgaacttatgccctgtcacagcagagagcaaagccatgctgggcttagccagctcctgcccaaaaagggaacatttggacaagccctagccagagggaaatcgcccatcccagtggtcagaacttgagtttcttgacaaacatcaccactgcgggccagagagctctggggtccttggtaagctttaaaggcagtctatgacacaaggactgaaattcctcctactgctgagcttagagccagtggactagggtggcacatgacctagggacagagtgaaaaacggggtgttttttctactcctcccacaagcccaggcagccctgctcgcagaaatgaaagtgactctttccttctgcttgaggagaggaaagcaaatagcaaagaggactttgccttgcatctagaataccagctcacccacaacaggatagggcatcaggcagagtcctgaggccctgtattagcctgttcttgcattgtgataaagaaatacctgaggctgaaaattttataaagaaaagaggtttaattggctcatggttctgccaatcagcatcaggaaacatgatgctggcatctgttcagctcataaggaggtctcaggaaacttacaatcaatggcaaaaggcaaaggggaagcaagcacatcttacatggccggagcaagagcaagagagagagggggaaggtgctacacacttttaaacaaccagacctcatgagaactcactcactatcgtgacaacagcaccaagggggatggtgttaaaccataagaaactgtcctcataatccaatcacctcccactaggccccccacctccaacaataaggattacaattaaacatgacatttaaatagggacagagaaccaaaccatatcagacccccattccagtccgtagctcctgggcaacatttctcaacacaccctgggaacctgcccagaagggagcctgctaccttgaagggaaagaccaagtcctggcaggattcatcatctgactaaggagcccttcggccccgaacaaccaaaggcaatatccaggtaatatgccatgggccttgggtgaaactctgagacatgctggctttaggggagatgcagaatattcccagctgtgggaactatggtgaaaaattctttctgcctgagaaaagcatggggaaacgtaaagggggctttttcttgcacattaggtaccaactcagccacagtgaggtagagtatcaagctgactcttggggtccttgagtccagacctaggttcttaaacagaatttctggacttaccctgggccagaagggagcccacatcccttaagggtgacttccaggcctggcagcgttcaccacaagctgactgaagagccctttggctttaagtgaacatcagcagtggcctggaagtaactcttgtcacctgtggtggtggtggtggcgatggaaagagacagctccgcctgtggaaagtggagggaagagtgggaaggactttgtcttgtggtttgagggcaagctcagatgcagtaaaacagaacacaaggcagatttctaaggtttttttactagaatccctggctcctagacagcatctctgaacctactcaagacccaggagaactttccactctgaagggaaggacataaacctagctggcttccgaacctactgattgtagaaccctagaatgagctagtcagtagccagttagtggttacagtaagcctttggtgagacccagtgctgtcctggcttcaggtctgacctctgtagtcccagtattggtggccacaggggggattgtgttaccccatccccagatgcaggcagctcagcacagagagagaaggtccatttgtttgagagaaagtaagagaagagaacaagagtctctgcctagtaatccagaaaattattctagattctatacaagaccaccaagactgcacctctataagtttgcaggaaccacagcattattgggcctggggcccaaatcccttcaaatacctgggaagcctttccaagaaagatgggcacaaacaagcccagactgagaacactacaataaatacctaactcttcaatgcccagacactgacaaatacccacaagcaacaataccatccaagaaaacatgacctcaccaaacaaactaaataaggcaccagggaccaatactggcgacacagagataggtgacctttaagagagagaattcaaaaagctgctttaaggaaactcaaagaaattcaagataacatggagaaggaattcagaattccatcagataaatttaacaaagagatttaaataataaaaagaagcaagcagaaattctggagttaaaaaatgcaattgacaaactgaataatgcatcagaataccttaatagcagaactggtcaatcagaagaaagaatcagtgagcttgaaaacagactataagaaaatatacagtgagagaagacaaaaaaaaaaaaagaataaaaagcaatgtagcatgccttcaagatctagaaaatagcctcgaaagggcaaatctaagaattattggtcttaaagaggaggtagaaaaagagatagtgatagaaagtttattcaaaaatacaatatcagagaactgcccaaacccagagaaagatatcaacattcaaatacaagaagactatagaacaccaagcatatttaacccaaagactaccttaaagcatttaataacaaaactcccaaagttcaaggataaagaaaggatcctaaaagcaccaaaagaaaagaaacaaatcacatacaatggagctccaatacatctggcagcagacttttcagtggtaactttataggccaggagagagtggtattacatatctaaagtgctgaaggaaaaaacttttattctagaatagtatatactgtgaaaatatccttcaagcatgaaggagaaatactttcctggacaaagaaaagctgaggaatttcatcaagaccagacctacaagaaatactaaagggatctcttcaagcagaaagaaaaggatattcattatcataagaagtcatctgaaggtacaaaactcactgttaattgtaagcatacagaaaaacacagactattacaatgttgtaattgtggtgtgtaaactactcttaagtacaaaaactaatgatgaaccaatcaaaaataattactacaacaactattcaaagcctaagcagtgcaataaggcataagcagtgcaataagacctaagagaaacaaccaaatgataaaaagcagggagatgaagttaaagtgtagagtttttattagttttctttttgtttttttgtttatgcaatcagtgttaagttgttatcagtgtaaaataacgggttataagatagtatttgcaaacttcatggtaacctcaaattgaaaaaacagacaacaaatacacaaaaaaataaaaagcagtaaattaaatcataccaccaaagaaaatcaccttcatggggaaaaaagaaagagaagaccacagaacaaccagaaaacaaataacaaaataacaataagtccttacttatcaataataatattgaatgtaaatggactaaactctgcaatcaaatgtcacagagtggctaaacagattaaaaaaaagagagagacccaatgatctgttgcctacaagaaacacacttcacttacaaaaatacacatagactgaaaacaaaggaatgataaaagatactctatctgaatgaacagccccccaaaaaaggagtagctatacttacatcagacataatagatttcaagacaaaaactgtacaaagagacaaaaaaatcattataaaggatcaattcagcatgataaagggtcaattcagcaagaggatataaaaattgtaaatatatatgcacccaatgatagagcacccagatatatatcattagagctaaagagacaggtagacctcaatataataacaactagagactttaacaccctactttctttttttttaattattattatactttaagttttagggtacatgtgcacaatgtgcaggttagttacatatgtatacatgtgtcatgctggtgtgctgcacccattaacttgtcatttagcattaggtatatctcctaatgctatccctcccccctccccccaccccacaacagtccccagagtgtgatgttccccttcctgtgtccatgtgttctcattgttcaattcccatctatgagtgagaacatgcggtgtttggtttttcatccttgcaatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaagagtgccgcaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccgttctaactggtgtgagatgatatctcattgtggttttgatttgcatttctctgatggccagtgatgatgagcattttttcatgcgtcttttgattgcataaatgtcttcttttgaatagtgtctgttcatatcctttgcccactttttgatggagttgtttgtttttttcttgtaaatttgtttgagttcattatagattctggatattagccctttgtcagatgagtaggttgtgaaaattttctcccattttgtaggttgcctgttcactctgatggtagtttcttttgctgtgcaggagctctttagtttaattagatcccatttgtcaattttggcttttgttgccattgcttttggtgtttcagacatgaagtctttgcccatgcctatgtcctgaatggtaatgcctaggttttcttctagggtttttatggttttaggtctaatgtttaagtctttaatccatcttgaattactttcatttcagaattggacagatcttccagacagaaaatcaacaaagaaatgtaatatttaatctgtgctatagaacaaatggacttaatagaaatttacagaacatttcaatggctgcagaatacacattcttttcttcagcacaaggatcactctcaaggacagatcatatgttaggtcccaaaacaagtcttaagatattcaagaaattaaaataatatcaaggatctcttctggccacagtggaataaaactagaaaccaataacaggaggaattttggaaactatacaaacatatgaaaattaaacaatatactcctgaatgactagtgggtcaatgaaaaaattaagaagaaaatttacaaatttcttgaaacaaatgacaatggaaacacaacataccaaaacctgtaaaacacagtgaaagtagctccaggaggcaagttcatacctataaatgcctacatcgaaaaagaagaaaaacttcaaataaataacctaatgatgaattttaaagacctaaaaaagccagagcaaaccaaacccaaaattagtagaagaaaataaataataatgatcagagcagacataagtgaaattgaaatgaagaaaacaatacaaaagatcgatgaaatgaaaagttagttttttgaaagcctaaacaaaattgacaaacttttagccagaataactaagaaaaaaggagagaaaatccaaataaataaaatcagagattaaaaaagagatgttacaactgataccacagaaattcaaaggataattagtagctactatgagcaactatatgccaacaaattggaaaatctaaaggaaatggaaaaattcctagacacatacaacctaccaagattgaaccacaaggaaatccaaaacctgaagagaccaataataagcaaagagatccaagccataataaagtgtcatccagcaaacaaaggctcaggacctatggcttcactgctgaatcctatcaaacatttaaagaagaactaattactacaatatagtttatgaagaacaaataatcaggaaaaaaaaactaataccaattctgctcaaactactctgaaaaataaaggagggagtacttccaaactcattccatgaggcgagtattaccctgacaccaaaagcagaccagacaaagacataacagaaaaaagaaaacttgcaagcttaatggtaacctcaaattgaaaaaaacatacaacaaatacacacacaaaaaaagcaagaaattaaatcataacaccaaagaaaagcaacttcatagggaaaaaaggaaaacaacaaaacaaccagaaaacaaataacaaaataacaggcataagttcttataaataatattattgaatataaatgaactaaactctgcaatcaaatgatgtagaggagctaaatgcattaaaaaaaaaaagacctgttgatctgttgcctataagaaacacaagaaaagaaaagagaggggtgaaccctttctttgccctttgccccactcccaagataacaaacctactgcaacccacttccatgataacaacattaatccatttaagaaggcagagccctcatgacctaatcacctcctattaggccctaccttccaaactgttgtaccggggattagatttccaacacatgctttttgggagacatattctaagcatagcagagaggtctttggttcttaaagcaataccactattcagcagccaaaggtaggctgagtttaagcaggtattctttgaataataacaggatcatcaatagaaatttatgtttgagatatacaattatgggattacatataaattttatttcagcaaattactgcatacagccatcatagaatttatcatcttgcactgcaataacccatttactcatctatctcaagtagacagtgagcttcctgagggcagagaaagcttcattttgtcctagtgtctggtacatgacagatgctcaataaacatcagagagaaaagataaaagggacataccagttgacacactgacctgttccctcacatagtattaaagcatagatggcaagttaatctttcattcaacaaacgcgagatacagtctctgccctcaagcaccttacaatatggaatgcaagggaaggcaaacatgaagaaaaaggcctgtattttgaaccgaatcagtcatttgtgagctttgtacatctcctcatttaacttaagcctacaccccttctaacatctaaacccttccactgtatcccttaaaatctatactgtgctctcctacactcccacccctactccctagtccacccctgacagaactttcaaaaactacaacctccacctgagctctcctagaccgaactctcaatgcagcagatagggtttccttctaaaaccccaaaggaatgtgtcattcccctgctcaaaacttctcaggaccctcatcttactcagagtaaaatctaaagtgctgaccactgttcataaggtctgtttccttctctcacttatcatctatgtaaggacaaatacaaaatttttaaaaggcttaattttccctgttgaaaataagagaccctcctcatcttttcttatagcatttacttcagaaaacttgtaagtactttcttctcgctttgaaatgtatataaatccttttgaaaactagataggatcttaccagtttcatgaccaaggaatgtctttctcaaaaaccttggagccatctctttgaatatagacatcaagggagataggagccctatctcccagtttttgtggaaggataatagcccaacttaggtaggcactttgttccacattgcaaaactacatcctaggccaggcatggtggctcacggctgtaatcccagcactttgggagaccaaggagggtggatgatgaggtcaggagatcgagaccatcctggctaacacggtgaaaccccgtctctcctaaaaatacaaaatattagccgggcgtggtggcgggcgcctgtagtcccagctactcgggaggctgaggcaggagaatggcgtgaacccaggaggcagagcttgcagtgagctgagaccgcgccactgcactccagcctgggtgacagagagagactccgtctcaaaaaataaaaaacaataaaaaaaatgacaagttggttttcctctggataatgccaattagctaacattgatggtcactccaattaccaggtgaatctagcgtaagctatatgtggcaagtggtgctgggaagttgtcttgcttgaggactagttattgtttatcttaaaacatgcgtgtaatagattgtatcttcttggctatgtaaaagaatgagatttttttctttgaaatctttcagtagattgcctatgatatgcaacacaatctagtttaatgcttattcaatgataaaagtgttttctttctcaactacctttgtgaagagcatatctgggttggaagattttgtttttaattatatttccccaaatactaccactcttctccttgctccttgttccttcaaagaaaagcctccacctttgttctgcacatatcccctcagtctagaacattccccaccactaccacccatatctgtttggcccatttcctcccatgtattcaggtcgctgctcaatgtcactttcaaagaaagatgatccctgaccaccttgtatcaaacaacaccccttggtcatcacatttctactttacctgtctttattcatcctcatagctcttataactgcttgatgtgtatgtgtttgtttacctgctcattgtctgtcttctctgaccaggataaagtctccccaagagcagagacttttcctgtttcattcacctcttatatttccagggcctagataagagtctggcacaaaggaagagctctttcaatgttagttcaatgaataaattattgttaattatacaaagcaaaagagattcaaataaagtgctattagaatgagccacttaactttgcagaaagtgcaactctgtatagctagagctataaaagagctgagcttttggctacagaaacacctgagcaagaatttatgatagctgagtgcttcttgtcacccctgctttcaaaataactgcaaatttgtgatggacagcaaagagttgtcatcttcatgcaccaattcatatgattcgtatggtcttacctcactaatcaaataatgagggaggagagcagggaaagggactggtttttaataatgaaaagtgaaatattagaatatatgaataaatgttcctgtgtatgaagagaaattaaagaaattctgtccaattcatttatagatttatgcaactccaatcaaaactccaatgcaatttgttcagaaagtgatagaataattctaaaattcatctggaaaattaagcaggtaagataattctaaaaagaaagagattaagcatcctaaagctataataataaaacaaagtgctacggatataaaagtagattaataaaacaggatagctagcctaaaatagaaagaacttattcatgatttaaaaaactcctaatcaaagaagaatgaatgaatgaatgaataataaaacatatcatttaataaacgcttttgggataattgattatgtatttaaagaaaaaataatttgagcacctgttgtacattttatactaaaagaaattctatgcgagttgaagagttaagatggaatcttaaagattctttaagattgaattaagatggaattcttaaagattccatctttaactctttaactcgcataggatttcttatcaaaaacttgataaaaaattactatttattatagatatataattgttatacaatttagaaatatatattattttaatttctaaatatatattaaatataataatatttatatatctataggtggcagatgacatgattctatatctagcaaacctcatagtctcagcccaaaaggtccttcagctgataaacaacttcagcaaagtttcaggatacaaaaccaatatacaaaaatcacttccattactatacaccaacaacagtcaagccaaaagccaaatcagccgaatctcatttacaattgacacaaaacgaattaaaaacctaggaatacagctaacaagggaggggaaagatctctaaaatgagaattacaaaacactgctcaaagaaatgtgagaaaacagaaacaaatggaaaaacattccatgctcatggatagaaagaatcaatgtcattaaaatgggccaatctgcccaaagcaatttatagattccatgctattcttaccaaactaccaataacattctttacagaactagagaaaactattttaaaattcatatggaaccaaaacagagcccaaatagccgaggcaatgctaagcaaaaagaacaaaactggaggcatcatattacccaatttcaaactatactacagggctatagtaacaaaacagcatggtagtgttacaaaaagaggcacctagcccagaaataatgctgtatacctacaactatgtgatctttgacaaatctgacaaaaacaagcaatggagaaaggactccctattcaataaatggtgctgggataactgtctagccatatgctaaagattgaaactggaccccttccttacaccatatacaaaaatcaactcaagatgaattaaagacttaaatgtaaaatccaaaactataaaacccctgaagacaagctagccaataccattctgaacataagaacaagcaatgatttcatgacgaagatgcctaaagcaatcaggacaaaagcaaaaattgacaaatgggatctaattaaactaaagagcttctgcacagcaaaagaaactatcaataaacagacaacctaaatagtaggaaaaaattttgcaaactaacaaaggtctgatatccagcatctataagaaacttaaacaaatttacaagaaaaaacaaataaccccattaaaaagtggacaaaagacatgaacaggcacttttcaagagaagacataacatgtggccaacaagcatatgaaaaaaagctcaatatcactgatcattagagaaatgcaaatcaaaaccacaatgagatgccatctcacaccagtcaggatggttattatttaaaagtgaaaaaataacacatgctggtcaagttgtggtaaaaagggaacacttatatattgttgatgggagtgtaagttagttcaaccattgtggaacgcagtgtggcgattcctcaaagacctaaaaacagaactaccatttgacccagcaatcccattactggatatatgcccagattaatataaatcattctaccataaagacatatgcacatgaatgttcactgcagcacaattcacaaacaacctaaatgcccatcagcggtaggctggataaagaaaatatggtacatatacaccattcaatgctatgcagctacaaaaaagaatgagatcatgtcttttgaagggacatagattgagctggaggccattatccttagcaaactaatgcagaaatcgaaaatcaaataccacatgttctcacttacaagtgggagataaaggataagaactcatggacacaaagaggggaatgacagacactggagcctatttgagggtagagagtaggaggagggagagaatcagaaaaaataactattgggtactaggcttaatacctgggtgatgacatagtctgtacaacaaaccactgtgacacaaatttacctatataaaaaacctgcacatgtacgctgaacctaaaataaaagtttaaaaaaaagttaaagattgaatcatagacaactttatgaaaaaaagactttattctagatatataaattgtatgtaatttataaatatatatttatttcttttagatataatatctatatatctatagatggcctttcgagacttagaacctgctatggtttgaaagtgtccccaaagttcatgtgttagaaacttaaactgccattgtaacagtattaagaggtagggcctttatgaggtaattaggccatgaaggctccatcctcatgaatggtttaataccaactttgcaggagtgagttagttatctcaggagtgggctcctgataaaggataagtttggcccccactttctcttcatctagggtactcacttccacccttccatgcttctgccttcttctatgggatgacactcattagatacagccgcttgatcttggacttcccagccaccagaatcacaagccaaataaatatgttttctttataaattacgcagtctgtggtattctgttatagcaggagaaaacagactaggaaactataaaaataaatgtaaaaagactagaaagatgtgatgttagaaacctatggtaaaaaaaaaagcaattatgagaaaaagtttttgttgtaaacatgatagatctagcttaatatgttgaataaagagatcaaacaagcagataacagaaacactaaaatcccaaaagataagtgagcaaaggtcaaaaacagacaattcatgaaagaggaaatacatctagcaaaaagacatatgaagcaggttctggctcttatcctagattctgcttctggtatccagtccactgaactcttggtttgatgcttcctgacagccaataattagcctccattttgctcttcaactgtgcccttgcttttcaactagaatttgatacttcattgctgcatcttctgttctaactttcacacattctcagttcccagcttttctatgccctgccttatggaagggtaagaaaaccataggaaatctctattttccttacttcatattttaccattttattcattcagtgctgctacataaaggcctatattttattcttcatcactttttcttttatatacactatccaaacaggttaagtaatcccatacacaatgtacaatgatccgtgttgtgataactacatgcaaacacatagttagagttccgaaggaaataaggaaggaagaataggaagagggagaaagggatggagggagggagggagggaggaatggaaggaaggaaggaaggaaggaaggaaggaaggaaggaaggagtagggagaaaaaaagggaagatcatataagcaacactttaaagcatccaaagcaaatacaaattccagggcgttgttaatttactaggcattatagatgcatttgggggaaatataatgtttgcaataccctgtgaaaaactaatattgatatcaaaatataaaaagaaagtaaaaatgaataacgtaattgcctgcaaaatgtattatgagactcaattaactttaaattatgctatcataaacaattcattatatttaaaaagtttgtatattagtttatcttactacaaaagaattcccaatggtacctaacatctaatttaaattaaatagtatttatgtgtgagcaagaatcacaacacatgaattaaacattactcataagatattaaatttcaaagtacatttataaaaatatttccaaatttttctatatcaaaaactacgtttaatgttgggttgcattgtaagtatattttaatacatttgctatgaagtgactgaagcctccaaaaacaagagtgcttaaggcagaaaaagtttttcaatggttgtggcacatgctttgaaaattcagatatgtccaggaggagcggagggttctctttgcttaatgaaacttgtcttgaagaaaaggataggcaggaacacagataatagtttccaagtgaggactgagtttgaaatagcacagtaatgtgttgttaaaattgtccttagagtcagctgaagcctaggagtcaggggtcagggggtagttgggaggagaagactaaaatataatagcaaattaaaaattatataatcatatcagcaaaatctctaaaaggaactggtgaacacaacttggcacaaatagtagtggagggtattagccacacttcaacatgtggctggcagtgtgttactttttgacacttacctagtggagaaagagtggggccatgttaccagatagagacggaggcagccagttatgtaggagcactacagcctgggcactgggccagctgcctccactgatcatcagcttgagagctagggccatgcagccagttaccaagtggagagaaaatagtgattgtatggccagtgctaaccttatgaacacatatgaaagacatgaaaatcccacaatagatatacaaagacatttttgtcatgacagttatgatgtactcctagcaggtaaggcctagagaaacatgggttatataaagaattctattaagtagacacatagaaatccttgaatatgcattagggaaaaaatgttgtcaaatggtcaacttggccatgttatttctgaaaatataaggtactaactctgtgggaaactttccaaggtttaacttttgcttttgtccttgctacaattgttgttgcaaacttatagtaaaacattagtcagatctagatcaacaaggacactgcaaggtatttccagcatggaaaacaaacttcactttcccaaattccaattctgtcaaaccagatgatgcatccatttggaaaagaaaagaaaacaaggcaactacttcagagcaagcttcattaataaatgcagaacagtctgttatctgtaaaaatgtgcagataagagaggaagagaaaaatctgcaagattcccaggctttgttgtgaataaatatagcatggctgtcaaaacaaaattgtaaaccgtattatgtagagtttccttttgttaatttggaatttaaatgtttaagtccaatcccctaaatgcaaaagtgatcaatcccagagcaatatgattactgtttcttgacaatgtggatagaaaccatcaaagccatatgtatacttaaaaacaacagacactgttatttttattcactttattttattttatttctctgaaacccatacacacagaataagaatttcctctgtatgtaaacaatataaataaaatatgcattggatatgagataatatcatatgaaatctacagaggaaaacattcatttctttatcaggcagaatcactatattagagatgaatacattctcttaagactctcaaacacttttaggttgcctatcctttagttttaaggtacattactaatacaacatcttttaaatttgaaccaagtgactttttaacatctattgaagctattggtaccttcaatagacaggagatggatcagaattctcgtggttatttaagaaatacatatgtaagtaagttcaattcacaactgagcttatgtttcctctatatgataaacatgctgaaaacaagttattcagggaaaatttttctggctgtattggaaagcttaggccaaagtcaaagagaaaagaagaactaaagcaatctagcttttcccatatgcaaacgtctatttcgaaacataggatgctgatttacagtgaaatttccgagtcaaataaaaatgaagcattgttgtatagtgggggaaaatgctggcctcgcatcaaaagttctacattccaatctcactttgttcttgctagctgataacctatgccaagtctcttatgggccttattaaatgaggagtgaattagatcatttctaacgatgttcaactctaacattttatgaacctctaccaatggaatcaatgtataagaaaatgagccaaacaaaagaaaataaaaggtattaaagaaagtggaataactaacagagaactatactcaatttacattgaaaagacaaaacattttgtaccattctaatctcataaataaaatataattcaatctattttgtgcaaaacacagtttagagaattacaaaataaagatatgaccctaaaatctactttagtttattgtgcatataaagaatttcaaactgatttaaatttaggtgatgtttccaattttatgaaacaggaaaaaattaccttaaatcactgcatccaagatttaagaaagaatttcttcataatacagttaataaaaattctttctaaaggaatttgtgaaactgtcctccagatgattcgattgtactttctattatactgcatggcatcaattttaacatgcacattttcccatatgttcacatttctcaaattaggatatgtcttccaagtgatggcatcttagatacaataaaatagggtagtttttaaaataggcatgccttatcttctctatcatattgtatttgagaaggaaaaaatagaactgtgcaagaaatcaatatcaagtcataataaacaaataaaagaaaaataaaatcccaattgttgggataccgaagaattccaactagtttacagatactccccctccaggaagaggagcttaaatctccccaccttgagtgtggactgcattagtgacttacttccaaacaggagagtaggaaggggaagggacagggtgaggaagtaaccttgcagtggaaaaacctggcaaacactacattggtcagtgatcaaagttaatatcatcattgataagtcatgtcaatagaatgtcccctttatataatgtcagagaatgtcactttacctttgtggtcatcctccccaaaacccaaaccccagtctaaccctaaggaaaatgttcagacaaatcccatttaagggccattctacaaaatgcctgaccagaccagtattcctgaaactgtcaaagtcatgaaaaacttccttgtttttcatgtctgaaagactgtcacagagcagaatgtggagacatgatgattacatgtaacactgaatcctggcacagaaaagacattaaaggaaaaattagggaaatctgaataaaatgtagagtttagttagcaataacatatcagtgttggtttattggttgtgacaaatgtatcatagcaatataaggttacaatagaagaaactgcaagaaaggtatacaagaactcctctgtactatctgtaatttttctgtaaatctaaaactattctaaaattaaaagtttatttaagaaaaccaagccatgcataattttatatacatattctacaataaaatgacccaacaaatcaaaatggaagagaattagatcctaaactaatccagatttttagaaaaataaccaagctaataagtgtaataatacaggaagataaaatgtaccaaagagaattaagaggctcttatctcaattcttaccatgggaacaatttttcatttgtgacaagacctgaattatatgttagtccatttagtacaaagtaaccatcaaaatagttaaatcctcaactgttgtacactcctatggatagcaatatttctagaataatgaaccttgtcctccctttttctgataacccatcataactctggatgtcttgggtttccaagaaagacttgtgggaaaatatgtgaaacaagtcattaaacttgggcttcaactgctatacagctcataaaacaaatagaactaaactgatttatttgagccatctgattttttgctcaagagacagggtcaaaaccaccctttagggttcaaatggtaatattctttctctgtatgaacatgagcagtgtagtcaacaattgctatgtagtctaattccttaattgactaaaaatactgtcaggccccaacttataatcaaattgtgttttaaactgctgtcatatctgttatgtataatttataacacatgttctcaatgacaaaattcttataaaggatggctaaatgcagtctagttcagaaaactttttaacccgtaaaataaaagatgttcacagcaatgtaaccaaggtgactactgccctgaaaatagactatgagccaactctagcagaaagcgagccccctccaaacaaacaaacaaacaaaaaaacatatcctggattattccctattcagactccacctcatgttttctaaagaaaatggaaagtaagcatccagggtaagccagttgcagtgtttcagagagtggatagaggtggaaagcaggatttataatattagatagaaaggaaggatagctaatataagaaatactctgtgaacaggatttttccactaactgtcagcagcactgaagtttcaagaaaaactgtggacatttccaaggtcctggatgaaaaggtatggacagcaatccccaaagccaaagttatggccaagaagagctgaagatgctttgcataaccaagcaaggcactcagctaggaaaaacactagaatggcccactaagacaggcaagaaagtcttgagcccagggcctgccaaggacacctgaaggattccaagtaacagtggaaggccacacactaaatagagtgcaggctttggaaataaatctgaatttgaatcctctgcctttaattagacctgtgaccataagaatctttcttaactgctctaagacgcagttctttcattcatcaaatcagaataaaaaatatccatttctgaatttctaacagttttatattgatgttctaacaaattatcacaaatttggctgctgaaaacaacacaaattatcattttacagttctggaggtaagaagtctgaattaggccgcatgggctaaaatcaaggtgtcagtaggactgcgttccttctggaggctttagggaagaatctatttctctgccttttccagcttcagcaggccacacacatccttggctctttaccccatttctctgttctcaaagccagcaacatggggccaagtccttctcatgctgccatctctctcctgcctctctcttccatgtttaaagatccttgtgattacaccggacccacccaggtaatccaggatcatctccatattttgcaggtccattgattagcaactttaattccctccgccatcctaattccctttgccatgtaacacatttcatatttatagtacagaattagagcatagaaatcttgggggttggggggtctattattatgctaccacatcatcatatagagtgtgagaattatatgccataatgtatataaagcagttggcatgtagcatgagtccacaaaataatagttttctcagcctccccagcttccctccctcatttaccatcagaaatcttcctctaataaatctcttgcatatctgatactgtgtgaacatcttcttcttggatgacccaattaaccagttacatcaactccagcagagcttccatactgtcaagaatcatagtattagaatcaaaagacacataataaatgctctattccaatcacttcattttataaatgagggaaacaagaccagaacaaagagtaacttgcccaaggtctaaaatcagtaggcagcatagcttgtacaagaatacttgtagcaccattaggattattctatgctgcctgtgggattctggggcaggaacaagctcttttatgactacaaaagttgatattccagtgtaaaacttctggaagtagaaaagaagattctaacagtgatgaatctcaagggaacagagaaaaggagtcctcttctagaagaggacaggccaggcacgatggttcatgcctgtaatcccagcgctttggaaggccgaagtggtcagatcacttaaggccaggagttcaatacctacctggccaacatgacaaaaccccatctctactaaaaatacaaaaagaggtttatgaaaccatcagatctcttaagaattcactcacttatcatgagaacagcatggaggaaactgcccccataatcgaatcacttcccaccaggttcctcgcttaacatgtggggattacaattcaagatgagatttgggtggggacaaaaagtgaaaccatatcaatccccaagaacgtggattatttctcatgtgactttctcaaacaacactttttctccaactccctagcaatggtgctaaaagaaggaaagtacacaccatggcaatagcatcaaacaatagttttaagaaggtgaagcctagaatagaacaaatttgtgagaaaagagcaccactattaatatatgaatattgagcactatgtctgttttaaccatatattccatgttcaatatatacctacaacagtgccatcagtagaaactcactgtccttgctctaatacactcaatattttcacccaaataatagaatcctttcccccaattagtatgagtgtagaagaaatgacaatgatctacagtgcaacttctcatgtaatcagaaattggtagagcatgcaaatccaaggctgatgtattcacatcatgtccgaatatcaggctttgcattagtagtggggatggggtaggataatatcagtgtctgatttctgcccacgtggtcagccaccattagtatgttttgcaggaaagtggataagtgaaaaccaacttaagcttcttctgcttcaaataggatattttcatcttttcaagccatgtattttttctttgatgaatgttttataagtcttctctattttctctccttcatagtaacacttctgttggacatgaataagatttagaattcatgactgtctgtgacatgtcctgaaaactagtttcactatctcagatcataaactgtacttgtctcatgtcatggagcaaaagcaaaatgtcttcatcactttttaaaatcaccatgtaagtaaattactcttttgacatatgccttaaaattatcttttacctcttagcaaagattaaatgccttagctttgccctacaacaatataacactacttcttatacttccatctctgaacctgaagaatctacattacagccaagcatgctccaagaatctacactaaaaccaagcatgctccaaagtcaatctgatatattccttttctctcttgaaacattgtatattaactttcatttttatgacttgcttttctcacattgttatcgtagcttctacattctttatccttcaaatacatttttataattccctgattttacccaataataagattaaagcatgtgagtgctctaggcaggctaatgacatggtattccttcataccaatattctttaaatactgtacatattcaacataggtttatatacttaacactgtccaggagataggcaaagaatgaagaaagcactttcctatggctttgttttcattctaactgttgaattagagctttgacttccagatatagggccactggttggacctgaacccaaatgaattgatgttatttccaggacatagtccctgggtgtggaaaccagttgtgtaactgactaatactggtaatatgtaaagtgtgtaatggcagcacattgtttaaatttgccaaagtctggctcgtttggtttaagagaattttttaaaaattaaataaatttgcccaagtgattttttgtagttgacaatccagcttttctatctaccaatctcaaaaaaagagacatactgcaattagtaaaaattatttgagaagttttcaagacttatagattattatttcaaaacgaaacagcataaatagcttactttttcattttattacttttctatgatagtaatctgttttaagattttctttacatttattcatttattttgctgccaagtgtcctgagactcttctggcattatttttgattacagggagtaggaaaaaaaagactttaaaaaggccatttatttttccaatacaaatttcattatggaggtaatattaatcataaaagaagatactaaccaaaaaaaggagaaaaaagagaaatgaaaatatattgtgtccaggttagaaggtctctgataaaagacaatctaaatctcccaatactatacagtaaattactaaggtaataatgttctgtcatgtgaatatccattcctattgtactttatatgatttgtgagttggtgatgtatgaagctggcattgaaagcaagatcagtgagtaatttgattaaacatgctgaatttacagaatttacactacttggatactaaaaattatcaggctttctgtctcactaaaatttactaggaaaagaggcaagttcttcctagaacagcaattctcaagctatggtctagaaacaagcactttcctgaacatttggcttggtagaatagaatgaacacactatagagggaaatatcccaagaggacattgagagaacactgatatattaggttatttctctttttcagtgagtcttcagagtagaacatttggagtgccactaaccattaaaattgtattccaagatcttagaagggtactccaagatcttagaaggatatcccaagtacctgtcttatgcccctatcagcaatgtgccccaaaatccccattcctgacctacttagcttgtagtctatgaaaaggaaccacagtaagataaagaaaagtgaaaaattgtcaatgttcaatatacaacctatatttttcaatcagatttatttatatgaccacacttaggacaatctcactatttgcaattttctgaatcaccaaaaagaaataaatagggaagcaaaaaggttgtataaaatgaccacagaagaatcacaattatttcaaaattttgccaaataaagaaatcataagacatgaagaaatcataaaatctctattcctctttgagctctatttaatgcaagtctttcctagtcaattaacctccaggctttatatcattaatctaatatttatatcattggccattctgtcttaaaaacatcatgtatgtttcattaaacatccagcaacacaaacaacatgatgcattaggagatggccagtcctagaaagagaagctctgattaacctttcattatttattcacataagaagtatgaattcacagaagaaatctagatggccatcaatcaactccagaaaagaaatgattttgtttttaatcacagctacttatgtttgcattagccaaattcctcattatatttgtagtcaccagttttgtaggtatgaaaggaagttgttgtaatatgttggtggtagcagcttcctgacctctgaatctcagctctggatctcagtttcatgatatcccttctggcttccactgccccagccattctagcaggtgttataagcacctaattctctctgttccctcaattccaagtgaaaatgtctagagtggttgctatttccagcactgaactcattgacagatgccttctctgactcctcttccacagcaggagatgctgtaagtcagcaccttgttactactcaacattcaggtaattaatatcctcgattaacacacactttcaaactccttaccatctttgtcttgcctgttaaaaacactcacagttatctgaatctgtaagtgtgtttttcattttaaaaacatttaacaagcaagacaaggaaagggcaccttctagtgcctgggaaaatgacatcacaaatttgcatacttcctctcttcaaaaagggaaagaaagaagcagaaagtttagtgtcttatacaaaatcccagggcaagactctgattggctcagcttgaatctggctctgacatgcatccctggaccaatctattgtgactagaatgaagctcacataataaaaaggtgtctgctagaaaccactcctctaacaatgagtaaagggaagacgtggtgatctgagaaggtgagataaacagatattctagtagatttttattatacctgtgttcaaatcctagctttgctaattgccagctgttgacctagggattgttatggaatctcactaacacagagttttcttttccatcaagagaaaataatttttaaaatttacatcgtaagatttctgcaaggattttttttctttttcttttttttttttgagatggagtctcgctctgtcacccaggctggagtgcagtcacatgacctcggctcactgcaacctctacctcccaggttcaagcaattctcctgcctcaccctcctgagtagcggggttacaggtgtgtaccaccacacccggctaatttttctatgttcagtagagacggggtttaaccatgttggccagtctggtctcaaaactcctaacctcagctcatctgcccaccttgacctcctaaagtgctgggattataggcgttagccaccacacccgacctctgtaaggattattttacataatacaaatgaagcaatgggcacggcatccaatatattgtaagtgctcagtaaatctgagtagtttgtttttatcattatcaggatgcttcagctaagtgggaacaatcaccatcagttttcttggcaaaagaaaccaaaatttacccttgatttcatttgcttgatgtctagaccctacacccaaagaccatctgaaaaaactgaccacacaaactcatatcaggttatcagctcaaaaaggacatcgcctttctagctgaacttaaatgacacaaaggcaagataaaaggaatccatgattacagtcatgtcctctggagaagggagcaatgcacattcacctcaatacatgtgttcaatttaatctaatacataaaagatctggttttctgggagccttttgttaccaaaccagcatctacaactataaataaggtttatttaaatgatttatcttgaattacctaataatttcagacaggggttagtaaattttctctataggctttgcaggccatatagtctctcttgtgaatattcaacttttcaatgaagcacaaacacagccatagacaatacattttttataatgagcatggctgcattctaatacaattttgtttacaaaaacaaacagagatctgtatttggctgataggctgtcaattgccaattcctagtttagatacaaaagtccttccctcccttcctacctccttctaccccttctcatgatcctcaattatgctcctacgaatgctctaaccccagttcatcaccatcagatgaatcattctaaaatactgttgtgtatgccattttccagctcaaaatccttcaagcatttctattacctaaaacaaaacattgaaactcgatcctgttatttaaaacattctataatccggctctaactgattttcccatgttatattcctcttctcttttacagaaatcatcccataaactgatctattcatgcttgcccttggatatttccttcttaattcttttcctcatgttttccccactatagcagtctttcgctcccctatcttcttcaccaattcaaattttttatattcttcaaggtccagaaacaaaaataataactcgcgaataaaaagtaccttgatccctttagatcccaattatctttcttgtgacttttcaaataaaagctattgttcatatcactcctgcggcccttatcacatactatttactcatccaacttgtgttggttgtgttgctgctgctgatgtcattttattggaagagcagacagcctgtatgtttcttgaaagtagtggctgagtattaaacctctttgaagagcccagcagaccttttggggtactttgtacatacactgaatatataattcattaaagctaaaggacaaaaagatatccatgtatccctttttgcagtaagtgcctttcagcaattagtgggccttttaacaaaaaaggagtttgaaatgattctataaagaaaaaggacactttgtccccaagaaagaacccagggaatgattattcaggatgtataaaattctggacttttgtttttgttttacctaaaaccttccacattgaccgtttcttatcatcctcttcaaaactgtaggtaagaaaaaaaaaaaagaaaaagaaagtacagatcattcagtattcttccttcttagaggcttcgggggagaaaagtttaatgggggagaaatagtaacaaatacctaaaagatttttaatgctttatgaaggcaattgcctgtgtttttgctgtctctcataaccatagatgggtaattgagaattagcgttgcttctgtcaagtgccatggaagcattttagtttcaagctggaaagattcagtgacattttgcatcatttaaaataataaagtcttatgcatgtggtgtcattataagcagtaacttttgatatctgaaaaatgttgcattctatttataaaaggaccctgtttttacacagaattttatttttttaaagtaattctgttactctcattctccagtctaacaacaaaaccattttcagccttaatcgcccaactcaaaataccagctataatactctcatgcaatagaaagatggtttcaaagctgccctccccaagtatttcacaataagagagtttgtatattctagattatagacgaggaaaggaaaggaaaagagaggaaaacgatgaggctagaatcaacttttctagtaaagttttatcaatttatgatgcctgctgttcaaaggaaaaaatccaaaacaagcaaataaataatagaggtttcaagtaaagagcacatttcaaaaaagggtccacagccttcagggaaagatgtaccataaaacaattatccttgataatactgtatgcccttgtccccagctatggttataactcacatggaggtcaactcagcacccaggggagagaactactgcctatcagaaaaataaacaacaagaaaataaaacacagaggagactgtagaatgttcttttatttggagaaggtgaaaaacagcctctgtactgcacatgcacaaaaaattaataataaccacatgaaaatcaagcatttagttattttcccccacatcgaaagacactgccatttaccttgtcaactgagaacaattcctctcctcccaaagtcatatttttgtttcaatttgtatagtattttcacttgcatggttttatctctatagaattcctgcaggtatgttttctacctgtcaggttattttttatttgccattttagtttgtatctaaaattctatatatgcttccaaagaagaatcaaaacttattttggagttaattgtacacaattatcaaatgttctttggatctaaagacatactaatatgcaccataatttgtttctgccaaaaaaaaattttctctcttcatctgtacaatgctattttttctaattatatgtgatgctttattaatggtatctcataggggaaatatgcccagattcttttttaaaatgtaagcaatctaaatatgttcaaagttgtgccacaaaattataaaatagagttggaaaacaatacaacaagtttttttgtgagattaacccagcaatagctttctacatgcagtcaaataatcaaatacaacaatgaagtagcaatactgtggtataatcaattgttttcttctctttctacgtaattataattgttctactatagaaaagtttaggtgctaccattgcttttaggataatcagatatgcagagccaaaaactgagacatatttttctccctaggaagaatttcagtgttggctgtacattcatgtgtgaacaaagccaaagaagatggcaagagtaaaatatgggtttgctatatccaaagcgggacaaaatgagcttccggggaaatgagggtagagaaatatcacaaactatgagatgtcaagcggtgtttgaaaatctaaataatatctgatggtagccaagacatgcctataaaattgtttcttacatatgacaaacagttgtttgtctttctggatttgtaccactttcccactgattcttcatcataacttaataccagactctaacctacaagcactttaaaagatcatagctatgttatggtgaagatccacaattaaggtagcaatcaatagatgctccctaaatttcaatgtggaataacgagggagcagacagaaaaccaaaaggcacactgaacaaaaagaataatgttgctgggcacagtagcgcacatctatagtcccactggctagggaggctgaggtgggaggatcacataagcccaggagttcaagactgaagtgaactatgatcacaccactgcacttcagcctgggagacagagtgagatctcctctcaaaaaaaaagaaaaagaaaattgttgaactggaaccaaatctcatagtaacaaagtttcacattttaaaatttcagagggaaaacctactttaatcactaaaaatctacagtctgagcatggctagttaagtttttgactacacattattgtcttggtaaaccaaatattgacagaatcttccagcttttttcatgctcaataaccacactaaatttgaaatattatgatattagccctacataagtttggatgatcttagtccttcacagttttccctacttttagacttcgttctctaatagactttcatgccattcaaatattgctttttttaaaaaaaaatcctttattatctacccctaggcatcatttcacacatcctttacacctaaaatgataaacatctgattcccatttattgaacaacatattttcattctaaatactcatttaatctaacatcttagagaacatgtgtttaaaaacataggctctatggttgactctctaggttgtaactcatgactatgtgactagtgtgactgtaagtttctttattttattttatttattattattattattatttttgagatggggcctcactgtcacttaggctggagcacagtggtgcaatcatggctcactgcagcctcgacctcctgggctcaggtgatcctcccacctcagcctcctgagtatctgagactacaggtgtgccccaccatgcctggctaatttttgtattttttgtagagactgagtcttgccatgttgcccacgctggtctcaaactcctgggctcaagcaatctgccatcctcagactcccaaagtgctaggattataggcatgagccactgtgcctagcctccaactttcttttttttttttttaactttaagttcagaggtacacacgtgggtttgttattaatacattggtaaacttgtgtcatgggagtttgttgtacagattatttcatcacccaagtattcagcctagtacccgttggtgtttttcttgatcctctccctcctcccacctgccatcttctgataggccccagtatgtgttgtttccctctaggttaataaagtagggaataggccagttgtggtggtttatgcctgtagtcccagctactcaggaggctgacgggggaggattgcttcagcctagaagtctgaggccagcttgagcagcatagcaagaccctgttccttttaaaaaaaaaatggaaaagaaaggaagaaaaataatttaaaagttttttaaaaaaattagtgtatgcaccgccattgtagacatgtgaccacatatattcagccacagagtgtcagtatagaagtctttaaaagactgaacaaatcttatgtagcatggattgcccctccagggtacagagatgtagcttggaggcactcaggccccctcacatctgtgtacaagccttctaactagttctcatcaaaagaacatgtgaacgtaagtgatatatgccgttttctgctggtgctattaagaagcaggtagggatttttctctctttccccttttactggttagaggcagatgatacagaagtcacacaatggaatcagctttttattcctggatcccagaattaccaggtagatgaaagctgcccagcaaccgggaacacacacattggattatcaggtgactgagcaaaaaattttttattgtgaatacccccactgaaatgagggggtttctttgtcacaacagcaaatgacagcttacctaaaacaatcacttctcctatttttattttcatttgttttgatgagaacttgcattcgtataaggaagcttaagcttaagttcactgctttgaggcagatgggtacatcttactgtctactgtcagaggtagttgggaaataagaaagggttggaagagtgtacctgggaccaatgctaattttttgaaaattctgtgagctgaaaactctaagaacaaaaaacagtcttttctgttcacttaaagctttaaaaagcactgcataaaaaatttcatgagagttactaaaaggagacatacagtgttattcattctatccaaaatcattctgatttcctgatttttctccgtactttcaaagtcctaacacccttaaaaatatactaaatgaaataatagaaatgtaagaatctcttatgaaggacacataaatccccctaaagttgaaatcaatttaatcctttttgaagctgctttgttcaacctctgaaaaacatatgcatgtttaggaaaagtgggtttttttaaggatgagttcatgtccttcacagggacatggatgaagctggaaaccatcattctcagaaaacgaacacaggaaaacagaaaaccaaacaccgcatgttctcactcataagcgggagttaaacaatgagaacacatggacacagggaggggaacatcatacaccggggcctgtcggggggtggggggctagaagagtgatagcattaggagaaatacctaatgtcaatgatgggttgatgggtgcagcaaaccaccatggcacatgtatatctatgtaataaacctgcacattctgcacatgtaccccagaacttaaagtacaataaaaaataaaaaaaagaaaagtgatgttctttaatttttaattttaatttttgtgggtacatagtaggtgtatatatttatggggtacataagatgttttgatacaggcatgtaatgcattataatcacatcatgtaaaatagggcatccatcccctcaagtatatatcctttatgttacaaacaatccaattatactcttttagttatttttaaatgtacaattaaattattattgactataatcaccctgttgtggtatcaaatactaggtcttattcattctttctaactaactttttgtacctattaaccatcctcacctcccctgccaccctcctactatccttcccaacctctggtaaccgttctcttgctctctatcttcatgagttcagttgttttgatttttagatctcacaaataagtgagaacatgtgatgtttgtctttctgtgcctggtttatttcacttaacataataacctccagtcccaaccatgttttgcaaatgacaggatctcattcttttttatggctgaatagtactccattgtgtataagtaccacattttctttatccattcatctgttgatggacacttaggctgcttccaaatcttagctattgtaaacagtgctgcaataaaaataagagtacagatatctcttcaacatactgatttcctacaaaagttctttttaaaatcagcttctcaaagccaatccagccttttaggtaaatacgttactgagtttatttttttaaaggcacattatatatttgatagatcacttgaatcttgtctagacatacagactgccttagacaagtgatgtttccttattcaacagactagaatttgtgttatttggcaagtttgcaacacacacacacacacacacacacaccgcagtgagactataactatgacccaaatctgtgttactttaacacagaattcctcaaccccagcactattgagtttttggggccagaaaaaaactttgggttaagattttttgtctttttcttttctttgacacagagtcttgctctgttgcccaggctggagtccagtggcatggtcacagctcactgcagtcttgacctcccaggataaagtgatcctctcacctcaacctcctgagtagctgagactacaggcatgtgccaccacacccagctaatttttgtcttttttatttatttatttatttatttatttttgtattttttgtagagaccaggtttcaccatgtcggccaggctactctcaaagccctggggctcaggtgatcttcctgcctcagcctcccaaagcacgggggggtggggcaattaccggtgtgagccactgcacccagccaagacctttagtcttaacaagtaattctgtgttgtgggggttatcttttgcattgcaagatgttctcacatccctggcctctacatggtagataccaatagcactcacttccccttttaaacacaatataacaaccaaaaatgtgtctaaagattgccaaatgtcccctctagggtaaaactgcccctagttgaaaaccactgcaccagcaaaaagcttccatttctcttggaatatcagaacgtaaggatgtactaagcttacaaagcaagcatctattatgaagctaaatctgaacttcaatggcttaaacttctgctgaagcagtggtgctagactatcgtctacagcttttactttacggattcagtaattccttcccaatctcaagttcctcttttaaaaatttcattaaaagaaaacttaattctgtttaactcttcagaaactgaagaaaaaaagaactggattcccctaataagagttgcaaatccttcttgttgaggatagtaagaaaaagagaaaacaggtttggtacaagaggggcaaagtgaaagttaaatcgggagtggatgtttttagacatgcctgcatcttgccaaagatgagaccatgtacattttggccttaattatgtatgcttttgtctctgtgaaaaggaagacattttagtcagtgaaatatttattatgtaactattaagggccagaaactgttctagggtctttctgcaaaaagaatgagaatgtttgctccaaatataaaaaaataaacaactataagatacacagatcaatgatggaaaccattgctctttagtctcctacaaactctttgctaaagcaaagtagcaaaattgtgtctttcttaaatcaaatcgtaccaaaaattataacctcacaataagaatactttccaaaatcatcacaaaacttgattcaatgattatttagttatttactagttgctaggcaatgtggcaaatgtgtaagtttcactgcatagattcactcataaaggaactcacaaacttttgagagaagtttgatttacagcagcctacactccagccatattaaagtatttgtacttcctggactttcacctatatttcatatctctgcacttctacacagagatatgaatactaatcactctatacatagaattacatttcccctcttatctgttctatcttagataaaaatgcagcaggactagtttccaagacaacaggtcacaagacatcactggtaaaacaagagacagtgaaggaaactggccaaaaccagctagaaccaaaatggcaatgaaagccatctccagttaccttcactgctcattatatgctaattataatgcattagcatgctaaaaaacactccttccagtgccatgacaaatgtcatggcaatgcccaaaagttaactctgtatggtctggataggggagaaaaccaccgttctgggagctccctgctcctttcccagaaaactcatgcataatccaccccttagtaagcatatgtaatcaagaaataaccacaattataaccaatgacgagcctgggactggggggatagggtgctctgcctatggagtagccttccttttgttcctttgttcttccaataaacttgctttcatttctctctgttggctcactcttgaattctttcctgcacaaagccaaagccaaggaccaacttggccttctgagttgagccccaattctgcatttcaccttgcaacatctccaccttcaaaatgtaaagcccttcatgaccctttccccaaatggagttgatcacgttccccttttacctttctccatagctgtacatgtttactgaattatcactacgtaaggcaatcacttgctcatatgtttctctctcctcctatacctagtttcatgaatacttgaatgctatctttaaatgttgtaaccttgtaaaacagtacaacaaattaatgttagatgtatgacaaaatgaatgaacaatatatgaagtgaagactattattacatgatgaaatgcttaactattacaatctggctaagatcatccttttctttaatatccagataaaatgtctcaagccctcatcatacatgctttccaggattttcaaagattcccaggagctttacactctcaggacacctctcatggaattctcactcactgtcttctatacttgccatgcttttcatatatgctcacgctatatgtctccaccacacctcctctactattctccatacttgactaaaaaaaatccataacatttgtactaaatattagcgataacagagaaatacacaacaacacagaatatgaaactaataatatttcatgtcagatatccatgttcagcctattactttattatgcagagcaattagctatcactttccatccaagactagagtctaagtatacctttgcataacttaagaggctcattaaattacactgtaaatacagtgggccctacatattcacagattccaaatccacagactgaaccaactgcagatcagaaacattggaaaaaaattaaaaataaaaaataacaatacaacaattaaaaataatgcaaattttaaaaatgatatattataacaactatttacatagcatttacattttataggtataataagtaatctagagatgatttaagctctatatgggaggatgtgtataggctatgtgaaattaaataattcaaatttaaatctattggaactttatattattctgagccttgacaggaatgtagctatgtagcccgagtcacatggcatatgcagctgcaacttctgactttttttcctgtaaatattaataattaggaaggccacatgacaacagagataagattcccttagatctttacccctcctcattgagtaataaagtaaacttccttggaatatagcaatctgtaaccaaacaaatcattgtaattggtcttatatggaaaatgctttaactctgccaaaacttctctggctttgtctatatacttcaggtatatgcaaatactatgccattttatataaaggacttgagcatccatgattttggtatccatggagggtcctgaataccagaatgtgactgtattttgagataaggcctttaaaaaggtaattacattaaaatgaggccatcagggtggaccctaatccaatacgaccgctgtccttataagaagagaaaatttgaacacacagagtcaccaggaatgtgtgtacacagaggaaaaaccatgtgaggatacagctaaaaggtgactgtgtgcaagctaaggctttggaagaaaccaaacttgttgactcctttatcttagactcctagcctccagaactgtgaagataaaaatttctgctgtttaagccacccagtctgagttcttttattatggccatctagcatactaatacacctcccctaaaaaaaggcaaaagactttaacagatacttcactaaaaaaagatctatggaaagcaaataagcacatgaaaagattattaacatagtcattagggaagtacaaattaaaaccacaatgagataccactaaattcttgtaagagtagctaaaattaaaaacattttttaaaagtcttactacaaaatgcctgtgaggatacagagcaactgaaactcttattcattgctgctgggaatgcaaaaaggtacagccactctgaaaaacattctggcaatttcttataaagttaattatatgctaccatatgacctagaaatcctactcctggatatttatccaagtaaaatgaaaacttacattcatgtaaaaatcagagcatgattatttatggcagcttttttcatcataatcaaaaattgcaaacaactcaaatatccttcagctaatgaatagaaaagcaaattgtgacacagccatatattaaactattcagccataaaaataaataaactactgatacaaacaactggatgaatcctaaacgcattatgctaagtgaaagaagccacacacaaacagccacattattacatgattccatttatgtaacattctgaaaaaagacaaaactacaaggatagcagacaaagcaatcattgccagatatcaggaagaggagttaaccacaagggacagaagtgaattttgtgggtggtagaactgttccatatttttattgtggtggtagatacacaactgtatgcattttcaaaactcatagacctgtataaaacaaacagttaattttgctgtatgcaaattatacctcaaaaaaatctgtcataaaaaaattcctacctatggcttcctccttcaaaaaacacagcatacctaggaagaaggtagggaagatgatgggtttaaaataccaaattaccaaagactatatccctatagtacttcagtgaatataaataatttaaattaaaaagcatggatatatagaggtatttaatttttaagattccagtcaaaaacaacaaaaaacgttaacttccaatattagaaatagtcacttatctgaaactcttaatttcaaagatttctgtaattttgattattcattatcatgactttatattcattatcatgagttactgaatggtgaaagttcaataaatacagatgaaagcaatgaataaaagcttccattggattttcaaagatcagaagaagtttggatttaatctgaatggaggtaagaaatcactatcgtttctttagaatgagggaacatgacaaaatattatgttaggaaaattagtctagtaatcatatatgagattgagttgaaggaaaatattaaagcaaagatatagaagatagctgcagtgatgaagagggccggggccaggatgatagccagaggattgtaatcattatattcaaaatgtgtatcttttccatatttaactgaatacccagaaatgatgtcacatttgctacacaaagttcatttgaaattgaggctcaggtggcaacttggcctataaaatttaaacccgcgagtgcacttgctcacccagactgcagcctgagtcgtccccacccacccttcctatgcagaaaccgtggtacagcgcagaaaccgtggtactgctccatgcccaggcagatctccaggcactaaagcacctgctcacctggattgacagcctgagccatcccattagtcctgtgcaaaaatccagccatcagggggcactctctgctggttcagcagccagagacacccactgttcttatgcagagagagtggtgcagtgggtccctctccaccccactcccagacagatctccaggcagtcggagcacccactcctccagcctgagctaccccacccttcctgcacaaagatcatggtgcagcaaggccctttccaatccatacccaggcatatctccaggcattgaagcacttgcttgcctggaacagcagcctgagctgccccacccttcctgcaaagagatcgtagtgcatctgagccttctttgcaccatgccgattaaacttcagatctccaggtgtttggagaacccactcacccagatcaacagcctgagccaccctacacttcctgtgcatagatcgtggtatagtggggccctatgtactccatacccctgcatatctccaggcattcaaagcacttgctcacacagagttacagcctgagccaccccaccctcctgtgcagagtttcaggtacaggggagcgcctctccactccaccctcaagcagatctccaggcattcagagtacctgctcacctactcagcatcctgagccgcctcagccttgctgtgcagagattatgatgaagtagggccctctctgtcccatgcccagcgatacctccaggcagtcagagcacctgttaatctgatttaacagcctgagctgcccaacccttcctgtgcagagactgtgtggtgcagcagggccctttacactccacacccaggcagatctcaaggaatctagaacactcactttcctggactaagagtttaggctgctccctctctccctgtgcagacaacttggatccaaggaggtttccatctcaacacctaggcacacctctcggtggatgctcactacattctccctcagtccagatgtttgtacctgccatcaggaaacctgtaggtgggcctaccccgtatggccccacccatcttgctcccaccccacccccgggggcaaagcagggagctcagaccactgtgcactccatgaattagcccactgcctgaagcaacagagagcttctcccagtaaacaatgatcaaatatatacccagctgcactgaccatagccagcttgtaggtcaaactgcacagcccaatataaaacctgcatagcccaatacaaaacctgccagtaaagtgcagccctatagtgcgtagggctataacagaaaagccaaaagactacccatcattgtctacagtcacacttcctaagaagcggggaaagggaaagggagagaaaacaatattacaaggaaagaaagcaaagaaaatatcctccctgcaagaaaataattacaaaaattagaagtaccagtgactacagatgagaaggaaccagctaaagaattctggcacctgaaaaacctggatgaagcaacaccactaaaagatcacactagctctccagcaatgatacctaaccaaaatggaaacatagaagttacagataaaaaattcaaagcacgaactgcaaataagctcaatgagatggaagacaaagttgaaaatcaacacaaagaaactgctaaagcaatgcaggacatgaggaaagagataaacatcttaaaaataaatcagtcagagcttctggaattgaaaacttgcttaagaaatttcaaaatacagttgaaagctttatcaattgccaagatcaacatgaagaaagaatttcagagcttgaagataggtctttttgaattaactcaatcagacaaaaataagaaaaaactatttttaaaaatgaacaaagtcattgagaattagggaattatgtaaagtgaccaaaaccatgaattatcaaaatttctgtgagaggagaaaaagtaaacaacctggaaagcatatttgagagaatacttcaagaatatttgcctaatcatgctagagagctagacatctctagcaagatgtatagtccggtgactactcaaggtcaatgttataaaaaaaatcttaagggcagctgggaaaaaacatcagatcacataaaggggaatcccatcaggctaacagcagacttctcagcagaaaatttgtaagccaggagagattgggagctcattttcagcattctaaaaagaaatttcaaccaagaatttcatatcccactaaattaatcttcataagtgaaagaaaaaataaaatcttgtccagacaagcaagcactaagggaattcattaccactagaggagcctaacaagagatccttaagggagtcttaaacatggaaatgaaagaacaataactgctaccacaaaaacatacttaaataaatagctcacagaacccataaagcaatcacacaatagaaactacaaaacagccaggtaacaactttgataggatcaaaacctcatatatcaatattaaccttgaatgtaaacagtctaaacacccccacttaaaaggcacaaattggcaagttgaattaaaaaaaaaaaaacaagacctatcgctcacacacacataatgacacccataggctaccaagtaatgagttgggaaaagatctatcatgtaaacagaaaacaaaaaaacggcgggagttggtattcttttatcagataaaaccaactacagtaaaagaagacaaagaaggttattacacaacgataaaaggtttgattcaacaagacttaaatatcctaaatatatacagactcaacagtagagcacctagatttatagaacaagtacttctagacctaccaaaagacttagccacataataatagtgagggacttcaacatcgcactgacaaaattaggcagatcactgaggcaccaactaagaaattctggacttgagattgacacttgaccaattggatttaatatacatctacagaatattccactcaacagccagagaatatataatacattcttttcacctgtacatggaacatactctgagattgaccacatgctcagcaataaatcaagtctcaataagttcaaaaaaatgaaaatcataccaaccatactctcagggcacagtggaataaaaatagaaattaataccaaggagacctctcaaaaccacacaagtatattaaaattaaacaacttgcttctaaatgacttttgggtaaacaacaaaattaaggcagaagtaaaaaaattatttaataaaaacagagacacaacatccaaaattttggggatgcagcaaaagcaatgttaatttataatactaaatgcctacatcaggaatttagagagatcttaaattaaccatctaacatgacacctagaggaactggaaaaacaggaacaaactaaccccaaagctagctgaatgaaagaaataaccaaaatcaaagcagaactaaatgaaattgaaaccccaaaatacatacaaaggatcagtgaaaccaaaagttggttttttgcaaggatagacaagatcaatagaccactagctagattaacaaagaaaaaaagaaagaagatccaaataagtgcaatccaaaatgacaaagatgacattactaccaatcccacagaaatacaaaagatcctcagagactattatgaacacctcaatgcacataaactagaaaatctaaaggaaatggataaatttctggaaacaacctaccaagattgaatcgggaagagattgaaaccctggacagaccaataacaagttccaaaattgaaccagtaatacaaagcccaccaaccaaaaaaaaaagccctggaccagaagaatttacagtcaaaattccaccagatgtacaaagaagagtttatagcaatcctactgaaactattctaaaaaactgaggagaagggataggactcctttctaactcatgctacaaaagtagcatcagcctgacaccaaaacctggcaaagacacaaaaagataagaaaactacaggccaatatccctgatgaacacagatgtaaaaatccgcaacacaattgctaggaacaggcctcaagcctggccataaacaggccatgagaaacaagccataaacaaaatctctgcagccctgtgactgcagagatttcttgctgctatgatggcttgatggctatgatgcccatgctggaagttgccggtttaccagaatgaggacaaggaacacctggcccacccagggcagaaaactgctcaaggcgttcctaaaccacaaacaatagcatgagcaatctgtgccttaagaacatgttcctgctgcagataacaagccagagcctgtccctttgtttcctgtaaggaatgcttttagctaatctataacctatagaaacaatgcttatcactggcttattgtcagtaaataggtgggtcaaactctgtttgaggctctcagctctgaaggctgttagctccctgattcccactttgtactctatttctgtgtctttgtcttaattcctctaacgccgctgggttggggtctccatgaccaagctggtcttggcaacgatactagcaaactgaatccagtagcacatcaaaaagttaattcaccataatcatgtaagctttattctagggacgcaacgttggttcaacatacacaaaaaaataaaactaggcctagtttgttaggagttttttatcatgaagcagtgttagattttattaaaaggtttttctgtgtccatcaagatgatcatatggttttggttttaattctttttatgtggtgaatcacattttttttgtacatgttgaaggaagagacctcaaaataataagaaccatctatgataaacccatagccaacatcatactgaatgagcaaaagctggaagcactcccctggagagctgaaacaagacaaagatgcccactctcactactcatcttcagcatagtactggaagttctagctgcaacaatgaggcaagagaaagaaataaaatgcatccacataggaaaaaaagaattcaaatgatctctcttcactgacaatatgattctgtatctagaaaaccctaaagactctatctaaaggctcctgaaacagataaacaacttcagtaaagtgtcaggatacaaaatcaaagtacaaaaatcagtagcagttctatataccaataatgttcaagctgagagtcaaatcaagaatgcaatcacatttacaactgccccaccccaccaaaagaaaagcaaaaaacataggtatacatctaaccaaggaggtgaaagaaagatctctacaaggagaactacaaaacactgctcattgtagattctggatattagccctttgtcagatgagtaggttgtgaaaattttctcccattttgtaggttgcctgttcactctgatggtagtttttttgctgtgcagaagctctttagtttacttagatcccatttgtcaattttggcttttgttgtcattgcttttggtgttttagacatgaagtccttgcccatgcctatgtcctgaatggtaatgcctaggttttcttctagggtttttatggttttaggtctaatgtttaagtctttaatccatcgtgaattgatttttgtataaggtgtaaggaagggatccagtttcagctttctccatatggctagccagttttcccagcaccatttattaaatagggaatcctttccccattgcttgtttttctcaggtttgtcaaagatcagatagttgtagatatacggctttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcggcctcttttttggttccatatgaactttaaagtagttttttccaattctgtgaagaaagtcattggtagcttgatggggatggcattgaatctataaattaccttgggcagtgtggccattttcacgatattgattcttcctacccatgagcatggaatgttcttccatttgtttgtatcctcttttatttcattgagcagtggtttgtagttctccttgaagaggtccttcacgtcccttgtaaggtggattcctaggtattttattctctttgaagcaattgtgaatgggagttcactcatgatttggctctctgtttgtctgttattggtgtataagaatgcttgcgatttttgtacattgattttgtatcctgagattttgctgaagttgcttatcagcttaaggatattttgggctgagacaatggggtttctacatatacaatcatgtcatctgcaaacagggacaatttgacttcctcttttcctaattgaataccctttatttccttctcctgcctgattgccctggccagaatttccaacactatattgaatagaagtggtgagagagggcatccctgtcttgtgccagttttcaaagggaatgcttccagtttttgcccattcagtatggtattggctgtgggtttgtcatagatagctcttactattttgagatacgtcccatcaataaacaaccccatcaaaaagtgggcgaaggatatgaacagacacttctcaaaagaagacatttatgtagccaaaaaacacacgaaaaaatgctcaccatcactggccatcagagaaatgcaaatcaaaaccacaatgagataccatctcacaccagttagaatggcaatcattaaaaggtcaggacacaacaggtgctggagaggatgtggagaaataggaacacttttacactgttggtgggactgtaaactagttcaaccactgtggaagtcagtgtggagattcctcagggatctagaactagaaataccatttgacccagccatcccattactgggtatatacccaaaggattataaatcatgctgctataaagacacatgcacacatatgtttattgcggcactcttcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaccaaacaccgcatgttctcactcataggtgggaattgaacccatggacacaggaaggggaacatcacactctggggactgttgtggggtggcgggaggggggaggaatagcattaggagatatacctaatgctaaatgacgagttaatgggtgcagcacaccagcatggcacatgtatacatatgtaactaacctgcacattgtgcacatgtaccctaaaacttaaagtataataataaaaaaataaaaattaaaaaaaaaaacaaaaaaaaaacaaaacactgctcaaagaaatcagagacaacacaaacaaatgggaaaacattccatgctcatggataggaagaaatcaatattattgaaatggccatactgcccaaagcaatctacagattcaacaatattcctatcaaactgccaatgacatttttcacaggattagaaaaagagtattctaaagttcaaatggaaccaaaaaaagaatttgaataggcaaaacaatcctaagcaaatagaataaagccagaggcatcacattacccaacttcaaactatactctaaggctacagtaaccaaaagggcatggtatttgtacaaaaacagtcacatagaccaatgtaacagaatagagagcccagaatcaaagctacacacctacatccatttgacaaagtttacaaaaacaagcaatggggaaaggactccctattcaataaatagtgctgggacagctgactagtcatatgcagaagaatgaaaccagacacttatctttaaccacatataaaaattaactcaaaatggattaaatatttaaatgtaagacctcaaactataggatttcctaggaaacaccattctggacattgactttgggaaataatttatcactaaatcctcaaaaccatttaccaaaaaaaaagtgagaagtgggatctaattaaacagaagagcttctgcaaaggaaattatcaacagagcagacagacaatctacagaatgggagaaaatattcacaagctaggcatctgacaaaggtctaatagctagaatttataagaaacttaaacaattagataagcaaaaaccaaataaccccattaaaaagtgagcaaaggacatgaacagacacttctcaaaagaagacatacaggtggccaacaaacatatgaaacaatgctccacatcactattcatcagataatgcaaaataaaaccacaatgggacaccacctcacagaatggctattatgaaaaatgaatggctattatgaaaaagtcaaaaaaacaacagatgctggcaaggctatggagaaaaaggggatgcttatatattgttggtaggaatgtaaattagttcaacccctgtggaaaggagtttggagatttctgaaagaacttaaaacaggactatcatctggcccagcaatcccactactgagtatataaccaaaagaaaataaatcattctaccaaaaagacacatgcactcatatgttcatcacagcaccattcacaatagcaaagacatggaatcaacatagatgcccatcagtggtggactggataaagaagacacagtacatatagaccatggaatactatgcagccataaaaaagattgaagttgtgtcctctgcagcaacatggatgcagctggaggccattatcttatgcaagttaacacagaaacagaaaaccaaataccacacgttctcatttataagtgggagctaaacattggatactcatgggcataaggatagcaacaagctttcttggggactagtagaggtggggacattgggaactactagaggttagaggaagaagaggagtaatagctgaaaaactacctattgtgtactatgcccactacctgggtcacaggatgaatcttagcccaaaccttagcagcttgcaatataaccatgtacatgtacaaacctgcacatgtaccccttgattctaaaattaaaattaaaacagaaagaaagataaaaacctccctagtgactatgctgacccatttaaggtcacagcaagagcagcagtacccaagttaggtggtgataacacagtggaagttagacccagtgatgatagaaattaaacccaattttactttctcatccttggctttttgttttctactagtaacaagtgttaatctcccctttgaacaggagtatgtggcttcactgcagcactttcagtcagagacagaggctaacggcatacctagccaaagcacaagaaacctaaaaggcctcagctttggtctgattccactcagaaaagctttccttcaaataagtcaactagacgtctcttccttttaaagccaacagtgatcatctgataggaaacacttctttgttggttttcttttgtttcagtgaaattcatattttccctacagggatataaataatgccgtatcttctgctatttaaaaattcctaattagaagccttttatgttataaagctgctaaaaagcaacccaaacctaagggaattttaaaagataagttattggtgacatagatgttacaacttaagctatgaagtcaaaagtgttgattgatgaggcacagaaggagtcttgttcacactcattcacctgtttcatttttgagactgtccatgccctgggaacaagaatctactttagccagaaatacataggcgtgctggatgaagttgaagtttgcctccagaattaaggtctttttgtatatgtcacctcatatctgataaacagaccacttatctggattctgatcttcaccatcttcttttactatatgggttcatgaccctccacccttcacctagtactcaattccaatagatcttctagttcttgatagtctagatatttaaccactacttttgcttcactgtgtcttcctaattcctgtatttttgcttcatttcttacctgtgactttcacatctagtatttgtatctacattcaatttctgcttccctaccatactttggtaggtccccaagtttaacctctatgtgcctcagttttctcattcatagaatgagaaaaacagtaagattattgtaaaagtatttcaaggattacaggaaataataagtaaagtgattagcataacctgagatagagaaagtgccaaataactgctagctgcactcaagcatatttatgcctgaataagagctttgtcctctgattttgttctacatttgtggaaatagataatagccatttgctaccttaagagaaattcctttgttttatatatgaagaattattctcttcttacctttctcttctaagggttaagtaaattcattttctttctaatgaatcatgttttctcacactttagtcattttactactttcttccaaggtctccaatcttattttagttgtagaaaaaaatacaaatctccagtaatattgataccaatccaaaaagtatttaactaaacctatcatcccaaatgattacctggcacccccagccatgatgaggccccatcagtgtcccaggcaatgctccccattctgcccaatgcttcagaggaaccaagatgctactgactgcactaagcaccaaagagccactccagcacttggatccaggaagaaatagcaacaccaaaaaagcctgcgaaagtgtcagttttctgtgcatagttcagttaacagctagataacaccaatcatccaaggcataactgttataggttttgacagtaagacatcccccttggcaaaaaatgtctcctccactggctgccaaggctcctgatcatcctaggatcacctcctgtgtgttgattaagcttttgctggctgagacgcagctggcctttacagcaggaaacccacggaagagtgtgtacgtgtgtgtcctctctcaacttctggctgagtcactcaaatcaaatagtcactgaaacataaagggggttccctacacctaattttggtggtaggggaaaaaatgtaaaatcatctggggcaatcaaggactattttcaggaacatttgtctttaaaatctaaaattaagccacctcacaacctgggtggttccccatggaggaaaagaggatgagctctgaaaagctagagttgtaacctgtatccttgggaacacggctataggcagtgtgaagagctgtacatataactgataaagggtccagcaggttgtcccattcctgcaggaagagcagagccccaaatcccatttcaacctgctttagcactcacacacctcaccaagacagtggtgactgccagcttctctcttgaccttcctcacccctaggtaccacaggatgtctaatgggaaggcacaagagcataaaacttgttgctctcagagttctatggatgaggaaactctgaaatatgaggacagatgtgagagaatctctagaaaccttaagcttaggacagaaggaggagagcatcccgctcacactgtctaacaatttaatagggattcatgcatctaagtatgtttgtgagggaggtagatgttaagaaatcatacatacagaacctcgttgagtttcgaaattggaggttcttgggcaacaagggacagcatggggtaacagactgtttggggaggagaggaagggaaagacaggaaatgaaaaattaagcacctggctagaacagtacagggatacaaggatggtatttgggaaatataccaaaataattaacttttgaaagcaagaaatgaagacattgaaaggaaataaatggctctccaagaaccagaaagacaagtatgaaatgggcaagactctatgggtcagagatcccttgcatcagctgatttctttcttctttttgagacggagttttgctcttgttgcccaggctggagtgtagtggcgcaatcttggctcactgcaacctcggcctcccaggttcaagtgattttcctgcctcagccccctgagtagctggaattacaggcacatgccaccaagctcagctaattttttgtatttttagtagagatggggtttcatcatgttggccaggctgttctcaaactcctgacctcaggtaatccacccacctcggcctcccaaagtgcagggattacaggtgtgagccaaagtgcccggcctcttttttttttttttttgagacaaagtcccttctgtcacctaggctggagtgcaatggcacgatctcagctcactgcaacctccggctcccaggctcaagcaattctcctgtctcagcctcctgagtagctgggactacaggcgcatgccaccgtgtccagctaatttttgtatttttagtagagacagggttttgccatgttacccaggctggtcatcgcatctggctaattcttgtatttttagtagagatgtggtttcgccatgttgcccaggctggtctcgaactcctgagctcaggtgattcgccagcctcagcctcccaaagtactgggattataggcatgagccaccacgcccagatggatcagctgatttttttatagtacttgattatttttccctaacatgtatcagtacagctagtatcacataggtaaaaaaccaaactaaattcctttttatagaacaattatttctatatccctgttaatgtatcttttacagatttccctgggagtcttttctttatgtacctaagatttaaatttcacttgcagtagtaaattatttaaactcaattcaaaatgaaatgtgttttcatttaattatcggaaatgcatttcataatgccaagtgctggttaaaagtaagtaatttcccccattcctcacccaagccacctctgcaccaccacccacaaaaacaaattagtctttttggttgagaaaaatgaatcattacttctcaacctaagttgcaacttgtcatttttcatttgagcatgtattcactagaagcaggtgctctttgctcttttgacagtaaccaaacatttaagcgtggaaagagaccaagaaaagcaccttggcccaccttctcaggggcttagataagtatctggaaaaaaatcaatatcatggaaatgaagtgccaaattgttttaaaactgcttagctctcactattgctcctaggactgaatgcaacaaaaccaattagcaggcattcactgaggcaggaaatagagtggaaagaaagggtagaaatggagaaaatgaggaaataaaaatatattaaatttatatatacttaagtatatttataatacatgattttatatatatatatatatacacacattaggtgtgtgtatatacatatattcattcattcatttaaattttggacatgttgagcttgaaaagcccattaagtaactagataaagttgctttgggttccacatttaagtgagatcatgtaatatttgtctttttgtatctaggtcatttcattcctcttgaaaagaaaactcatcacaggtatctttaacacaaagcaccaatcttaatgtaattttattctcatgtattttcccactggtcataaattttgaaggccctaatttgctttccattgcccatgttctaatctgaattcatccaagagtgaaactgatgcgaaatctcatcttctatttctcttaatgttaagcactttgtttcttaaattgatgctgtagacaatttatgtagccaaacagaaatgtcacaacaattttgggaaacatctcaagttatttgtttcaaagaaagaaaataaattattttaccaagagataagtgaaaacattgtttttcaatccctttaaacatttatgatcgaattctggatagccaaggtgatggcagctgcttaagtctgaatctcccagcacatactccaaaaataaaaataaaaaataaataaaactacagaaaacctatgctgtcagcataactagaaaagagagaacaacctagatttcaaattacacgtgaataaaaaattaacaccaactcttagcatggaatttctcacccttctggtgcaagcctacctggggaacaagggcaagatggggccagagtggagggatggtgggagatgggggagaaccatactgaaaacagaagagagaacctagcaatgaaatttaaaattgatctaaaatcacagctataaagagaaattctactctcattgcaaaaataatggaaaaagagtcctggtagatcagagcctactagaaggaggaatgagtatgtggggctctaagaggtggtcttagaaaggccttgggagagagaagggtaacaaaggaatggagaagcactctggaaactacacagtgaacataagaagaaataagaaagggaaaatcagaatccagtaagacaaaagaatttttcttaattgaagaaagctactgaggaaataaactatcttttacaaccttaacagaagagttctaaccagggatcttgtaaaccatcccaaaccatcacagaattgctgaggcttaagcaacctacaagtattctaaaaagaaaaaaaaactaatatgacaggaaaacagaaataaaaattttaaaaactcagttgaaaatatcccctcaaaaaaaccaatagtgaatcaaaataaaatagtagcataatatcccaaagtgaatcaaacagcctcaaaagattatgaagactttcaccaaaattacagacagatatagatagaaataagaatatagatatacacaaaactgtgcaaccatagttcatttggcaaccatttattaaaacattaaaaatcaactttgtccctggcactgtcctagttgttggggaatagagaggaaacattctctatgacttcaaggagcttattacagtagaaggagaaacacatacagtatgacaagtgatgggataaaagtatacaggaaatcctttcgaaacaccataaagtagtatctacctccaaattaggagccatcacatatgcaactgaagtacaagtaagagccagatcagaaaattccaggaggaaaataatcatgcagctgtaacagtatatgcaaaggcatgaagtcagaagaaatgtgatgtattcaaagaacggaaaatactctgatatggctgaaaacaaagctctgggaaaataaagggtcacagttgctttatacaatttagatttcattctaaaggcaacagagaaccagaaccattgaaggatttttacttgaggatatgttcagattttcattttaaaataatccttccagtaataatatttaggctgaattagaaaggggtgaatttgaatgcaagataaccagttagcaggcattcaccaacaaggaatataagtggaaaaaaagtataggaatggaggaaagaaaagataatatattaaatgtatataaaaatgtatttacaatatatgatatataatacgtttaaattttggacatcttgagcttgaacacctcattaagtaactggataaaatcttgaattgaagagaaatatatggggtagaaataaagatatgggaatcatccaattgttagattaaaggcagttattgactccgtgggtgtatatgattttactctatagagtatacagagggtgtaggggaaagaaagaaaaatgagaaggagagaaaaggaagagcaagttatgttctgggcaatatcaacatttactctgacaggaactgggaagagtccagacatgtaggagaaaaattgggagaaaaaaaaagaaaattaagatttacaggaaaaaagaacagttgaagttaaaaggtctgaaaaatgtcagttggataagtgatcataataacagtgtttgtgcaagtgaaaggcagaaatagattactgagaagtgaaaagtcaagttaataaaaaatagtatatacaaacctctccttagaaatgtttgacttctgactcacttgtatacttaacctttcatatcattcatttctccaacaagtgtttattgagtgccacttaatatcaagagagacaatgtgcttatgtcccaatggagaagccaggcaataaacaacttaaagatcaaatgtgcaagataatttcctacagtgataactgctatgaagaggcgaaagtctacattagattaatcagagaaatccactgtaaggaagtgatacttaagctgaaccctgaatgataagaaggaattgtcctgtgagctctaggggaaaatcattccacgaagagggaacagcaagtactaaggacagattagcaagcacataattaaaacatccacagtaataactatactgatacttacatccacccaacaactgctaataaaaccatgccttcactgagtctgctggcagggctgttgagctggtcacaaggaggcaaataagctggctcatattgaaataagagaggaaggaatcatagaaaaagaaaagaccatggaaacctcccctcctctacaattaacaattttaaactgttgggagtatttcatgttcattgaatgaacaaaaatgttaataatagattgccctaaatcttgaattttagctgcattttgaagatccttgaagcaataaaaatgcctgtgctttttaaaggtagttttgttttgtttttttaaaaggcgggggttgcctttcaggccagatttctttgatttcctgtttcagaagcttcacctagctcaacgtgggggaaaaaaaaaaaaaagctcgcaaaaggaatatttgtacagcatagcttttatgttaagagtttgattttaggccggacacggcggctcacccctgtaatcccagcacttgggaggccgaggcgggtggatcatgaggtcagggaatcgagaccatcctggctaacatggtgaaaccccgtctctactaaaaaatacaaaaaattagctgggcgtggtggcacgcacctgtagtcccagctactcgggaggctgaggcaggggaatggcgtgaacccgggaggcggagcttgcagtgagcagagatcgcaccactgcactccaggctgggtgacagagcgagactctgtctcaaaaaaaaaaaaaaaagtttgattttatatgcttaacatgtattttttaaggtatatattaacatttctttttaattattttcatgattaactggaatttttgtggcatctgatacttaatggaaatagaacaccagttaacaaaactagctccaggaaacattcgactccctcgcttctgtccaaaaatggatgtagttagtaagcaggtcagcgcacctaaaatctttcagaaacttagcatgaggaaaagaagaaagacaggactgtcgctggatggggtattgctttgaaagaaggttaccattgctgctgctgttgttgccagcatcgtcatgtcgtttggatcaaactttaacaggttaatatgctgaaaaggaaaaatgagtagaaaaaaatgaaaagttgacagtaaaggcaaaatacaacttcctataaaggaaggtcctcaggggacagaagaaaatgggattcagaatacaggattattctgggcacaagagaaaactaagtttaaggatagcatactttttgtgactctgggatctcaaaatagatgctgaaacccagctatccaaaccagatgaaatgcttcatacaatcactatggattccactgaagaagaaaactgagggtttttttaattgctttataatttgaaagttgctgataattagagctatttaactcagcacaacattcttctaaatggcatcattgtgtcactgtactattttggttaaactcccactggtttaatttcagaaacatcctttgaataaaatgccaagttaaaaagaagtaatatctcattatttctttaaaataattcaattaatttcaaaaggatgtttcctgggaaagacttgtaaggtttcttttgtaggcctgaccataacacaagagtacattatagaaaatagcagcagctacctaccagtcagtttttaagagcacctttctttacacaataaatatgttcctgaggagctttttaaattttgaatgtgtattgtggaggctatttggacctgcaaaaacctgatgctgccatttactatttgtgtgttctagaacaagctactaaataggttaccctctcgaaattttctagggattaaatattttccattctatttggcctaattgggctgcctcagaaagacagactaacccatcaagaattaagaattacttcttgaactgagaattacttcttctatgaaatgtaatattaacacctgttgtggggcacccacctgttgtcaaacttcaaagatggataaagcacaggatagtttgattccttcactggctcagggcaccaaagagttgtgttgccagatttagcaaataaaacattcccagttaaatttcactttcaaaaagaataaatatttttattagcataagtgtgccccatgcaatatttgagacataattctactagaaaattattcatcattgatatgaaattcaaatttaactgggcattctgtattattttatctggcaaccctaaccaaagcaacagcttgtctcccacctggctatggcagaagtggaatacaaaagtcaaagtacatgataaagtgctgtacccacacacaccgccatctaaacctctgtatacttccaaaattacaatgtttcctgactgaggcctgcttcccctgctctcctccatgtgatcaagctccctgacaccctctctccactgacttctacccacactctggacctaagacaaaatttctgatgcccctacacactatcccagaactaaaaagactccaaggttacaacatggcagaaacattctctccgtttccctaagactcctagaagcattttttagagtcataggtccatacagggcctgagattcactggccatctcagatctcccaaatttcattgcagtaaattctatcatgtctcctaccctggaggaatgggcgggtagtggcagacagtagtggtagaccagcacaaaaacaaaccatgtctaagtttattctattcctatccaactctcctcttctccccaagttggagggtatttgctcaggaggcacagaagaggtgacatggaagaggcagtataacaacttggttatgcctattgtctctcattccaaaatatcaagaatttgccattttttattacttaggcctgatttgaaacttacatcctgtgtgagtggcccaataggggagaaaattgatattcccattatatgggaattataaggggaaaataatattcccattatatgattattgtaagaattaagtaaatcaaagacctaacctgtatagtaggcacttccacagcttcagagatggaaaatctgtattactaaataatgtccagtaggcactatctcctaacattccaacctctctgtcaataattcataaatgaatattcacatgctctaaaagttcctgttattatgtgaataatcatcacatattttctgtgaaagtgaaatgctgtgtagtatatttcttatatcgagcaccctagtagaaagtatttacataatgcgggaagagtctaccttctttccataaattgactttctttataattgtattattttttacaacccttctaaaacaaaatgatatccatgcataaagaacacagctttcatcttgcggtgtgacagactcctatgtgcctttttatttttaatagactggcctcacacactggtgggggttgtattcatgaatatatggcttatgtttacggttaggagaaagataggtttaaaaataataataaaggactttctgcctttactgaagccacgttcccagcctttcataatttactacactatctcattattttttaatgcacttgcctttttaaaaaaaatccaaaccttccaaattgttgcatgataatttttcttccttttcaacaggaggttctcacccctctgttgtctactccagcactggcccaagagaacctcttgtacaacccagttttaaagaatgattaagaaggatttcatataggtaactgaatatgaaattagttataattttgagagcatggttatctcatatgaataaaattttaattgcttataacattaaataatgaaataaatttgtagcgctgtcctaattccatcaattttggaatacagttcaaaatgagatgtagcaagtaagaaatacaaattgtatttctcattaataatcataagccatatataatatctgttgtctataattccaatgataaacacttactgttttcagagaagttctaggtaatacacactcaaccttctataagctatcttaacttttttatttttctggcataaactatgtgtctatctttttttaaaaaaattacactttaagttctgggatatatgtgcagaaagtgcaggtttgttaaataggtatacacgtgccatggtggtttgctgcacccttcaacccgtcatctacattaggtatttctcctaatgctatccctcccctaggcccccacccactgacaggccctggtgtgtgatgttcccctccctgtgcccatgtattctcattgttcaattcctacttaggagtgacaacatgcagtgtttggttttctatccctgtaatagtttgctgagaataatggtttccagcttcatccatgtccctccaaaggacgtgaactcatccttttttatggctgcatagtgttccatggtatatatgtgccacattttctttatccagtctatcattgataggcatttgggttaattaccagtctttgctattgtgaacagtgctcccataaacatatgtgtgcatgtgtctttatagtagaatgatttataatcctttgggtatatacctagtaatgggattgctgggtccaatggtatttctggttctacatccttgaggaattgccacactgtcttccacaatggttgaactagtttacatacccatcaacagtgtaaaagccttcctatttctccacgtcctctccagcatctgttgtttcctaactttttaaagatagccattctaactggcgtgagatggtatctcattgtggttttgatttgcacttctctaatgaccactgatgatgagcttttttgaatgtgtttcttggccgcataaatgtcttcttttgagaaatatctgttcatatccttcacccacgttttgatggggttgtttgtttgtttcttgtaaatttgtttaagttccttatagattctggatgttggccctttgtcagatggataggttgcaaaaatcttctcccattcagtgggttgcctgttcactctgataatagtttcttttgctgtgcagaagctctttagttcaaattagatcccatttgtcaattttggcttttgttgccattgctttgggtgtttcagtcacaaagtccttgcccatgcctatgtcctgaatggtattgcctaggttttcttctagggtttctatggttttaggtctaacacttaagtctttaatccatcttgaattaatttttgtataaggtgtaaggaaggggtccagtttcagttttatgcatatggctagccagttttcccaacaccatttattaaatataaaatcttttccccattgcttgtttttgtcaggtttgtcaagatcagatggttgtagatgtgtggtgttatttctaaggcctctgttctgttccattggtctatatatctgttttggtaccagtaccatgctgttttggttactgcagccttgtagtatagtttgaagtcaggtagtgtggtgcttccagctttgttctttttgcttagaattgtcttggctatgcaagctcttttttggttctgtatgaaatttaaagtcgttttttctaattctgtgaggaaagtcagtggtagcttgatggggatggcattgaatctataaattactttgggcataatggccattttcatgatattgatttctcctatccaagagcacgaaatgtttttccatttgtttgtgtcctctcttatttccttgagcagtggtttgtagctctccttgaagaggtccttcacatcccttgtaagttttattcctaggtattttattcactttgtagaaattgtgaatgggagttcactcatgatttgggtctctgtttgcctattattggcatataggaatgcttgtgatttttgcgcattgattttgtatcctgagactttgctgaagttgcttatcagcttaaggagattttgacctgagacaatggggttttctaaatatacaatcatgtcatctgcaaacagagacaatttgacttcctctcttcctatttgaatatgctttatttctttctcttgcctgattgccctggccagaacttccaatactctgttgaataggagtggtgagagagggcatccttgtcttgtgccagttttcaaagggaatgcttccggtttttgtccattcagtgtgatgttggctgtgggtttgtcataaatagctcttactattttgagatacgttccatcaatacctagtttattgagagttattagcatgaagcggtgttgaattttgttgaaggccttttctgcatctattgagatattcatgggttttgtcgttggttctgtttaggtgatgaattacgtttattgatttgcatatgttgaaccagccttgcatcccaggtatgaagccgacttgatcatggtggataagctttttgatgtgctgctggattcggtttgccagtcttttattgaggatttttgcattgatattcatcagggatattggccccaaattttcttttttgttgtgtctctgccaggttttggtatcaggatgatgttggcctcataaaatgagttagggaggagtccctcattttctattgtttggaatagtttcagaaggaatggtaccacctcctctttggacctctggtagaattcagctgtgaatccgtctggtcctgggctttttttggttggtaggctattaattactgtctcaatttcagaacttgttattggtgtattcagggattcgacttcttcctggtttagtcttgggagggcgtatgtgttgaggaatttatccatttcttcgagattttctagtttatttgtgtagaggggtttatagtattctctgatggtagtttgtatttctgtgggatcggtggtgatatccctttatcattttttattgtgtctatttgattcttctctcttttcttctttattagtctggctagaagtctatctattttgttaatcttttcaaaaaaccaactcctggattcattgatttttggaagggtttttcatatctctatctccttcagttccgctctgatcttagttatttcttgtcttctgctagcttttgagtttgtttgctcttgcttctctagttcttttaattgtgacgttagggtgtcaattttagatctttcccactttctcctgtgggcatttagtgctataaatttccctgtacacaccactttagctgtgtcccagggattcttgtatgttgtgtctttgttctcattggtttcaaagaatttatttatttctgccttactttggttatttacccagtagtcattcaggagcaggtttttcagtttcctcgtagttgtgcagttgagtgaatctcttaaacctgagttctaatttgattgcactatagtctgagagactgtttgttaagatttctgttctcttgcatttgctaaggagtgttttacttccaattatgtggtcaattttagaataagtgtgatgtgatgctgagaagaatgtacattctgttgatttcgggtggagagttctgtagatgtctattaggtctgtttgttccagagctgagctcaagtcctgaacatccttgttaattttctgtcttgttgatctaatattgacagtggggtgttaaagtctcccactattattgtgtgggagtctaagtctctttgtagggctctaagaacttgttttatgaatctgggtgctcccgtattgggtgcatatatacttaggatacttagctcttcttgtcacgttgattgctttaccattatgtaatacctttatttgtctttttttatctttgttggtttaaagtcggttttatcagagactaggattgcaaaccctgcttttttttgctttccatttgcttggtaaatattcctccatccttgaggaatgtgtgcctctgcacgtgcgatgggtctcctgaatacagcacactatgtgtgcctctgcacgtgagatgggtctcctgaatacagcacactgatgggtcttgactctttatccaatttgccagtctgtgtcttttaattggggtatttagaccatttacacttaaggttaatattgttatgtgtcaatttgatcctgtcattatgatgctagctggttattttgcccattagttgatgcagtttcttcatagtgccgatggtctttacaatttggtatgtttttgcagtggctggtaccagtttttcctttccatattagtgcttccttcagaagctcttgtaaggcaggcctggtggtgacaaaatctctcagcattttttgtctctaaaggattttatttctccttcactgatgaagtttaatttggctggatatgaaattctgggttgaaaattcttttctttaataatgttgaatattggcccccactctcttctggcttgtagggtttctgcagagagatccactgttagtctgatgggcttccctttgcgggtaacccgacctttctctctgtctgcccttaacattttttccttcatttcaaccacgatgaatctgatgattatgtgtcttggggttgcttttctcgagaagtatctttgtggtgttctctgtatatcctgaatttgaatgttggcctgtcttgctaggttggggaagttctcctggttagtatcctgaagagtgttttccaacttggtttcattctccccatcactttcagatatatcagtcaaacgtaggtttggtcttttcacatagtcccatatttcttggaggctttgttcattccttttcattcttttttctctaatcttgtcttcatgctttatttcattaagttgatcttcaatctctgatatcttttcttccgcttgatcgattcagctattgatccttgtgtatgcttcaggaagttttcatgctgtgtttttcagctccatcaggtcatttatgttctcctctaaactggttattctagttagcaattcctctaaccttttttcaaggttcttagcttccttgcattgggttagagcatgctccttgcctcagaggagtttgttactctccaccttctgaagcctacttctgtcaatttgtcaaacttattctccgtccagttttgttcccttgctggtgaagagttgtgatcctttgaaggaaagaggcattctgagttctggaattttcagcctttttgtgctggttttttcctcatcttcatggatttatatacctttattggtctttgatgctggtgaccttcggatggggtttttgtgtggatgtcctttttgttgatgttgatgctattcctttctgtttgttagttttccttctaatggtcaggcccctctcctgcagtgcttctggtgtttgctgggggtccactccagaccctgtttgcctgggaatcaccagcggaggctgcagaacagcaaagactgctcctgttccttcctctggaagcttcatcccagaggggcacctgccagatgccagtcagagctcttctgtatgaggtgtctgtcaactcctgctgggaagtgtctcccagtcaggaggcatgggggtcagggacccactagaggaggcagtcttacccttagcagagctcgagcgctgtgctgggagagctgctgctctcttcagagctggcagatggaatgtttcagtctgctgaatctgtgcccacagccaccccttcccccaggtgctctgtcccagggagatgggtattttatctataagcccctgactggggctgctgcctttctttcagagatgcctgcccagagaggaggaatctagagaggcagtctggctacagcggctttgctgagctgtggtgggctccacccagttcaaaattcccacagctttgtttacattgtgaggggaaaactgcctactcaaacctcagtaatggcagacatccctccccacaccaagctcaagcatcccagtttgacttcagactgctgtgctggcagtgagaatttcaagacagtggatcttagcttgttgggctctgttggggtgggatccgctgagctacaccacttggctccctggcttcagccccctttccaggggagcaaacagttctgactcgctggcattccagttgtcactggggtatgaaacaaaattcctgcagctagctcagtgtctgcccaaacggcctcccagttttgtgcttgaaacccacggccttggtagcataggcactcaagggaatctcctggtctgcaagttgcaaagaccatgggaaaagcatagtgtctgggccggaatgcaccgttcctcacagcacagtccctcacggcttcccttggttagggaaggtagtttcccaatcccttgcacttcccgggtgaagcaatgccccaccctgctttggctcaccctctgtgggctgcactcactgtctaaccagtcccaatgagatgagccaggtacctcagttggaaatgcagaaattacccaccttctgcattgatcttgctgggagctgcagaccacagctgttcctattcggccctcttgcccctatatgtctatcttaactatttttttttattattctggtgtgtgatttctctctttcgtttaatggttttcacaataaataagccttaatgccagatatcttaaaaataatatttgtagtgtcattcacttaatctaaaaatactcacaattgttcttcagtgttgccaagtttttcagtctactataagagcttgatcttagagtgtgttcactgacctcatattacatatagaatgtatacaaaaaagacctttaaaatgtagggtgataacatctattccatatatgccaacattcttagatattctcaactttagtcttctctcaaattgatcccctactgacattaaaaaattactaactttttatagcagcactgtgcacagctcttatatcaagagtaagaaataaacttttccaaaaccgcttaaaaacagagtaacattcagccaggcgcggtggctcatgcctgtaatcccagcactttgggaggccaaggcgggcggatcacaaggtcaggagatcaagaccatcctggctaacatggtgaaaccccgtctctactaaaaatacaaaaaatcagctgggcatggtggtgggtgcctgtagtcccagctacttgggaggctgaggcaggagaatggtgtgaacccagaaggtggagcttgcagtgagccgagatcacgccactgcactccagcctgggcaacagagcaagactccgtctcaaaaaaaaaaaaacaggtcggtgccaaggctcatgcctgtaatcccagaacttgaggaggctgaggcgggtggatcacaaggtcaggaaatcgagaccatcctggctaacacggtgaaaccccatctctactaaaaatacaaaaaaattggccgggcgtgatggcaggcgcctgtagtcccagctactccggaggctaaggcaggagaatggcaagaaccactgcactgaaatcgcaccactgcactccagcctgggcaacagagtgagactccatctcaaaaaaaaaaaaaaaaaaaaaaaaacagagtaacattcattagaagaacatagaagaaagaaaaaaaaatagagtaacaaagatgtcaagacattctctatatccactaggccaggtgtttggagtagaagaaaaatgcatagtgactgatacaagttactcatgagcaccaaccacatgttcacaagtggtaccttacttatcacacattggttaataccaagtctaacttaagattccttccctggataaacatccgatcatttttttatggatccaattctagcccactattttagcataacaaaggtcaaacatgttagatatcttaaacccagagttatttactctctgtttttaagacaaaaatgtttcctgatagatttcaaagagattccaaaaagacagcttcctctaaatttaaaataaagttcaggtacgcttaatttatttgcttctgtttcatctttggatttaatgttttccatcccaggtaaaataaattcccccagttgttaaatgaatttgatcttaactatgcccaatcttaatatatggtatagatgtatgtttatattagaatgggcaaaaggccaacaaaaacttcctgtctgatttttttcttaacaaattgtacactgctgcctaccaaaacttctgtttattcacataatgctgtatcatattcccaggacttgctgctctgacccaaggtgagaagaaatgcctttgtcctacaaacatgagcatttagcttaagttcaaacactgacaaagaagactgaaattggatacttaccagaataatctcccatatttagtttctctaaattcacagatgatcattatcaaactttcaaaaatatcataactattctcaatgactttaacattaaagttgggaaaatgactaaaattcagttacctttaattttaaaaatgcaaatttaacatgaagacataaatgtgtcactatcagtaatgacacatgtggtggaccattacattctgcaccaaaagtaccaagaagggcttcagtaactcccaatgtttggatggggagcttagaacaatagagataaataccaacatcaaaatgagagggaggaaacattataatttcttcattaagcaaacagtaaggttaaaacaaaatatgtaacttaaacttcaaagcacaaaaataattcttcaaaatattctaaacattttcatccaataagtactccgtatcaacaatcagcacctcacttggaaaatcagtcacaagtcagctgttaatgctgtgtggatgcaaccacagatcattacctacttaattgtgtatacatctaataggctcatacagctcttttagaacaaaggttttataatggagtagatgataaatactgaactgtagtgctaccaggtgctatactaatatgagcagaatttatatagagaattttagcctgtattaatgctgtaactaaaatagaaaaaaatgatttaaaatcaggtttgtaataatacagttaaaaaagaaatgcaatattacaagttcatattgtggcatcttgctaaaatcccataagtgatactaaaaatgttaagctaaatatagtttatctggtcaatgaatgcaactgtcagttgaccacagaagagagaaaagcaatttacattgtaaaaatttaaagacatccaatctaaaatttaatgttgactctgaagaatatcaattaatttatattttctgtcatttgaaactagagtgtatgaaagtaaacctgtacatacacatactcttctaaatcattgaacaaaatatggagcaaaccagcaacactactccatcttctggtgacattttccctcacctagatgtatttcagtgtaagtgtttctactgctgtcacatttggagcatgagatagggtataaaagatgattagcttcttcctaaatagcaaacatgaaattgtccaaacatgatagtttagagagcaaaaataagtacgccttaaaaaaaataacagaacaaactaaacttctcattacatattaaattagccctcaggtaatcagcccctaacaaacagcttaacatctacaaaaggctgcatgactggtgtgtgcctgtttaaagctctgctgtaagctgaactgttggtctcagctaggcatcctcaacatttcctttgaattttagccaacagtgccctaggcatgctcctagcactactattaacaaaacagctgtagttgaagcagtagtctttttgcctgacaaggacaccgtaacagtcattgtgatgtcttctgattgtgaacacaggtagagatgtacagcttggatacaaaaatttaatatgagtgtatttgagattataatttttactagttgtatagtaaatatgtgactaagcttgcttttctgaaacaaatgctgctgagtcaataccagacagtcccatgatcagtttggccaagtcacagtggacaacccagagctaaagtatgacatttttactcttcttcagctccctgtaccttagtctcagctgttcccatattcagtctctttagctagactaacaaaaaaagaatggagactcaaataaaaccagaaataaaagaggaaacattagaagtgataccacagaaatacaaagaattaaaaaagactcctgtgaactattatatggcaagaaattggataacttagaagaaatggataaattcctagacacataaaaactaccaagataaaatcatgaagaaatggaaaatctgaatagaccaataatgagtaagaaaattaaatcaaggccgggtgcagtggctcacgcctgtaatcccagcactttgggaggccgaggcaggtggatcacgacgtcagcagttcaagactagcctggccaacatggtgaagcccagtctctactaaaaatacaaaaattagctaggcatggtggcacacgcctgtaatcccagctactcaggaggctgaggcaggagaattgcttgaaccaggacccaggaggcagaggtttcagtgaactgagatcatgtcactgcacttccagcctgggctacaaagggaaactccatctcaaaaaaaaaaggaaagaaacaaagaaaaaaaaaaagaaaattaaatcaataattaaaaagtctcatcaaaggaaagcccaggacctgatgacttcactgctgaattcaactaaaatttaaagaactaataccaattctcaaactcctccaaaaaactgaagaggaaggaatactacaaactcattttatgaggccaacattacctgacaccaaagccagacaaggaggctacaagaaaagaaaattacaggccaatattcctgatgcacaaacatgcaaaactcctcaacaaaatactaacaagctttaaaagaccattcaccatgatcaagtggtacaccacattaacagaatggagaacaaaaatcatataaacaactcaatagatgcagagaaagaatttaacaaaattcaacatgctttcatgataaaaacctctcaacaaattagatatagaaggaatgtatttcctttttttgttgtttgtttgtttgtttgtgatggagtcttgctctatcacccaggctggagtacagtggcgcaattgtagctcattacaacctccacctcccaggttcaagcagttctccttcctcatactcccgaatagctgggattacaggcccacaccaccacacctgctaatttttgtattttatcagaaacagggttttgccatgttggccaggctggtctcagactcctgacctcaagtgatccacccacctcagcctcccaaagtgctgggattacaggtgtgagccaccgtgcctagcagaaggaatgtatttcaacacaataaaggccgtatttcacaagcccatagttagtgttatgctcaatagtgaaaagttgccaaaaatacacaatgtggaaaaaatagtctcttcaataagtggggttgggaaaattgaatatccacataccaaaaaacaaatttatttttatcctacatcacaaacaaaatttaactcaaaatggattaaagctgtaaacataagccctgaaaccataaaactactataagaaaacaaaggggaaatgctctatgacattagttttcacaatttttttaaatatgatgccataagtaccagcaacaaaggcaaaaataaataagtgaaattatatcaaactaaaaagtttctgcacagaaatggaaataatcaacaaaatgaaatagtaacctatggaatgaaataaaatgtttgcagaccatacatccaataagaggttagtattgaaaatctataaggaagtcatttaactcaaaagcaaaaaagaaaagaaaagaaatgacccacaaataacctaattaaaaatgagcaaaatacctaaatagacatttttttttttttgagacctaagtctcgctcttgtaccccaggctggagtgcaatggcatgatctcagctcactgcaacctccgcctcctgggttcaagcaattctcttgcctcagcctcccgtatagcagggattataggcacctgccaccacgcctgctaatttttgtatttttagtagagacggggtttcaccatgttggccaggctggtcttgaactcttgacctcaggtgatctgcctgcctcagcctcccaaagtgctgagattacaggtgtgagccactgtgcccgaactaaatagacatgtttcttttttttttttttaaatcctttaagttctagggtacatgtgcacaatgtgcaggtttgttacataggtatacatgtgccatgttggtttgctgcacccatcaactcgttatttacattaggtatttctcctaatgctatccctcccccagccctccacccaccgacaggcctcggtgtgtgatgttccctgccctgtgtccaagtgttcccactgttcaattcccacctataagtgagaacatgtggtgtttggttttctgtccttgtgatagtttgctgaggataatggtttccagcttcatgcatgtccctgcaaaggacatgaactcatccttttttatggctgtatagtattccatggtgtatatatgccacattttcttaatccagtctatcactgatgaatatttgggttggttccaagtctttgctattgtgaatagtgctgcaataaacatacgtgtgcatgtgtctttatagtagcatgatttataatccattggatatatacccagtaatggggttgctggatcaaatggtatttctgcttccagacccttgaggaattgccacactgtcttccacaatggttgaagtaatttacactcccaccaacagtgtaaaagcattcctgtttctccacatcctctccagcatctgttgtttcctgactttttaatgactgccattctaactggcgtgagatggtatctcattgtgattttgatttgcatttctgtgatgaccagtgatgatgagcattttttcatgtgtctgttggctgcataaatgtcttcttttgaaaagtgtctgttcatatcctttcctgactttttcatggggttgctttttcttgtaaatttgtttaacttctttgtagattctggatattagccctttgttagatgggtagattgcaaaaattttttcccattctgtaggtttcctgttcactctgatggtagtttcttttgctgtgcagaagctctttagtttaattagatcccatttgtctatcttggcttttgttgccattgctttgggtgtttgggtaatgaagtctttgcccatgcctatgtcctgaatggtattacctaggttttcttctagtgtttttatggttttaggtctaacatttaagtctttaattcatcttgaattaatttttgtataaggtgtaaggaagggatccagtttcagctttctacatatggctagccagttttccctgcaccatttactaaatagggaatcctttcttcacttctttttttttttttggtcaggtttgtcaaagatcagatggttgtagatgtgtggtgttatttctgaggcctctgttctgttccatcggtctatatatctgttttggtaccagtaccatgctcttttggttactgcagccttgtagtatagtttgaagtcaggtagcatgatgcttccagttttgttctttttgcttagaattgtcttggcactacaagctcttttttggttctgtatgaaatgtaaagtagttttttccaattctgtgaggaaagtcattggtagcttgatggggatggtattgaatctataaattaccttgggcagtatggccattttcatgatattgattcttcctatccatgagcatggaatgttcttccatttgtttgtgtcctcttatttccttgagcagtggtttgtagttctccttgaagaggtccttcacatcccttgtaagttggatccctaggaattttattctctttgtagtaattgtgaatggaagttcactcatgatttgggtctctgtttgtctattattggtgtataggaatgcttgtgatttttgcacattgattttgtatcctgagactttgctgaagttttttatcagcttaaggagatttggggctgagacaatggggttttctaataaacaatcatgtcatcttcaaacagggaaaatttgacttcctcttttcctaattgaataccctttacttctttctcttgcctgattgccctggccagaacttccaacactatgttgaataggagtggtgagagagggcatccctgtcttgtgccagttttcaaaaggaatgaatgcttccagtttttgcccagtcagtatgatattggctgtgggtttgtcataaatagctgttattattttgagatacattccatcaatacctagtttattgagagtttttagcatgaaggctgttgaattttgttgaaggccttttctgcatctattgagataatcatgtggtttttgtagtcggttctgtttatgtgatggattatgtttattgatttgcatatgttgaaccagccttgcatcccagggatgaagcctacttgattgtggtggccaagctttttgatgcgctgctggattcggttcaccagtattttattgaggattttctcatcgatgtttatcagggatattggtctaaaattctctttttttgttgtgtctctgccaggctttggtatcaggatgatgctggcctcacaaaatgagttagggaggattccctcttttactattgattggaatagtttcagaaggaatggtaccagctcctctttgtacctctggtagaattcggctgtgaatgtgtctgatcctggactttttttggttggtaggctattaattattgcctcaatttcagagcctgatattggtctattcagagattcaacttcttcctggtttagtcttgggagggtgtatgtgtcccggaatttatccatttcttctagattttctagtttatttgcgtagaggtgtttatagtattctctgatggtagtttttatttctgtgggatcagtggtgatatcccctttatcatcttttattgcttctctaaatagaaatttttcaaagaaagcatacaaatggccaatagatatataaaaaggtgctcacatcactaatcatcagagtaatgcaaatcaaaacaaaataagatatcacctcacacttgataggatagctactaccaaaaaacaaaaggtaacaagtgttggtgagtgtaatcagaaatgggaatgcttgtagagaaatgggaaccttggtgggaatgtaaattggtacagccactatgaacagtagtatgaaggttcctaaaatagattttaaaaaaatagaactattatatgatccagcaatcccacttctgagtatatatccaaaggaaatgaaatcagtattttgaagaggtatctgcactctcatgttcattgcagcatcattcatgatagtcaaggtatagaaacaacctaagtgcctaggatatactttaaaggtttagacgacacgggattctagaaattgtcaataaatcaaaattccattgcagtagaaaactacaaaatgatgtactttctgtattgtttgtgtatccacgataaagtggctgaaccagatgatgcttataagtctttcctttgtctacagtgttgtaatattattgcattttcttctttaaaaaaaaaaaagggccaggagcggtggctcacacctgtaattccagcactttgggaggccgaggcaggcagatcacaaggtcaagagatcgataccatcctggccaacatggtgaaactccatctctactaaaaatacaaaaattagctaggcatgatggtacacacctgtagtcccagctactcgggaagcggaggcagaagaattgcctgaacctgggaggcagagattgcagtgagccaagatcgcgtcactgactccagcctggcaacagagcgagagtccatctcaaaaataaataaataaatatttaaaaatttaacatttttaaaaaggcactactgaattattttcatttactggcacctcaccgcctaatacagtatattcgcatgtatagataaatgttaaaagcatctttgttgttcctgcagtttgatatgaaacccaatttcctggattattccatagtcccaatgcaacaaggttcctacagactcaagaaagtccatacccattctggtactcctttcatcctggtagaaaattctgttctacttcagattcctagggctcaatctgaaagagcagaactcccacctggaggacaagcataatcagaaagaagtggacttcactgaaaagtcaattgtgctgcatcctcatttcagtcctttgttgtacatttctgtgaacactcaaagaagttcactcctttcttcttgagtaggaaagtggaaatgtagagtggctggaggcttgcgttttagagaagactgcacccacatcttttattaaggggactatgaggggctcctctattccacatgtccctgaatacaggacagaatgtcactactcgaccacctagcaagtgtccagcaaaggaaatgctcctcaagacacaggaggtagcagaagtatgtttttccctggagagaatggggctcacttccacaaaggctgccatcagagcctttcattatagccatatataagcaaggcctcccaaaccatgaaccccagtgaaataaactgaatgtcctggctttgttttaacattagaagagatttctgcagccagtccaatctcagcatcatgcagcttttcaaacaggaaaagaatgcttttcatactataggtcctctcttggtttcaggatacaaaccagataccaaggatcaatagagggctcaccaaagaaccaaaggttgtgagaatatatcatttcctgttattgtcccaactcttgtcattagcaaagtatgtggccttgtacaagatatttaatctccttgcaactcatttttttcatctttaaaataaaacagttggggccaggcacagtagttcatgcctctaatccttgcactttgggaggctgagacgggtgaatcgagttcaagaccagcctgggcaacatggtgaaaccctgtctctacgaaaaatacaaaaaattagctgggcatggtggtggatgcctgtaattccagctacctgggaggctgaggcaagagaatcacttgaacccaggaggcagaggttgcactgagctgagattgtgccactgcactccagcctgggtaacagagcgagattgtctcaaacataaaaaataaaataaaataaaacagttaggttagatgaattctaaagattctttacttggtttaaggttctctagtatagcatagcctctgtaatttgcatcttaaaccaccaaaagtcataatcttagtagtgaaagattaccttcttttcatgcacagatcactttcaaagtgcaaaacagactaaagaagacattttcagagttaacttgtctatttttttttattattatactttaagttttagggtacatgtgcacattatttctcctcaataccaacttttattgacaaccttatggacttaggtatgtcaatataagacatgcacaaataagcaccatattgatgcaaacactgaagttgttttttgtttgtttgtttggttggttttgggtttttgttttgtttttgttgttttttttttttttgccatctctggaattcctatcagcattgtaaattttgaaacaacccataacaaagaattaacttgtttcaataaacattccccacataaagtagctataagctgcccacaacgcaaactactgtatagcaaacaaccttgtaaaaattaataaatcttctctggtgcatgaaaatcagctaacgcttgactcaacagctttctacctaagtgccaccaataaactgagccccagagacaacagacggaaacagaatagcaaaccttaggaattaaaagatgtctctataatgtttttactttgctaatttaatagaagacacttagttatcatgaccattaactatccaatgtggaaatcaaattttaggaggacaaatgtataatatgcatcattttcatcattcattttaaaataaaggcaagtttcttacattaaaaaatccataagattttttcttcagactgtaactatagaaaaacaaatcaccctataaagatctgtagtttatgaagtagtgaaaatgatcaaatggctattgcaaaaagctggatattaggaaatgtgaatattaattctgaatttgttactgactcaggatgaccttgcatgatgcatccaaccttcttttctctatatcagaaaactaaagaataaatgtaacatcacattcttttctcctttgggacaaacaactatgtacaattgaataaaaatgaaattgcataagtagtggatagaatatgtttgggttggtttgaacttagcacactgtttaataattcaacattttttatacctgtgcaataaatttttaaatgatgtctgaaatgctttgaaatcttcagaaacaggtttataaatggcataaaaaatcattttatttgatctggtaaataagaaatagaataccacctaagacagacatgaatattttagtatagcagtccttggttcacttacccttaaaaggaataattcaatcagaattctttcaggacagttagattaattacagaagaaggaaaaaaagaatcttctcccaattgagcaattaacatacttcatcttacaaaggtcactgaagttaatccatggctatagaactattgctctagaagcttagcacctccccttagtactcattcagtccagctcccacttacacccttccttagactgcatctaaacaattccagatacacatgttctttatcttttattttattgatttatttattttttgacatggagttttgctcttgtcacccaggctggagtgcaatggcatgatctcatctatctgcaacctctgcctcctatattcaaatgattctcctgcctcagcctcccgagtagctgcgattacagttgcctgccaccatgcccggctaattttttgtatttttagtagagacggggtttcaccatgttggtcaggttggtctttatttttaaaggtcttaaagaaaatatatttacaattccattttaatgttagccccaatggaaagttagtccctaccttataaggtccttgtagataagcaattcccagtgcaatattattctagctgattcactacttttttcttgctataagtccttacatgattgaaggatattatcggaactcatcaactttttcttctctatatgctatagtacaaccacaagcctagcactatttagtttcattttctaagcatttcttccacaggatccctacattgttttgttgtatcctcagagttctcaagttcccagagtaagcctaagagtattttctatgtggtcagtcattatctatctagaattttattttttgttttgaaatatttgattgacaaagattgaatatattcaaagtgtgcaacaagatgattgagagatatatacacattttgtaatgactaccaccattaaattaacacgtctatcatcactcgtgctgtttattaggtccccagaacttgttcatcttataagtgaaaatgtgtacctttgatcaatatctactaatttcctccacccaccaatccctggaaagcactcctctaccctctacttctctgagtttgacattttcagattccacatataagtaagaccatacagtatgtgtatttctgtgtctggattactttgcttagcaaaatgtcttccaggttcaaccatactattgcaaaggcaggatttccttcctttttaaggctaaataatatttcattgcttatatgtataccacattttctttattcatctgttaatagacacttaggttgtttcaatatcttggctgttgtgaataatgctgcaatgaacgtgggagtgcagctatctcttcaagatactgattccattttctttggatatatacccaaaagtaagattgataggtcttatgatagctctatttcatatgtttttagcaacctctatactttttccgaaatgactgtaccaatttacattcccaacaatgtgcaaaggtttccttttcttcacatcatcactaactcctgttatctcttgtcttgcacacctgttaggatggctatcatgaaaaagataagagataacaagtagaattttatttttcaattgaaaaatattaacccgcagtcatttttatcaaataaattttatctaacttatttttatttttcttctgtttaataaaagtttgttttaaattcaatttttatcctacaaggtattatgtacccttctggctttggaattacctaaaaggggtcacacacccagtttagtaaaagaaaaaaaaagcagttgttcactcctgagcatcgtcactaaaaaagtaccatgtgctgaacaatacctgaagcataagggaagcttggatatatagaatgtattattaacctgaattggacgttagccagaacactgaacctacttcccccaagagattgtcatagtacaagtcctcagtactttaactgcccatcaagagatatcaccttagaaacatattagaacaaaatgttgcagctcccttcttgagaggtgtcagcatgttctttttgttacatagatcaccaactgctagactatgtatgtccaaaaacattctatcccatatgttcagaacagtgctggaccctatgtacagcacagaagtatacaaaataaagaacatatccatatccttatggaacttacaacctatttaagaaaatggcttatgagaataacagaaaacatataatagctaccaattatactaaacacatgtcaggtgcaatgttaagtcctttatacatatttcataggacttactttatacttgatatattgtttcctcaaagcaagctatttaagttagggttatttttccgatgctttttaaaaagaaactcaggtatccagtacaaacagtctaaccaggtttgggtaactacaaagctcacactctaatcactgtactacatggattctcaatgagtatatcatcaatcaaatgctaaattgtatgacacaaataaaagctaagaatggcaaagagtgaagagttatattgactagaggtcacaggaggaggtgttatgagggaggctagacttcagtttgactttaaagaatgatttaagtatgtaaaatgaaacgggctgtacattctaaatacgaagttatataaaccttgtgcacaggtcagaaggcaagaatagtatgccgtgatcagagagacaagaatcagatacgtgatgtgttccaacatgcatgcaggtctgaagtacaataatttaattttacatatttttatatcaatgtctaaatgtgctttagtctatataatgttcaactcaataatgtcaactttaatttatatcaaaagacttcagaagcctctggaaatggatgtgttttataatgttattataagttttaagggtagataaagagaggaatgaattacattagagtccacattatcaaaccttattttgttttacttcacaaaacgaaagctctaaggaaacctcttgatttataagcactcaaattaatacataaatctgagatcgatataatagctggaacttgttattaccattcctatgtcacaccaactagaaggatgaaaaccaagtagtccaagcagataaactccaagactgtacctgcctttcgatagtaagaaccaaaagagtgtccaaattctccggttaatcctgctttgtcatccgtttactttaggctgattcatcccagtaaacccaccacctcacctatcacagcctcctctcacaccttttccaatcaaagctatttcaacattagtctttttgaaagtaggaaaatgtagagatgttgtgccctgacccaaggaatagctgatgtgcaggcactcactcttttaaataaataaatactaagttcagacctaggaaagaaagcacagtaacctcagaaaaacagaagtgagagaatggagcaaagaactccagtagtcttatcttgtgccgagaaagaaatctctcaaagatgatgttaaaaatatcatagaaggggacagaaaataaaacctaatggatgactccaataaaataattatagtcaattcattggacatccataattcagagttaacactggcattttctgtttgttttaaaaaatggatagaagaataaaatatgttaggagaaaacctcaataatacataggggcaagggaaaatctctcagcccttggtatccaggaaaccaaaggcttatgctcttttgaattttaaatgtgtagcaaaacacattgattttaattgcctataatctgaggtcaaaccttttggcatggttctttgttcatagcaacaacaccaccaataatatttactgaggatttgccatgagtcagatactgttaggagcactggagaggatacagcattaaaggtgacagacgaggccctgtccttttggagcttatgttctgtcccagtgcggaatgataaatatggttggaccagggaacaaaccatgactaattctctaatacaaagaataccaccttataaagaggaaactttcttgctaaactggcaattttacagaggcctgaatcttttccattagaagaaaaacactttctggcgtgtgcttcatcaggttttggagctttaaaggaatagaatgcgagataaaagataaatcccatcaagctagagaagagctgatgttctgaccctttgaccctgcccatcaagaagacataacactccaggtttgaagtcagacttgatttagatttgaagcccagtttcacgccttattagctccatgaccttaggcatgttacttaacttccttaacaattttctcatctgtaaaatggtgctaacaaaagccacctcactgtattgttataagcatttaaagattcaattcataaatgtttaaatcataccatgtgccatatgcttttcatttaataaatagtatagatgatttatataggcatatatgtatacactccatgtgctcatcttttctttatgcacatataatttacccatctatcctcaatgccattctcccagagttctacccttctgcccctgaggcatttacattcttccaaattcacaattagctaataaaagaatccaatcactgaaaatgtgttaatgagaaacgataacagaagagtacagtgactactgcctgccagctcaaatacccctccatggtaaaatatggttttggaaacaaaactgtactaaaaattgcataggccggaggagtgactctggtgtgaacgctaagcagcatcctctgggggtttgttatagtagcactcagtaaccatcaagtgctaatacctagatcatcattaatttttttaaaaaaacaaaacttaaatggacattgtatcctttttcatgtaaattaatgtgtctgcaaaaagaatgtatttgccctggaacattctataaaacaaatataacccctaggaaaataaggccatagaaaggttaaatgtccatgtaacatctgtgatagagcaatacctagaacacaattctctttttggcccagtaattctagaccatatcatgttgacttaatgagatttaactaaaaatagaaaattctgctttgaaaaccttcatccaaaaggatccaaaacttgtgaattaggcaatggtgagaatgccacaccctttgctactctaagaggaaagtctctcaagtgatcgactcgaggcctggccatgcaagtcagacatttagtcatttttctagactctatccatcatggagcacattaccgaatttcatgcaacctcatttaaacatttaactggctgttctgatcggaataaacctttggtggaagtaaaagcttgacaacgctgacacctagtggctgtgaagaaactggagcagattcagcctaggaagagtagtgagctactgtggcagtgtctccaaaacacacagcatttaatcatgatgaatattaggttataaagtaccagttctaaaacaaaccctataaaagtttatttcagctctctatttatctaggggcctacaaaaggaggcaattaaaaaccttgtatttgaaaagtaaatcttccttcaatcttccacacttagcaaattactcatcttcaaagatcaaagaaaactaaagatcaattcatattttggcatatttatgactattttccttaatgttgcatgtacacccacaaccttatcctggtcttcaggtgatttttctccccaggtcaaatataaaagccaactggccaagccattatagagactccctttatgcctctgaagcgtccctagtcaaagggtagttggattttcacaaaccagcaggaattttctttaagagaggtataaggacacatgtggaaacccctaaagtacacatctaaaagcaaggaccacattgaacactgtgggaagccatatgaacacagcagatcagcacagcacaacctgtatctgctctaaccattagaagataagtttcctcagacccacctgcacctctgacaggcaggatggcaggaagcctaaagtgttcatctcctccaccaaggagagctctgactcctacctgctgacgtttgaaggctaaataatccaaattttccagctccttcccaagcttctggtaggttttctggaggtcagatttgttggcaacatttttgagagactcaaatgtcctttgaaactgaaattgaaaacaaaagtagatcattaggatagcagcagatttttctcaaattctcaacttgctaacacgaagagtcgataatgagcctcagtttctcccattcataatacagtgataacaaatgctagctaattatctttcaatgaaataattagggacacagaaagagttataaaccatattctaagtataaccaacattactgcatgcatgagaagcctgttcagtcctcattctaacaaaagagcatacttcatttaaaaaaaataaaaaagaaagttcatcttttaggatatacttctgctttaaaattttttagaaagcactgtgaatgtataattttaaatcataatgaggaagcattaaagagtgctcacatttcaatcatggaaacaaacaaatttatgaaaatgtagttgcttacacgatattttgctataatggcatggaatctggcttgcctctataataatatctatgcagaataggtcacccaacaaacttcagcaagaaagatctctcagagcttgtattttgagaaggaaggaaaacttaacattttgatgatcaaagcatatgtggcatgttcagcaaacatttattcatttctgctctataacacagatgagctatgagcagatgagttatgatcagaaagagagttctgatcagttctgctgaatcagaatgctcctattctttttaaatcagatactagataaatacaaaggtgaaaaattgcaacgaaccacagaatactgtctgctactaataattaattaagcaaaggaagctcacaagaaattggattcttggtttattttcataaattagaacatactttggagggttagtgattgaaaatgtcaagtaatgtaatttgcaagacatttgcatttgctctctctttatgtcatttatttcccatattctcactctgtgccattagacagatttctacagatagagacttgaccatcttaaacacaccagaactccactgtgactatgatgccatgagacaggctaataagattttatagaatataattaagtttccagggaaatgatttgacccttactatatcaaactctatgaaataagtcatattaaaatggcattctactgaattaaatccctaatttcatgaaagcaacatgtttatctcaatccaaggtgacagagggaaaagaaatgggaaataacagtgctaagcttccatgacaggacagtaaattaaattcaacaaataatcatttagaacctactatgcacaaagcactatgaatataaaagacatttcctgccctgaaggaactcataccactggagaaactagacatgaaattcggaaatgagatggacactgacacttactgagtgcccactcagccccaggtacttgatgctttccaatttaatcttcacaagaaccacaggagttcctatttctcttctcattctataattgagtaaactgggtttcagaaagtttgattgaactgggtttttattacaacattcatgttctttctactctatccttaactctaacacaaggcaaggtagtaaagagagtgcaaaaaaagagagataaaggtaacattggtgaaaactcggaaaactcactgatactgacactgacggagggactcagaccacgtagaagacgtaagacaatttgagttgggccccaaaggacaggaagtcttttaagagtctgacgtggaaaccaattctacccaacatattaaacacagccaaaatcagttcattttcccccacttataacaataaacaagttcctttcaacataattttaatgacctttatatgaaatatttattatattgtataatcatttctgtgccttgcccatttcttggttcattctcactatgttcaaatcaaaataaaaccttatctaagattctaaaaaatttaagtaattttatctatgatttaattaatacaagctattttactgacaaatccatttaactctaaagcatgttttagcccctgcactttgtcttccctaagaaatattagctctacttcttaaaatattttttcttcatatttatctctgtaaacattatacaactccaaatgggaactttagagcaaacacacttgtaaagagtgttcaaaatagccgggcgcggtggctcacgcctgtaatcccagcactttgggaggccgaggcgggcggatcacgaggtcaggagatcgagactatcctggctaacacggtgaaaccccgtctctactaaaaatacaaaaaattagccaggagaggtggcgggcgcctgtagtccccgcgggaggctgaggcaggagaatggcgtgaacccggcaggcggagcttgcaatgagccgagattgcgccactgcactccagcctgggcgacagcgagactctgtctcaaaaaaaaaaaaaaaaaaaaaaaaagagtgttcaaaataagaaacacagaaaaccaacacttcaggtaatatgcccatggccaaaggagaaatggagaaaatccagtaacaatacatgatcacaagaatgttttaactaaaggtcggactttgtataatatggagatttcagcttgaacttttgttatcaggaattatatcctccatttattgataataaagagttcaaaatactgtaaaaccatgataatttcattcatttaagcagttttttttgcttacaacaataattaattgtcaaggagaggtcatatgaaagctgtggtatagctctggcttagctccctattaaacacaccccatccccacctgcacacatgtacgcttaaagatactaaagagtgaaagcaataatcttactttccaagtgatgctgaagtacagaagataaaagttaggttgaggcctaggttttaaagagtattcacttggcttgaagatttttctaataggccacaatggttaatcattgaaacaaacctccaagattttctatatttgttcagtacatgataattttcttatattgattatttctccaaataaatgatctcccagttggagacaagttggggaaaggaagcacaattaattgaagagatttttaatactgctggattttacttattcatagttttgagtgggaatttaaaatgagccaaaaaccccagaataatttgttgaaccttgaatttatcctgtgtttttttttttaactcgttataaaccaaactcaaactttaaaaagctcagtgaattagactaaacccaaaacaaaccttggacatacaagataagaatgggtagaggaaaacaatatccctaagcccagcacttgctggaaaagtaagcactgtcaacactcccagagtgtgttttctcatcaaattatttctgctcagaaataataatagtaatccatcaaataaaacagcagaaactataattgctcatctcacattaaaatagctgacaaattattttgcaagaaagagaagcatagaaaaggcaacaggaaaatgtctactttgtctcagcagtcccttttcccagatacattttttctcctttttcctgacaatacatatataaataaatctaagccagtgttctatacaaattatgcatccaatgagttcatgtaaattatgtagatttgtggagtaatttgagaaagacacgaagaaataggctgaaacagcaggaaaaaaaaatgcagccaaggctctggcaaataaagttttcctctccctcactgccaacgccctggcttccttttgtagtcagatcgattgattcaaataactctagagctccagcagcctactaattcccataatttaaaaacatcaagtagcattgctccaaaacaagagccagctccacagtcatcatgttttcttatttaatatttcatgcatttatacgaggtgctgggtgctacctgtaacatgaaaagaaatcccatacccgcagcgttatgtgtacaaaagggtatacagtaagtgcctgatggaaagcattatatcaccaagtgtgatcttagtgtccctaaatcatctgtttaaaacaatgctaaaagtttctggagcctaaagcagaaggaaagaatagtcaaaaaaataatatattgatgctctataaatattaatacctagagtaaaaagaaattgttttaagcataagaaatagctaatctaccttacttaaatatggcaaccacagagcaatcaaaaataaagtattacagagaaagaaattatttaatgtttctgaatttaatccattgactttcatattttccaaatgaacttacaagatgataataccactcaataaaaagaagtttacaactgaagcagaaaattaaagctcacatacatatctcaaatgatttttttttttttttttttgctgtaaggaatgactataaaagttaagaacatagagcaaaattgggcttgagatctaaattagaaatagttctatgtaggtgaaggcacactggccttgaggtctgaggttcaagtccttgctatgccatttaataactgcatcactttggacaagtcattattattccaattttgattgtgttatctataacacaggacaaattgtctttgcctgcctacttcactcagttgttgtgaaatcagttgaggaaaaataaaagacattcattcaacaaatatttatcaatgagcaacataccagacatgtaagaaacagaggaaaacaaaagagaaacaactcttaccctaacagattttacaatctagctttataggttactgctttataaacttaaaagttccataaaattgaaaagaccattgtcattaagatcatgacacctttcagtagtgaataaggactgaacaaaagggtcattcaataattgtttatagagcagcatcactgtgcaaagcactgggcttgacgctgtgagaaacatcacatttatggtgaggcttgggtggaaaaatgacgaaatcattgatgctttatgaaaagtttggccaggtacagtggctcacgctgtaatctcagcactttgggaggccgaggctggcagatcaattgaggtcaggagttcgagaccagcctggccaacatggtgaaatcccatctttattaaaaatacaaaaattagtcaggtgtggtggcatgcacctgtaatcccagttacttgtgaggctgaggcaagagaattgcttgagcccaggaggcagacgttgcagtgagccgagatcgcaccactgcactccagcctgggtgacagaaaaagacttcatctcaaagataagataaaataaaataaaataaaaagtttatgggcaatgtccccaaagaaatcagcagtttacaaatggataatccattttgagaagggtcaagatgatgttgaagacaaaacccacagcagcagaccatccacatcaatttgcaaggaaaaaattaatcttgtttgtgtcctaattgaagaggaccaacaattaacaccagaagcaatagccaacatcatagacatctgaactggttcagcttacacaattctgactgaaaattttcagttgagcaaagtttcccctggatgaatgccaaaattgttgcacatagatcaattgcagataagaccagagctttcaatgaaatgttttaacaattttaatttcatcaagctccttaagtattcctttggagaaatctaacaaaagatgaatgtggatttaccagtatgatcctgaagactgagcacaatcaaagcaatatctaccaagaggtggaagtggtcctgtcaatgcaaaagcaagctagtcaagagcaaagatcatggcaatagttttttaagatgctcaaagaattttgcttgttgattttctggaaggccatggaatgatagtatctgtttattatgagagtcttttgagaaagctagccaaagctttagcagaaaaacactgggaaagcttcaccagagtccttctccaccacaatgctcctgctcattctgctcattctgctcattaaacaaagccaattttgcaagtttcaatataaaatcattaggtatccaccttacagtcctggtttggctccttctgactctttttgtttccaaatctcaaaaaatatttaaagggcactcatttttcttcagttgataatgtaaaaaagactgcattggcacggttaaattccaggacattcaattctttagggatgaactaaatggctagtatcattatttacaaaagtgtcttcaacttgatggagtttatgatgagaaataaagtttatattttttatttttttcttttaattccatttttctatgaactttgtgaagtcccctcatcattaccctgcttaaaattctttcatggtttccccttagctttcagactatagttcaaactttgtaacttagcacatagacctttcaaattaggtctatgcctacctctccagcttcaactcttgttcctctcacacagttcacccttcatctcagccattcaggactattacaagtctttcagcatacatcctcttctgcaggtaaaatgccctctgccccactaccttctttctctagtcaactctccaaactcagccacacagtattcatttaacataccctctcttaatacaattccaacctccataacactttgtaccaacctctaccataataacatattgttaatttactttttatctagtctgtaaattccaagagagcaggatcatgatggtatttttagaaatttgaatccctagcacatactagagtgatggtgactgccacaaagtaagcacacaaaaataaccatttgctgaggtaatccattaattaatcaaatcagagataactggaaagatgctgattccttcttaaaaaatgaaaattttacatggtttaaatttgtatggtcaaaggtcataaaatttcaattaaacaggaggaataatctcaagagatctattgtacatcatggtgactgcagttaataccaataaattatatacatgaaaattgctagagtaaattttaagtgttctcactaccaaaaattgataagtataaaaggtaatgcatatatattaagtagcttgagttagcgattccagaatgtatacatgtattaaaacatcatgttatataccataaatatatataatttttacttgtcaaaatagggggatatagaagggatggttaatggatataaaaataaagttagatggaaaaaaatctggtgtttggtaacataatagaaagaccatagttaacaataacttatcacatatttcaaaataactaaaagagtagaatcagaatgttcctaacacaaagaaatgataaatgcttgaggtgatggatattccaattaccctgatttgatcattacacattatatgcttttatcaaaatatcatatataccccataaataagtacaactattatgtatctatatgagaacacatggacacaggaaggggaacatcacactctggggactgctgtggggtcgggggaggggggagggatagctttaggagatatacctaatgctaaatgatgagttaatgggtgcagcacaccagcatggcacatgtatacatatgtaactaacctgcacattgtgcacatgtaccctaaaacttaaagtataataataatacaataaataaaataaaataaaataaaataaaatttaaaaaatatacgtttgaaaaaaaaatttcttcttccctaaaatttccaataggaaattcatgacaaatccagcaagtatgccctatttgtctctatttctaatttctcctcttatatcttgatgtggtttggctgtgttcccacccaaatctcatcttgaattgtaactcccacaattcccaagtgtcatgggaggaacccggtgggaggtgattgaattatgggggcaggtctttcctgcactgttctcgtgatagtgaatgagtgtcacgagatctgacggttttaaagatgggagtttccctacacaagctctctctttgcctgccgccatccacatcagatgtgacttgctcctccttgcttccaccatgattgtgtagcctccccagcaaggtggaactgtaagtccattaaacctccttcttttataaattgcccagtctcaggtatgtctttattagcagcatgaaaacagactaatacagtaaattggtaccagtagagtggggtgctgctgtagatacctgaaaatgtggaagcaatttgggaactgggtaacaggcagcggttggaacagtttggagggctcagaagaagacatgaaaatgtgggaaggtctggaacttcctagagacttgttgaatggctttgcccaaaatgctgataagcatatgcgcaataaagcccaggctgaggtggtctcagctggaaatgaggaacttgttgggaactggagcaaaggtgactcttgttatgttttagcaaagagattggtggcattttgccctgccctagagatttgtggaaatttgaacttgagaaagatgatttagagtatctggtttaaggaacttctaagcagcaaagcattcaagaggtgacttgggtactgttaaaggcattcagttttataagggaagcagagcataaagtttggaaaatttgcaacctgaaaatgtgatagaaaagaaaatcacattttctgaggaaaaattcaagccagctgcagaaatttgcataagtaatgaggagccaaatattaatccccaagacaatggggaaaatgtctccagggcatgtcagaggacttcccagcagcccctcccatcacaggccaggaagcctaagaggaaaaagcagtttcatgggccaagcccaaggtccccatgctgtgtgcagcctagggacttggagccctttgtcccagctgctccagccgtggctgaaaggggccaatgtcgagcttgggctgtggcttcagaacgcagcttctgaagccttgccaccttccatgtggtattgagcctgcaagtgcatggaagtcaaaaattgaggtttgggaacctctgcctagattttagagaatttatggaaacgcttgtatgtccaggtagaagtttgctgcaggggcagggctctcatggagaacctctgttaggaagagtggaagggaaatgtggtgttggagccctcacacagagtacctactggggcaccacctagtggagctgtgagaagagggccactgtcctccagaaccaccctagaatgatagctccactgacagcttgcactgtgcacctggaaaagccgcagacactcaatggcaacccatgaacacagccaggaggaaggctgtatcccgcaaagccacagggggagagctgcccaagaccatgggaacccacttcttgcatcagcatgatctggatgtgagacatggagtcaaaggagatcattttggagctttaagatttgactgccctgatggattgtggacttacatggggcctgtagcccctttgttttgaccaatttgtcccatttgtaacagctgtatttacccaatgcctgtaccctcattgtatctagaaagtaactaacttgcttttgattttacaagctcataggcagaagagacttgccttgtcttagatgagatgttgaactgtggacttttgagttaatgctgaaatgaattaagactttgggggaatgttgagaaggcatgattagttttgaaatgtgaggacatgagatttgggaggggctgggggcagaatgatatagtttggctgtgtccccacccaaatctcatcttgaattgtaactctcacaattcccacatgtcatgggaggaaccagtgggaggtgattgaattacagggccaggtctttcctgcactgttctcatgatagtggaagagtctcaggagatctgatggttttaaaaacaggagtttccctccacaagctctctctttgcctgctgccgtccatgtaagatgtgacttgctcctccttgccttctgccatgattgtgaggcctcccctcacaatcatggaatccacatggaatccatgtggaactgtaagtccattaaacctctttcttttgtaaattgcccagtataaagtatgtctttatcagcagagtgaaaacagaatacacatcttaaataccagtcttgacttgctctttttctttacatcttaatatgcttttacatattttgcctaagatcttccacaaaatatacatagcttctaacagctcttaattatacagtaattttccctttatcagctgctgatatcttcagtaataaaaggctttagaaaatctttttgttggtacacatctgccttttaaatagagggtggcctcggagagtctcagctgccaacatggtaatgtgatttttctgtcaatataaatatttgtcatagtcagaattattgtttgtccacaaatgctttataaaattatgtagcaaatgttaaatatacatttgacaaaagttgttaaattctggacccatttcctgtaagacactggtctattacctaatccaaagggatcaacattcccaaaacaagtaaaacatgactatggtatgataaatggaaaaagttagaaaagttagttcaactcaatagtcaaatttcccttcatttttaggaataagtacaacatttcactccaagggccaaaaagtgggagcaagataccaaggagaagaaagatgggacagggaaagaaggtgaaagagaacttataccagttcttgccaagtaatttatgtcatatatcattcagtcttcacaaaaccctttcaaggtattcggaataagttttattctccccataactcagaagaagaaaccaaagctcgcagatttttaactttcccaaaatcacccagctaatcaacaacacagccaggattcaagcaaggtctccatgctgccaaaagccatgttttcttcccacgatgtcctgacccagtaagcagaagccatccaaacctattttcttccaaataaaattgacccttagaaatccagatgccaaggtgggcacggtggcggacgcctgtaatcccagcactttgggaggccaaggtgggcagatcacccaaggtcaggagtttgagaccagcctagccaacatggcaaaacactgtctttactaaaaatacaaaaattagcctggcatggtggtgcacacctgtaatcccagctactcgggaggctgaggcaggagaatcacttgaacctgggaggtgaaggttgcagtgagccaagaccatgccattgcactccaggtgtgcaaaaagagcaaatctctgtctcaaaaaaaaaaaaaagaaatccatatgccaataaaacaagatgtggaatcctaagaagaacaaatagtacagaaaagtctgaaacacttgaacagtatcatagagataaacattttaacttaaattcctataaaaaatttataaacaatggtgacaatagagccaaaatacctttccaagtttctacaattgatgaaatattgaaatatcagcacttttttcctctgtcccctattacctttcatttggacctgtttttccccaaaagaacacacacatttccttaaggaactagacacgtttaaaagtgccatgtcaggaatccttgattatttaatttggcagtacttgtccatttttggttgctcagtgacccatgtttacactagttggtggtctcagactgtgtccttgtaaatgttctattgtaattgcttctcctggggcagtctcagtggaaagagtataatttaatagaaataagaaagctttacaaaatcaggaaatatatagatacatgctattaaaagagagtaacatctcatttatctgacatctaaaaggaaatatacttcaacgggattgaaaaaaatctgttatgtaagaaaagtcataagaaggaaaataagagtaaggccacttaaaaaaaattgtgagctcagaggaattctttaatgctatgaaataaagaacaaaaacagaaaatgtagcaggaacttgtataagtgtcaggagggaaaaaaaaaaagtccagaagcctgaatgaaatagtaaagacaaggagaagaaaggcaggccttggcccattacatgcaaaataagggcaagaaataaaaaggcagtcctctgttttgggggaaaaaaagtgtgttcccaggagaaattcatgtctttaaagtggataccctcctcccaccaaaaatctataatagattattatatagtaggattggggagtgtgatggctgactacagaatgcttcttaggaagggcactacctatactgaagaaaataccttaaggagtaatttaaggtgggtagtgatatcctaaggacagaaataagcaggggccaagtggagtgctagagagataactattctttactgcattccaatgaacataatttagaagtttgagggaaagtagctagagaaaaaatgtggaagggcaatgagatggagttgctatcaatgagattttgaagatttcgaacatacaaattgaagccctttagaatatattgttgcaatatagatatccctcccttccgtcttcctgtaagtttctgtaaggtttactacattcatgtattctggtctgctctggtaggttggagaatgtgtgtatctgtgtgtctattcgtgcaaggggaaaaggccaactccagattctgggtgaatataatgtagaatagagacagaaagacaatctataaatgaaaataattcagtggaagcaaaagcttggagacagagttgaccctgaaaatatgagctcccaaggaatttgcagaaatttgggggagaacattatacttgataggacacagaatgagggtttaaactaattatattgagatcttaagagcaagaagaacccagcaacaagtggttttgcatcataattaagtggattataagtaatttaaaaaatgaaggtcagaacaaaggagaagaaaataaaagcaggcaagcaatggtcacttagagctcttattgggtcattaaaaagtaagtcatgccaaactaacttcatttcctttataactgggattactagactgataaatccacaatgccacaaacagtatatcttgatttcaagaaagtctttcaagaagtgcttgaaaatgaaataaagaagcatggtttatacagcagcccaatgaagcaagcttgaagctcatttcaacaactttactcaaaggatgttcatatttgattggtattatctaaaagaaagatataatactgttttccatgtcattaaacattttttcatgaataaatttgaaaatgatatcaggttaggaaaggaagacaaaatcgagagtcaaaggatgatggactgtaacaaaaagcaggaattaataagataaagttcaatgaatataaatgtaacttctacctttacataattaaaaaaaagactagtatcagaggaggaagacctggattaggagtagtttgagctcagagagttggaggttgtaattgctttcaaaatcaatatgaaccaacaacatgacaaggctactgtgataggtaagatcatgttagacattaaatcagggatgtaattgtccatttatatcatggaatgttcacatcagagagtttgttttgatttcaagacactgatttcaacatttcatggaagttacctacaatctagaatgcatagaaaaggatttacagagatgatttgggggacttctatttcttgtaatagcaaattagaaattcagtctgatcctctgctgaaggaaacgaaggtttgatgataaaataattcatcttaaaaacatcacagagctaataaggcagtgagaaatttcctgaagtgggtttcagaagaggtgatgttcagtatccaatcaaaaatagccattcacattataagacaagacaccatgagtaaaagcaaggaaaatgatagcagaagcaggcacccaaggagtccaaacaccagagttctcaaaccatgaggatcagacagttctgctcaccatgtcgagtagatcaaaataaagactgaaaatttcagcaggaaactaaaagtcatacaaagaaatgtaagccaatttgaaaaatatatagaaattctatggtatttaccatataaagaacatccaaaagtcaaaaaatttttagcctagaaaaggggagacataggtaagtcctaagagtaatcatcagttatttgaaaagagccttttctattgccttgattctgtgttgctccagaaagcaaaactagacgcactgtttgaaatagcagggaggcagttttaagctcagtttgagaaatttgtctccaacaattagaagtgtccaaaatcagcttcactgtctcagaaaattgagattgttatcattgttagtgatcatctattgttaggcagttgcatatgttgcatattatcagagagtctttctacgtcaggtaaaatattaaactgtaagggcactgaagtttctccactatgattcttttgattccaagtagaagctaatattgtcataaacattattagaaaaattccaaactgatatttcccaaagtatggtttcagaaatttccaggattaatatactatggaagagttctggggtcaaaaacatttgggaaattctgagttaagcagagttaaacaggcttcttcatggcaatatttctcaacaattttaacgcgctaatgtgcatcaaaacattcatgggaatttctatgtgcagcattgatcattacaaaaagaaacaacttttttcctcttccatattttcaaagcatgctctacagaatacttttggggaaatgttgggctaaataattctaatcctgatgatctcagaaacaatttagtgattttcattctacatgaagtcttgaaataattgagttgataatgattcatatataaacttttcatgaggatgaaaccatgaaaaactatcacgatttaccacaaaagatgttcccttctctttgataagatgccacttcctttttcataacatataattgttttactacacatacttatatgtgacatataatccagttgaaattcaggctctaacaaggcaccaagtgtgagagaggatggttagaatttaaaacaccttctggtgtatctaacttactttaataactggttgtaggtccatgaatttgcctaaacttttaaaagctgtttgtagttaaagctgttctaaccattagagtagttaagttccaaaagttttaattctttcctgtttccttgagcaagttacttaaattcaatgtgcctcagctttctcatttgttaaatagaaatcatgatcatagggctgttataagaattgaattaaaagaaataatccagcacagtgtttggcacattataaaaacccagcaaatattaactataatttttactgcaagaggtactttgcttttgtttgatctacaatgccatcctgcttcatttgcatggtatgatgtatgtgaattacctacctctgtgcctaactcctagtggacactcaattaaaatggtagtgaaggtggttttattctttatatacagttacctcctaattggttatgaaggtggcaattttcaccttacaaaagccctgcattctgccctatctcaacaaatttagagtctaaaataggaattattgggtcattggaactaggaattacctgccacttaatcttttgtacccatttcttgtttacagcatttgttagtgtctgtattcaaatatgagacaaatgaatctcagaaatgttcagtaatttgtctgtggttattaaacaaaccaagaagcaagtaacagaaatctttgctcaattatgacacctacaaatccactagtaaacagctgctggtgatgagaacaattccctttcctaaaaagctacttaaactaaaaaaaaaagattgaattgctctttttactgtaataaaactatcagttcagtaatttgtctatggttactcaacaaaccaagaagcaagtaacagaaacctttgctcaattatatcacctacaaatcttctagtcaacagctgttggtgatgacagcaattccctttcctaaaaagctacttaaactaaaaaaaaaaaaaaaaaaaaaaaggtattgaattgctgtttttacagtaataaaactatcaaaagaaaaaaatgaaagtacacagagagggtcactctagcgttaaaataagcaatagtgaatacaagaaagatgtggctgggagcactggctcacacctgtaatcccagcactttgggaggccaaggtgggaggatcacgaggtcaggagttcaagaccagcctggccaacatagtgaaacccccgtctctactaaaaataaataatacaaaaaattagccaggcatggtggtgtgtgcctgtaatcccgctattcaggaggctaaggctggagaattgcatgaacccagaaggcagagattgcagtgagccgagatcaccactgcactccaacccaggcgacagtgcgagactccatctcaaaaaaaaaaagaaaaaaggaaagaaagaaaagaaaaagaaagatgcaaagaaaggtttagcttagcagttagagaaaatgattttgacatgaaggttaatcaaataagaccattgcttacttaatagagtagttatattaaaatcacagacactttatgaaaatgcagatttatttatagacagagtataagggtcctatttcaagcagaaaatacaacagatataaaaagagttctttgcaaccttttcatctgaacactactaatgatttggtcaaactctgaaaacaggctttaataaaattctctctctactaaaaatgtgctaagtgggtttgtctgacaaaataaagcattcaggatatcttgctaactttatatcctcctagctaatatacattatttactcatattaaatacatgtctacattttcctaatggattactacagacatcacagactacctgtaaacatgcactctttatcctgaatcaagaggacatggcaaagtagaattcatttacaaaccaggataaatttccaaatgtcttcaactttaaggtttctatttctcaagttatttatactcatatgtttatcatatattatctatataattatgttatttatttatttatagagagcatagttatttaaatgatcaaaagtctagaacttttcctagccatttccttataagcaagccatctcctgtttaatttcccattggctttagaactactctggcttccttattttgaggtatacattagtcttcacaacccagtctagtctgcttctgaaggggtgatgttaagaaatgagagtgaagccaagatgcactaggatcgacgccaggttcagagaatgaaattagaagtgaagacaatgccaaggtaaactaagccatcttttacttacagctgacacatgttgcaagaggcacatgacatcaatcatgtccgcaaggataaggagtctcgtcaccgcagccagcaaggcacgggcagcttgaaccacagcctccctttttgggagaaaacaggggtcatctgtaaatctctcagctgatactttcagagcttcacctgaaaaatacaaccccatataagttatactttaagtttcaactatgcctatttcaggatttatcagctaacctaattccaagtaaattccaagactaagcataatataaaaatattgtcagttgacaattttctctctcaataaacaatgcagtttcaaattaacatttgtttttcacaaatattttggaattaagaagcataatatcattttcctgcaagaaagttgtgctcaactgactaggaacatctagtaaaattgctgccaacttctgcatttgctgaatctcatttcttgtaaaaggttttattactaaagcttcaatcataaacaatcctgcttataaaaacaaggtaaatctttattgagttactttccaaatcaatggatgttaggactgcagctctctgataaaagtttaacataggcaaatttattctaaactatcaatataatgaataaactatatcctaaatttagtcacagaaatagtacttcatagtacctaattgttagagaatattgtgtccactatttttaatgccttttcatttaaaatatattttattataaaagaaatatgtattctttcattgttttaagttcccagttcaaaagggtataaaatgaaaatatttaataaaaaactctctttactcccatccaacaacataattgataattaccacatccactattttttaagtttttaaatctaaacttctttttattataaaagtactataatacgtgtccattacttttaaataatttaccacactaaagaacatcaagtaaaaattttaaaagtctccaaactaatcccccaaagcaccaactattcagctcttgcatatctgtccagaaatttttccatgaatgtatgatttatgtgtataagcatatatagatacatgttttatatacataaatgtatatgtatgttttatacatgtatgtgttttatgaatatattcatatacattcatatatacaaatatgttttataaagacagattttataagaaaacatattttatatgttataagaagaaaatgtaaaaatatagagcctttagcaagtagtatcctactagagagattttctgtaatttcttctttttgcttttcaatttattttcctttcatactgggaaacagatgaccaggaggcaatatagcacagtaattaacagtgtgtactctggagccagactgcttcaatgtctctgtcctagtatctcaatcaagtcacttaacatcattactcttcgttttcttctttttttaataatataaaataataaacctactattttatgagtattaaataagagtacataagttatatttcattgatacactgtaacttattttaccaggcccctattgaacacataagtcatttccaactttttcctattttatataatactataaagaacgtccaggacatatatctttacatgcatgaacaagtttagctttaggataaattcctaaaagtagaattcctgagtcaaggggcaaatgaattttaagttttgttatatattgccccaaaattctccaaaatacagtcatcccatcaaaaatatacaaaagggtctgtcttatccatttatggattacatccataaatattttagtttcattgactcatgaaccttaacataaagaaaactgagtcagttattttattaaataaaataaagaatactgtttcttataatagacaaaacttgtgaggagggtctgagactgtctcaacatgttagtatgtctcatttagatctctttagcaataccaagttaggaactaggactctagacacttctgagatcaaattcatatattccccctctagttctgggaacttggacagtaaatgccttcaatgtccttatctataggaaaggggtaaaaatatgacttatctcatagtgtttcttggatgcttagatgacagcattcatatatttagcacagtatttaaacatggaaagcactcaacaaagattaactgttattttggaggaaatttctaatagagatggtaaatttttaatgccaataagtgggtgattttcatctgcttctctgcaagtcagaattgctgctatgagactgtgaaaagttaaactgacttccagaatttagagagcagatgaatgcccacaaaaaagattaattttttctttttgtgattctgagttggaaagttataatagcctttttagaatactgtctttgacttcacatactaaaactaaatatatatcaaaaaattatgtatttttgactctaaaaatgttggaatgttgaacaactggctggagagccatattcagaaagagatcatttaaacaattagtatattcttgtctttgttaaaggaatataaacagccagtcaggtagctctgttgggaagagaaaagtcactcccaaaatacattaataaagatgctacaacttaaattcttattgctggacttatccctaatttccccaatattcctaacccttttcagctggtttcagcccacactctggtcctaagttaaacatcacttcctatgggaagcttggaccccccattaccaagataggtcttacaataagattctatgttttctagcataaccttcatcataatttattataacaaattgtatcaaaacctgtcttttcttctggatcataaaactagtaagtgcaagagctgcattggccctggtcaccacagcatttccaggatctagaagagtgcctactctgttgcagatattcaatacattgactatctactgccaaatgaatatatgaatgaacattattcaacttttctttgataaacatttgttgttccctctataaaacagctgtatcctaggtatccaggatatagatatcagtatgaaacagtatttttgcagcccaagaagttcagatcaagtgaaagtcaacaaacactgatacaggtttctggtacaggcctgtacaaagtactaagagacacagaggaggatctacctctgcctgaggtgtcagaagatatacaaaggaatgttctaggtaaaagaaacatgttccaactattgataaggtattgacaacgacagctggtttatagaatttagccagttcactgtcatattgatttctgacaggagaaaatggttattttcctaattaaatagaaaaaaaggtacaggtttcctttccatctagaatattagcatctatgttttataaagtctacatgtggagagtctactcttttgaaatatcattcccaatcttgcttataatgcttttactttgaagtttgctgaataggaaatttcacttttaaaatacatacaaataaaaataactacattttttcttcaagaaatcccactctatacataaaaataatttactaaaggtcttgaaaatgccagaagaactaggtttagaaaacttctttctactgagtccatttagttcctttcctaaaaacgggattttttttaatcgttaaaaaaaatcagttatgaaatgcctaggtactagagtatatagtctacaaatatctatagagataacttttacacacctatataagtgtaagagatgacaatttctgaatatacaaaaatctggctgataaactttttatatgatcaaataaataaactccagaagtacaaaaaaattgttggccaaatacacatattaccaaatattctttattttataaagcttcctatatggttattttacaagttcctttgcttcatttaaaagtataattctactttctaaaagtgcttatattgattataaacttaaaagtcaaggaaaacatagtataagaaaaatatccagaggaaaaagagaataaccaaaatgaaaaggggcaggtactaaagataaaaaacttcccaaacttttacttgacattatgtttattattcaattaagatttctaatatatgcatctgtccaagtgatacaaatacatcatggtaaaaggtttatatcatacacatataacatgcattagtacatattcattgattcaatatataatagggttcacagactgagactcaacattcagggtttggttttatttgtttttggttgggaaactgccattttgaatttgaaaactctgaagaggtagaagcttgaatttaactttttagcagacaattattttatttggcagggaagagaggaggatgacctcaattcgatcctaaacttacacagatgttaaaaaaaaatagtaaagactcccctttaaaatgttcaagacagtttgactactaggagcaaacatgttttgtatgataaaagaaaaccttatcatggcaggtggaagggcagcaaagctagccactgctgtgtggacccaaggttgggtgctacggcagggttatagactaggaatgtggctgcatatggttgctattgtaaactattggctatgtcttatttccattttattatcttcgaactcagtaaagtcttattaaaagttataatttgcttccagtcaagggagaataacagagaccagattcctttcctacctgaaacaaaaaaatagaccaaataaatgcaaaaatggttataaggcactggatgttaggcagtgaaggacagtaatccctgagaaatggaccaaaaaaaacaggatgagccctttgatagccccagcttaccaccatgagagactttccaggcaatgatacaggaaggggaaaccaaggcagagcctggcaaactctctgagctggggagacaaagctgagagtcctgggagatcaaggcagtaaatgtataaaacagaatagagaatgataaagggaagagatacacagagaaagaacactgataatctgcacatgctccctcttgagtattcagctgaatactgatcaaccagtatactggaggaaaccacccaaggctagggaaagaaccacccaaaaggatttgaggtaactgtacttgccactcacacaggactgggaataatgcttgtccaaccaccagactggaaaacttcataactcatgggacattggatagaatacaaagaagagtcttgcctcaatagtggggaagaattagccttagactgaacattgccctagtgccttctaacaaagcaattcagagaaaacagaattcccaatttcaagaccagcagcattcatgcatcagagaagagagatagccaggtaaaggcaacagcagactagcataatgatttaatgaaaatggaaggacatgagcagccagtcactgagcgctgcaccattgggaactctcaaaataagctgggaaatactttgattgggctgattctattaaaaaaaattttttcataactaatctgtgtttttttattattatactttaagttctagggtacacgtgcacaacgtgcaggtttgttacatatgtatatatgtgccatgttggtaaaattatataaaatgttttataaaacataaaatttgatggggctagtttctataaaagtaatagaaacatctcccaacatcatagataggatatagtagaagctgtcttaaaagacctcctcttaaccacctctctagattaataaactttttattcctctcagcaacatattaatggtatctcctttccggtatgtaaaatatactgaagaccttctgcttccaataattgaagttaatcaagaagttgaaaaggcttgctccccaatcttttcatgtgagttgtaattataattatatagttttattaactatataaacctatcaaatataagtgtaaaaatatctattaattctttaaaaactaatttttaatgctttagagacattcagtaaagatgagttgttaagttgggtatggaaggaaaaaatggtaaaagttggagcagggcaaggcaaggaaaaggattataaaagatcaagaaagattctgcagttaggtagcttcgcaagtgtcattaagttttcttccatgaagacaccaaaactggaaattttagtcaatatagtttggttgtggtttcggtcaaaacgactatataagttatgcgtttgtgtgtgtacaactaatgaactaatgaactttttacttctaataatgagaacaaatatatcttgaagcaaaaattatctgctatattttaaaacactggaaataactttcagtcacatttagtcaaactttaattatgtacttgtatgtaaaagtacacaactcctaacttaaaactttattaatatctttttatgagcaaaatattttgtacaatgtatctataaactatgcacctaaataaatttcaatattaaggaagattttaaaatagagctaaacatctcttcagaatttcaaagaaaaatgaaattttttaattttcaaaaaattgaccaagtaatttcatgtcatatttaaatttgacaatttttttttctatgcaggctctcactttgtcacctaggctggagtacaggggtaatcttagctcactgcagtctcaaactcctgggatcaagcaatcctcctgcctcagccttccaaggagctgagactacaggtatgcatcaccaaacccaattaattttttgtatctcttatagagatagggtctctttttgttgcccaagctggtctagaactcctggcctcaagtgatcctccctcttcggcctctcaaaatgctgggattatagccatgacccaccccactgagctaaatttgacaataattttaagataataaaatacacaaaatatattcctgcaacattattatcatctcctggggttagaagtttcatatacctaaagtggtttacagtaaaacaaactgacaaaggaacaaagcaatccatattgtaaaccagtcaataaaaagaaaatagtatggatttataacttaaataaatgtttaaactttgagctgaaatagctgcccataattattctctattgaatttctttcccaacaacctattgactgatatgccacccaccaataaacacttttatattattcttgatgtaaatttaattcttttgaggtgaaaaaataaaccttataactaagatttccgactaaagttaatttatcattttttctaatatttccttttatggctaaatgtagtaagcttagccatgaatacacttaaattatactatgatgaattggcaaaaactgatatctttgcttttttgacatctgctaaaagaatctcattctagtgctttgaagttgaaagttaatttttaataaatgatacctaacccttacaaacagttcattcattcatatatcaactattcagcactaaaatacgcaaagcactatggggtatacaacaacgattataacatggtctccaccaggtaccctcaaataggaaaatgaaccacttcaatgagaagattcttctgtttggttttaaatgtcagcatcttcagatacacctaccttaaagtatattaagacataattccatagcacctcccccccaaaaaatacaagtataataattcttcatatgcacaattcctagatttcaatattttatgtatgatttaaaagttctctgagaaaaaatgaaaaacgagagtgactacatcaaaggatcactcaatcattttaaaataaaattaccagttatcaattatcacttataatcagcctcaacaaagttctattcatcaagaggttaagtaataaagtagaattcaggcttcaccttactagaaattcaagtcccacagctgtgatcagagcaataaatatttaacaaatttattctttcatatatcaccccattcagagtactacagctgttaatcagtaaggtcaaatttggccctattgatatgctccttatgcagaaatgacagaagttattttagggccccattataaagtcttagttcacaagctcacacaaaacttgcaaggaagtcaatgtggccaactgtacatactgaaagtacagagtgaaacccaaaggagcataaaaatttagtgaagataaacatccaggattctgaaccattacaaaagtaaatacattccattcacaagagcatccaacaaataaaacatttaggaataaatttaacaaagaagtgtaagacttgtacactgaaaactgcaaaacattgctgacaaattaaagaagacctaaataaatgatcatatctcatgctcatggattagaagacttaatattgttaagatagcaatactccccatatcggtccacagattcacaataatccctgactgatatcgcttagatgtttatccccgccaaatctcatgttgaaatgtaatccccagtgttggaggtgggacccagtgggaggtgtttgggtcatgagggtgcatcccttatgaatgtcttggtgctgtcctcatgataacaagtgagttcttgctcagttcccatgagatctagttgtttaaaagagtctgggacctcgcactcctcttgctcccactctcgtcatgtgacaatgctagctccccctttgccttccaccatgattggaagcttcctgaggccctcaccagaagcagatgctggtgctatgctccatgtacaatctgcagaaccataagccaattaaatctcttttctttataaattacccagtctcaggtgttcctttatagcaatgcaaaaatggactaacacttttaacaaaatccttactggctctttcaaagaaattcaccagctgatcctaaaattcatacagaaatgcaagggacccagaatagccaaaacaatcttgaaaaagaggggcaaagttatagaaatcacacttcccaatttcaaaacttactaggaagctataataaccaatagaattgctatctcagaaataaacctttacgtttatggtagatcatagacctacttgcaagagctaaaactataaaactcttagaaaaagaaaacaggaatacaactttataatcttgagttaggcaacaatgtcttatatataacaccaaaagtacaagcaataaaaaaaattgatgaactggacaatcaaaacttaaaccttttggactccaaaaaaaaaatcattaagaaggtaaaaagacaacacacagaatggaagaaaatgtttgtaaaccctatatccaataaggggcttatatccagaatctattaaaaaaaaacttactacttaataataaaaagacaatcctgtttttaaaataggcgaagagtctaaatagacatttctccaaagaaaaaatacaaatggtcaataagcacataaaatgacattctatcataaatataatctaaattattaaagcataattaaagatgtacagaggttttagtaaggacctttgaataagttttttttattatttaaaaataggcacatttcttgtgtagtcaaaaacacaaggctaaaaacatacctgcagaggggaccaaaaaaaaatcaatgtgtatgtatatgtactggaaactgtcactttaataactgtaaaaactagtgagtaattattataatgaagcagtagaaaagtaacatttacatacattgcagctaacttctctccttggggggaatatcaagatcattaaaagggtgggggtagagggtgtcgatcttgttcaccatgctgccccaaaaccatgagcagaatgcatctctctcggaaatccctggagaccccatagagctcattttgtagctaaaagcaaactctgagctataaatattagttgtcttttgcacaaaaattaacagtagctttaattgtcctttctttttacttttcccaccaatgatacattcagtctgagaaacttgagattcttaacaagtaagaggtcaaatatttttgaaattccttgtattcttagttcctttacttcagacagagtcggcaaactatggaaacaagccaaatccagcctgccctgtttatgtgcagcctacaagctatgaatgttttttatatttttaaaggttgggaaaaaatcaaaagaataatattttatgacatgaaaaattatataaaatgtaaatttcagtatacataaataaagctttattggaacacaaccataactttttgtttattgcttacatatttctatagctattttcattcttcaacacacagagttaaatacttgcaacaatgtacggcccacaaagcctgaaatatttactttctggcctttcacagagaatgtttgctgatccctcatctgagataaatgaactaataaaattcataatctgtttttttaaaaagcacttcatttttaaaaagttcatacaactaacaagggtctccattttgatatatataaatgtggccctaaaaattctttttcaaaaattatttagttggctttcatatcttaagctgaatacatggaccttgcctgaaaatcccagacaacataaagttgagtttatcccttaaaagaataaaatttgacccagcagtctttcagcttcagtattcatatatctaataatattagcatctcaggaatttcccatatgcctcagttaaatagttccccgaagaatactcagccagctctaaataatgctcccagtgtaatatcaaaaggaggtatgaattttctcctcaccccaaagcataatagtgaaaaactatactgcaggagtcaacagccagctcatctaccttgttcgctacctttcaatgaaatcctgagcaagtcacataattttttggtatcaatatccttattatgcaaacacaaagattatggaaacacatagaataaagaaaataggtgaaataaagaaataaaggtgaaatgaagaaagaataaagaaattatttaaagaataaagaaattctttttttaaagaataaattatttaaattaagaattctttatttaaagaataaagaaattcttttattaaagaataaagaaatttctttaccgtagaataaagaaatttctttattcatagaataaagaaataggtgaaataaagaaaataggtgaaagcctttagttctcagagaaacatactaaataaacatggagtttttaaaaggcaaaagtatcctcactgctgtgttcatattttatatattttagtgtgaagatttatcacgtcaaaatcaaggctactcccatgaaacttacagaagaatttcccatggagcttcagcaaactttcgtgtctcagtctatcataaatctcagcttgctattgacagggaaaggaggcagagaagagctgggtagaggagggtgtggttcctggcgagggctccacctccaggcctgtgcccacagacctaggtgaggacaggcactcctgactttgcacccaaatgttgcatttcccaggactgtcctggcctgccactccccagtcctgtgcctgtaaaaactcccgagactctggcaggcagacacacaagcggctgcacgtggagagaaacacatcttggtggaggaatacacaagcagctgaacattgagagggcgtcgagaggaggagatcggtggaagaagacacaagtggctggacgtgaagaggacatcaagagcagacccgcaggccatcgaccggtggaacgacgtggagttttactgggcagtcggagaagagtcaggcagttttctaggggaaaccatctcctttctgtctcccccacctgctgagagctacttccactcaataaaagcttgaactcattctccaagcccatgtgtgatccaattcttctggtacaccaaggcaagaaccccaggatacaaaaagccctgtccttgagataaggcaggggtctcattgagctaacgcaagccgtctacggatggctaaactaaaagagcaccctgtaacacatgcccactggggcttcagagctgtaaacattcgcccctagacactgttgtggggttggagccccacagcctgcccgtctgtatgctcccctagagatgtgagcagcggggcactgaagaagcgagccacactcccatcacacaccccctgaggaggacaagggaacttttcccgtttcactatcaatcacactattttaggggttcaactgtccataaccagtggactatcaatagaaactctcacttccaaatgcctccctcagggatgtttgaaactggtatttattaaactgggtaaatgccatagactaaagaggaaagaagaggtcaaaaatattgggtaaaaaaaggagcaatgaaaaattttggaatagaaggaggaaacggtgaagcaagtaagggaaaataagagttgctaattctttcttttgggttatcagtatagactgaatatttgatgaggaagataaaacaggagatctcattgatagccgctagtgtccaaaagcaaagaaaaatgagaagtattatctcatataatgtgctagcacacagaaaaggataacaacgcacattcaagaatacaatacgacaattcaaggatgcatttgatattacaggtccatgcatatttaagtacaatcattccttattttatagtttcttataggttttttttcgttgttagaggttagacctgaaccagccaaatccttgagccaacttggaataatgattatatgattttcatgcaatactattttttttcttcaacttttaagttcaggggtacatgtgcaggatgtacaggtttgttacctgtacatcgacgccctctcaatgttcagctgcttgtgtattcctccaccaagatgtgtttgtctccacatccagccacttgtgtgtctgcctgctagagtctcgggggtttttataggcacaggactggggagtggcaggccaggacagtcaggtaaatgtgtaccatggtggtttgctgcatagatcatcccatcacctaagtattaagcccagcacccattatcaattattcctgatgctctccctccccaacccaacccctgacaggacccagtgtgtgttgttcccgccttgtgcccatgtgttctcatcactcagctcccacttatatgtgagaacatgcagtgtttggttttctgttcctgcattagtttgctgaggataaggacttccaattccattcatgtccctgcaaaggacatgatctcatttctttttatggctgcatagtattccatgatgtatatgtaccacattttcttcatccagtctgtcattaatggatgcaatactattttgagtggattcttcatcaatttttttctttggcccttttttaaccccgtttttttaccacccaatctctttcattgccagaaacttctcttgttctgtgatcttaaattttcactgatttgggggcactggtgcaccttttagttttgtctttcaactgtgatttcaatttgagcaggaatttagtatggaatgtgtgtgtgataaaaacagttttgctgtaaagaacatgctcttcaataaagttcaacaactcctttctctccataatagaccctcaggcacttagacacactagctcctaaaaatcgtttgtaactataccccttaaatctatatttaataataatatattatgtacaaaatttaattcattttacctaggtttatacatactaactggtactttgaagtcaagtcattctttctaaatgcttcttttattagaaatgagttcataagctgtgatcctggaaaaacatcttgagtcactatcgaaatctaaacattttaaagtcctcttaaaatgttactaattaactgagagagtctttagcccaaagcgtctcctattagtgtgggagaaataatagtaatctggacattaagaaacctgcattttacttattagcagcatttgaggaatggcatttaaaaatacgggaaataagattattctctgggaattaaactgcagtcatcacttacacaatggatggaagagatatacaaaaaaagaaaaagaattttcttctcacattcaagaatacaatagaaatgaattatattttgagggtcaaatgaccagtcatctttttttcttttcttttttttttaattatactttaagttctagggtacatgtgcataatgtgcaggtttgttacgtatgtatacatgtgccatgttggtgtgctgcacccattaactcatcatttacattaggtatatctcctaatgctatccctccccgttcccccaaccccacgacaggccccagtgtgtggtgttccccaccctgtgtccaagtgttcccattgttcaatgaccacctatgagtgagaacatacagtgtttggttttctgtccttgtgatactttgctcagaatgatggtttccagcttcatccatgtccctacaaaggacatcaacccatccttttttatggctgcatagtattccatggggtatatgtgtcacattttcttaatccagtctatcattgttggacatttgggttggtttcaagtctttgctattgtgaatagtgccacaataaacatacgtgtgcatgtgtctttgtagcagcatgatttataatactttggatatatacccagtaatgggatcactggatcaaacagtgtttctggttctacatccttgaggaattgccacactgtcttccacaatggttgaactagtttacagtcccaacagtgtaaaagtgttcctatttctccacatcctctccagcacctgttgtttcctgactttctaatgatcgccattctaagtggtgtgagatggtatctcattgtggttttgatttgcatttctctgatggccagtgattgtgagcattttttcatgtgtctgttggctgcataaatgtcttcttttgagaagtgtctattcatatccttcacttactgtttgatggggttgatttttttcttgtaaatttgtttaagttctttgtagattctgtatattagccttttgtcagatgggtagattgcaaaaattttctcccattctatacgttgcctgttcactctgatggtagtttcttttgctgtgcagaagctcttcagtttaattagatcccatttgtcaattttggcttttgttgccattgcttttggtgttttagacatgaagtccttgcgcatgcctatgtcctgaatggtgttgcctaggttttcttctagggtttttatcgttttaggtctgacatttaagtctttaatccatctggaattaatttttgtataaggtgtaaggaagggatccagtttcagctttctacatatggctagccagttttcccagcaccatttattgaatagggaatcctttccctatttcttgtttttgtcaggtttgtcaaagatcagaatattgtacatgtgcggtattatttctgagggctctgttctgtttcattggttgatatctctgttttggtaccagtaccatgctgttttggttatgtagtcttgtagttcagtttgaagtctggtagtgtgatgcctccagctttgttcttttggcttaggattgtcttggcaatgcgggctcttttttggttccatatgaactttaagtagtttttttccaattctgtgaagaaagtcattggtagcttgatgcagatggcattgaatctataaattaccttgggcagtatggccattttcacgatattgattcttcctatccatgagcatggaatgttcttccatttgtttgagtcctcttttatttcgttgagcagtggtttgtagttctccttgaagagatccttcacatatcttgtaagttggattcctaggtattttattctctttgaagcaattgtgaatgagagttcactcatgatttagctctctgtttgtctgttattggtatataggaatgcttgtgatttttgtacattgattttgtatcctgagactttgttgaagttgcttatcagcttaaggagattttgggctgagacgatggggttttctagatatactatcatgttatctgcaaacagagacaatttgacttcctcttttcctaattgaataccctttatttctttctcctgcctgattgccctggccagaacttccaacactatgttgaaaaggagtggtgagagagggcatccctgtcttgtgccagttttcaaagggaatgcttccagtttttgcccattcagtatgatattggctgtgggttttcatacatagctcttattattttgagatatgtccaatgaatacctaatttattgagagtttttagcatgaagggttgttgaattctgtcgaagccttttctgcatctattaagataattcatgtggtttttgtctttggttctgtttatatgatggattacatttattgatttgtgtatgttgaaccagccttgcatcccagggataaagcccacttgatcatggtggataagctttttgatgtgctgctggattcggtttgccaatattttattgaggatttgtgcatcgatgttcatcagggttattggcctaaaatcctctttttttgttgtgtctctgccaggctttggtatcaggatgatgctggcctcataaaatgagttaaggaggattccctgtttttccataaattggaatagtttcagaaggaatagtaccagctcctttttgtacctctggtagaattcaggtgtgaatccatctggtcctggaatttttttgtttggtaggctcttaattattgcctcaatttcagagcctgttattggtctattcagggattcaacttcctcctggtttagtcttgggagggtgtatatgtccaggaatttatccatttcttttagattttctagtttatttgcttagaggtgtttatagtattctctgatggtactttgtatctctgtgggatcagtgttgatatcccctttatcattttttattgcatctatttgattcttctctcttttcttctttattagtcttcatagcagtctatcaattttgttgatcttttcaaaaaaccagctcctggattcattgattttttgaagggttttttgtgtctctatctccttcagttctgctctgatcttacttatttcttgccttctgctagcttttgaatgtgttcgctcttgcttctctagttcttttaattgtgatgttagggtgtcaattttggatctttcctgctttctcttgtgggcatttagtgctataaatttccccctacacactgctttaaatgtgtcccagagattctggtatgctgtgtctttgttctcattggtttcacagaatatctttatttctgccttcattttgttatgtacccagtagtcattcaggagcaggttgttcagtttccatgtagttgagcagttttgagttagtttcttaatcctgacttctagtttgattgcactgtgaccagtcatcttaaagtaacagaatggatcccaggcttcaatggctaaccttgactataaattaactaaaagttttggtatatctaaaaaaaggaattatcaatcaaaaagggactgtgtcaaccatggaaaaaagaaagttggtgatattcatccaaacagtttccaacagagtaagagctttatataataaaccatacatagtagaaccccattggtaagattatctctacagaaaggatagatgaatctgatgatttttaactttcaccattaagcattcaatttatccagcctcctttgttctatctctatgctcactaagcaatcttctgattattatttatgttgcctatattgatccatctacagtgagagaacatattggttgtgtgggtgtactttgttctgcataactttttcattataaatttaaaataggttctgattttacatcttagcttcatgatcttagttaatgtgagtatactcctgagagacaaatctggtcttggcatatgtatctgaaagggatctcagtttcaaataacagaatctattctaactaatttaaaaggtaaaggaatttgttcagggttattgggttgtttacagaatttctgcaaggcccagaaaagccaggtttgaatgatattaaggcaggaacatcaaccaagaacaacttctaatgccaccatagctctattttaggtagaaaccccactactaccaccactcattactcaacacctatgatactaggaactgggcctgagaaactctgtcagggctgccctaaaagaacaaatgcttctgccactagattgcaacaagaccctatctctctaaacatggccactctcatactgcttacctcatccttccaagtttcacaggtatgcatcttttttgcagaacctaagccatattcccaaatgcaagaagagtcttggaaatgtatctttttatctttccaacctttctaaacatggccactctcatactgcttacctcatccttacaagtctcacaggtatgcatcttttttgcagaacctgagtcatagtcccagatgcaagaagagccttggaaatgtattttttatctttccaacctctgtagtatggtccctcccaaatatactccactagaaaggagctggaataggtcaagtgaatcttaccttattaaaactattatactgcttaaaacacttttaaaactgtgtcatgtttgacacctcttccacccacccctttttctctcagttctaccatgcttaaaaataggcttttaatatcaattctattcttcactgagattgctataaagatcttgccattgatatatgtcaaagtgttctgaaaaagcatgaaactatctgaatgcggctggcagccaagatggccgaataggaacagcgccggtctacagctcccagcgtgagcgacgcagaagacgggtgatttctgcatttccatctgaggtaccgggttcatctcactagggcgtgccagacagtgggcacaggacagtgggtgcagtgcactgtgcgcgagccaaagcagggcaagcattgcctcactcgagaagcgcaaggggtcagggagttccctttcctggtcaaagaaaggggtgacagatggcacctggaaaatcgggtcactcccaccctaatactgcgcttttccaacgggcttaaaaaatggcacgccaggagattatatcccgcacatggctcggagggtcctacgcccacggagtctcgctgattgctagcacatcaggctgagatcaaactgcaaggtggcagcgaggctgggggaggggtgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtgcttctcccagcacgcagctggagatctgagaacaggcagactgcctcctcaagtgggtctctgactcctcacccccgagcagcctaactgggaggcaacccccagtaggggcagactgacacctcacacggctgggtacccctctgagacaaaacttccagaagaatgatcagacagtagcattcacggttcacgaaaatacgctgttctgcagccaccgctgctgatacccaggcaaacagggtctggagtggacctctagaaaactccaacagacctgcagctgagggtcctgtctgttagaaggaaaaataacaaacagaaaggacatccacaccaaaaacccatctgtacatgaccatcatcaaagaccaaaagtagataaaaccacaaagatggggaaaaaacagagcagaaaaactggaaactctaaaaagcacagtgcctctcctcctccaaaggaacacagctcctcaccagcaacggaacgaagctggacggagaatgactttgacaagttgagagaaggcttcagacgatcaaactactccgagctacaggaggaaattcaaatcaaaggcaaagaagttaaaaactttgaaaaaaatatagacgaatgtacaactagaataaccaatacagagaagtgcttaaaggagctaatggagctgaaaaccaaggttcgagaattacgtgaagaatgcagaagcctcaggagccgatgcgatcaactggaagaaagggtatcagtgatagaagatgaaatgaatgaaatgaagcgagaagggaagtttagagaaaaaagaatgaaaagaaatgaacgaagcctccaagaaataggggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaacaccacaaagatactcctcgagaagagcaactccaagacacataattgttagattcaccaaagttgaaatgaaggaaaaaacggtaagggcagccagagagaaaggtcgggttacccacaaagggaagcccagcagactaacagcggatgtctcggcagaaactctacaaaccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaacaggcctgccctaaaacagctcctgaaggaagcactaaacatggaaaggaacaaccggtaccagctactgcaaaaacatgccaaattctaaacaccatcgaggctaggaagaaactgcatcaactaacgaggaaaataggcagctaacatcataatgacaggatcaaattcacacataacaatattaactttaaatgtaaatggactaaatgctccaattaacagatacagactggcaaattggataaagattcaagacccatcagtgtgctgtattcaggaaacccatctcttgtgcagagacacacataggctcaaaataaagggatggaggaagatctaccaagcaaatggaaaacaaaaaaaggcaggggttgcaatcctagtctctaataaaacagactttaaatgaaaaaagatcaaaagagacaaagaaggccattgcataatggtaaagggatcaattcaacaagaagagctaactatcctaaatatatatgcaccaaatacaggaggccacagattaataaagcaagtccttagagacctacaaagagacttagactcccacacaataataatgggagacttaaacaccccactgtcaacattagacagatcaacgagacagaaagttaacaaggatatccaggaattgaactcagctctgcatcaagtggacctaatagacatctacagagctctccaccccaaatcaacagaatatacattcttctcagcaccacatcgcacttattacaaaattgacaacatagttggaagtaaagcactcctcagcagatgtaaaagaacagaaattataacaaactgtctctcagaccacagtgcaatcaaactggaactcaggatcaagacactcactcaaaactgctcagctacatggaaactgaacaacctgctcctgaatgactactgggtacatgacaaaatgaaggcagaaataaagatgtcctgtgaaaccaatgagaacaaagacacaacatactagaatctctgggacacattcaaagcagtgtgtaagggaaatttacagcaataaaagcccacgagagaaagcaggaaagacctaaaattgacaccctaacatcacaattaaaagaactagagaagcaagagcaaacacattcaaacgctagcagaaagcaagaaataactaagatcagagcagaactgaaggaaatagagacacaaaaaaccctgcaaaacaatcaatgaatccaggagctggttttttgaaaggatcaacaaaattgatagactgctagcaagactaagaaagacaaaaagagagaagaatcaaacagatccaataaaaaatgataaaggggatatcaccgccaatgccacagaaatacaaactaccatcagagaatactataaacacttctacacaaataaactagaaaatctcaaagaaatggataaattcctggacacatacaccctcccaagactaaaccacgaagaagttgaatctctgaatagaccaacaacaggatctgaaattgtggcaataatcaatagcttaccaaccaaaaagagtccaggaccagatggattcacagccaaattctaccagaggtacaaggaggaattggtaccattctttctgaaactattccaatcaatagaaaaagagggaatcctccctaactcattttatgaggtcagcatcatcctgataccagagccgggcagagacacaaccataaaagagaattttagaccaatatccttgatgaacattgatacaaaaatcctcagtaaaatactggcaaactgaatccagcagcacatcaaaaagcttatccaccatgatcaagtgggcttcatcgctgggatgcaaggctggttcaacatacacaaatcaataaaggtaatccagcatacaaacagaaccaaagacaaaaccacatgattatcttaatagatgcagaaaaggcctttcacaaaattcaacaacccttcatgctaaaaactctcaataaattaagtattgatgggacatatctcaaaataataagagctatctatgacaaacccacagccaatatcatactgaatgggcaaacactggaagcattccctttgaaaactggcacaagacagggatgccctctctcaccactcctattcaacatagtgttggaagttctggccagggcaatcaggcaggagaagtaaataaagggtattcaattaggaaaagaggaagtcaaactgtccctatttgcagataacgtgatagtatatctagaaaaccccatcatctcagcccaaaatctccttaagctgataagcaacttcaacaaagtctcaggatacaaaatcaatgtgcaaaagtcacaagcattcttatacaccaataacagacaaacagagagccaaatcatgagtgaactcccattcacaactgcttcaaagagaataaaatacctaggaatccaacttacaagggatgtgaaggatctcttcaaggagaactacaaactactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcatcgccaagacaatcctaagccaaaagaacaaagctggaggcatcacactacctgacttcaaactatactacaaggctacagtaaccaaaacagcatggtactggtaccaaaacagagatatcaaccaatgaaacagaacagagccctcagaaataataccacacacatctacaaccagctgatctttgacaaacctgagaaaaactagaaatgaggaaaggattccctatttaataaatggtgctgggaaaacaggctagccatatgtagaaagctaaaactgaatcccttccttacaccttatacaaaaattaattcaagatggattaaagatttaaatgtcagacctaaaaccataagagccctagaagaaaacctaggcattaccattcaggacataggcacaggcaaggacttcatgagttaaacaccaagagcaatggcaacaaaagcctaaattgacaaatgggatctaattaaactaaagagcttctgcacagcaaaagaaactaccatcagagtgaacaggcaacctacagaatgggagaaaattttttcaatctacccatctgacaaagggctaatatccagaatcgataaagaacttaaacaaatttacaagaaaaaatcaaacaaccccatcaaaaaatgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacactttaacactgttggtgggactgtaaactagttcaaccattgtcgaagacagtgtggcgattccttaaggatctagaactagaaataccatttgacccagtgatcccattactgggtatatacccaaaggatcataaatcatgcttctataaagacacatgcacacgtatgtttattgtggcactattcacaatagcaaagacttgaaaccaacccaaatgtccaacaatgatagactggattaagaaaatgtggcacatataatccatggaatactatgcagtcataaaaaaggatgggttgatgtcctttgtagggacatggatggagctggtaaccaccattctgagcaaactatcgcaaggacagaaaaccaaagaccgcatgttctcactcataggtgggaattgaacaacaagaacacttggacacagggtggggaacatcacacactggggcctgtcatggggtggggggaggggggatggatagcactgggagatatacctaatgtgaatgatgagttaatcggtgcagcacaccaacatggcacatgcatacatatgtaacaaacctgcacgttgtgcacatgtaccctagaacttaaagtataacaactgtatatatatgcatatatgtgtgtgtgtgtgtatatatatatatatatatatatatatatatatatatatatcactatgatcaggtgggttttatatcgtgatgcaaggatagttcaacatggccaatcaataaaacctgatacattacataagcagaatcaagggaaagaaacatatgttcatctccatagatgcagaaaaagtatttgagaaaatacagtatcccatcatgatacaaactctcaacaaagtgggcatagaaggaatctccctgaaaataagaaagaccatatacgagaaacctacagttaacatcatactgaatgggaaaaagttgaaagcattttctctaagaactggaacaagacaaggatgcccactttcgccattcctattcagcatagtaccagaagtcctagccagagcagtcaggcaagacgaagaaatgtaaggcatccaaattggaaaagagaaagtcaaattatccctgtttgctgatgatatgatcttatatttagaaaaccctaaagactccatacaaaaactcttagatttgataaatgaattcagtaaaatttcaggatacagagtcagtgtacaaaaatcagtggtgttcttatacaccaataatgatctatctaggaaagaaatcaagaagtaaatcttatttacaatagctacaaaaagatatgtagaaataaatttaaacaaggaggtaaaagatctctacaaggaacactagaattcacagataagaaattgtagatgacacaaacaaatggaaaaacatcccatgctcatggatcaaaataattagtattgttaaaatgaacatactgcccaaagcaatctacaaattcaatgcaatccttatcaaaatactaatatcatttttacaggattagaaaaaacaatcctaaaattcatacagaaccaaaaaacagcccaaatagtcaaagcaatcctgagcaaaaagaacagaatagctattattttttttcccacacagttcactgatgtatagaatggctattattaaaaggacaaaaaataacagatgttggcgaggatgtggagaaaagaaaacccttatattctgttggtagaaatataaattagtacagcctctatggaaaactgtatggagatttcccaaaggactaaaaatagaactaccattgcatccagccatccactactgaatatctacccaaatgaagccaatatataaaaaagataccttcacttgtatgtttattgcagcactatttacaatagcaaagatatgcaatcaaactcagtgtccatcaatagatgaatggataaagaaaatgcagtatatatatattatatatatatacacacacaaacacacacacacacatatgtgtgtgtgtatatatatatatatatatatatatatatacaaaacctaggcattaccattcaggacataggcataggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcgcaacctactcatctgacaaagggctgatatccagaatctacaatgaactcaaacaaatttacaagaaaaaaacaaacaaccccatcaaaaagtgggcaaaggacatgaacagacacttctcaaaagaagacatttatgcagccaaaaacacatgaaaaaatgctcatcatcactggccatcagagaaatgcaaatcaaaaccacaatgaggtaccatctcacaccagttagaatggcgatcattaaaaagtcaggaaacaacaggtgctggagaggatgtggagaaataggaacaattttacactgttggtgggactgtaaactagttcaaccattgtggaagtcagtgtggcgattcctcagggatctagaactacaaataccatttgacccagccatcccattactgggtatatacccaaaggactataaatcatgctgctataaagacacatgcacatgtatgtttattgcggcactcttcacaagagcaaagacttggaaccaacccaaatgtccaacaatgatagactggattaagaaaatgtggcacatatacaccatggaatactatgcagccataaaaaatgatgagttcatgccctttgtagggacatggatgaaattggaaatcgtcattctcagtaaactatcgcaaggacaaaaaaccaaacaccacatgttctcactcataggtgggaactgaacaatgagaacacatggacacagaaaggggaacatcacactctggggactgttttggggtggggggaggggggagggatagcattaggagatatacctaatgctaaatgacgagttaatgggtgcagcacaccagcatggcacatgtatatatatgtaactaacctgcatgttgtgcacatgtaccctaaaacttaaagcataataataataaaataaaaaaagaaacagatgcaacaactatatttccaataaaacaagacaataaaaataagaaatgagaaaatggcaaaaaaaaaaaagaatgaaatatgtcttttgcagcaaattggatagaactgggtatcattatcataagtgaaacaagccagggacaaaaagacaaatattgcatgctttcataagtggatgctaaaaattgtgtataaatgaatgtagaaagtggaatgattgataatggagacttggaagggtgagagggttagagcggagaggatagtgagaaattggttaatgcgtacaatgtacgttacttgggtgatgaataccttgaaagccctgacttaaccactatgtaatctatgcaagtaataaaattacaggtgtaccccatatatttgtacaaagaaaaatctgtatcctttcatgtgaattatctggagcttgaatgtgcagtctaatgtctatagcctcggtagttatgcctaccagaggtagcaattccaaacagataccacgggcttcatgttcatgtatgtttactgggagaggtcttgcaaattaatggaagcttgccactgctaaactgcctcccatctatttttaattgtaggcctccaccaaggtcatcaagagtcagttggagggctaggaagattaatgtggagctttcgaatctatcagaagctaactatagctctccttcctaaatatggggttatggtattttgtattaaaagaaatgctatggtatttagtatattaatgcaggagcctcccagctgcatgtttgtagagcttaggcctacagtagttgacaacttgccccactttgcatggctcatgaatatgtctggcagggtagtggatgtagccagaaactaggggactttctctctcccttgtgagtagtaaactttgggttaaaaaatgttcacatacctcatgtgcataacatatgtacttgtgtattttttctatttatctctctttctacattttcatagttcttcatctcaatgtttgcaagactccaggctacagactgtttttttttttgcagtaggaattaggagtcaaggcttaccaccatccatattagtcagagaaaaccattacttccagaaatgattattcttggaaagtggcatcctggaagtgtacttaatcttcctatcagtatacttaggtacttaaacaacaaatggcattatagaattttcaatattgaacatttaaaatgttacctatcttctccctgattgttccagtatatatatatgtgtgtgtgtgtgtgtgtatagtacagtacatatttccttgcacgcacacacacacatatatatatgcatatttatatgcacacagacacacacacatatatatatatgcaaggaaataaattttgtcctagggaactagagattagaaaaatttttactggtgtccattttgggttacctgtattgaaagagcttttgaaactcagctatattgaatatttatttataaaagaaaatagcagttcaatttttgttaacgattcctaagtaacgggtcagctccatctacttgttcaacaatgttgcagttaggacttaggtgaaatgtttggtatttaccaccaattgctcacagcctatatatggtttcaaaggcaacagctgctgccctcattacttccatctcttactatgttggtgttgtgtgcatttaactgttattataacttaacaatgtccttagataagcattaagacacaaatgcaatattcttttcaacttggtatagcatgcttcaggagacgcagttcgttcttcatttgaaagagaatgatgaactcttgttctaacacattttaacatgcatgcattgtgtcctgtagctggcagaaagtttatggaaacatttccattgaagactgatgagataattagctacattgcttgtaaactactaattgctaaaaaaacgttcaacatggtattccataatgttctcttgaaaaatcttcagcagacttttcttttagtgcatttgatattttcagcaaactcctcagtgtcaaccattatgaggtgtgcggatgattgggaagtacttaatatgtgtgcatagccattccaatttgagttacttgatatgctggacatatagacaagctgatttaagaaataacagtaattccagtttttaaagtatgagaaattctgtaagctgtgtaccatttactttgaagtataattcaaaggtgggagcaaagatttaatgcatgttaacaggttgatttgtaagtaatgagtcctagaaactaaaatgtggcctgaaatctcagctggtaaagagtctgaaatcagaggtgtgattcttatattagccatggctctgctctccttcacagctatagcgatggcaccacagcgtagccatttcataaatgtgtgcaaaggtaacagagtgacctaaagtttatgttcacagaagatgggtctgaaaattattgttgtgttgcacattctagcattaaagagtgcattaagctattgcagttgctcagggggaggaataaaaatcttaagaatttctgtccttgactgtttcttctcatccctttcttaagtttcaaaagaagtggtgttcctttttgctctttaaaactaatctttccaatcattatctggatcttagctcatcccttctcttctcttctcgagagacttttattctacaattacctttttttctgtagcatgttcatttaccttccttttcattagttctttcttcacacatattagcttgcccctgctttacaactggcaaatattcaataacaattccactttcttttagtctactcttttcttaaactcctaatcctgttttacctgacctgttctgcttggtgtatttgttgtttaatccaattacttttgaacaattttaattctcttcaactcctgtgctgcattcgacatttatttactcatcctgaaactttccgcctttcttttagaatattatatatgaaattcttctattacttccccacatcgtctttctctttcctcattgacttcttcctcttgtctctttttttagtgttagtcttggtcctctctgtcacttcttgtttcctttcctgggagagcttcttcattctcatgatttgaattacagttgctatattgacaacttttagttctcatgtaaagttccactgccaaattctgagtgcttctcaataatttttctacattaatacatagataatcatactcatctcactcccacaaataatggccactcttgggaatgtttgatgttcaacatactagttgaaactgttcatttcttccccagtgagtagtgacacatactgtggacaacattactgctgtaaccttttactaggtggttccacctggctgttttggtattacatactcaccatgtataaactgaactcagcatcttcttcacaaggtctttacaaactttgctatctctagtgtcatctgacttgaactctcagcatatttgacatagttgattattttctctttttgaaatactgtttccttgactaatggagcactgccagtcctggtttctttttcacatctttggtaatttcttttcaatctcctttttggttcatcattttcatactggccatccagtgctggaactcctcaaagctggttcattatgtgggatagatggaaagtgaagttggaaataaacttggaatgataaatttggaataaaccttggagatccttcaatggcaagataaggatgctggggcatccttacaaaattttttagtcaaacagtaacaggactaagtctatgttttaggaagatttatctggcattaatatgtggaagataggttacatctccacagtgcctctctaatattaatgatgataataataactacaataatactgatttgtatttatgtgtcttgatgagataatgcacataaggcaaataaggagactcaaatctagaaagaaaaaatgatttgcctagagctacctggttagttattcacagagttgggattgcctttcaagtttatactaaagaaatatttgttgactgtttgataattgtgtatctccatttccctttattttttctgtcatttaatatatgttactctggtcactctaagtatctttgaaattgcttgagaataattctctagtacagcctcaaactgtgatccttggaaaacaagtgtttctagaaatgttaagaactcttctgtaagaaaaacattaagtaaattcataaaactcaattaaaaattctaagcatgggttcattactagataacttctcagtcaacattcttaaaatgctgaattgtattgcaaatctctgcgagtagattataatagactatagtttatacaggctgggtgcccaagtagcagaacctaagatggaggttcttgtgcaactgatttactggagtcccgtcaagtgaaatctacgagggggtgagggaagcaggagagggcagagaagaagctgagagaagttgaactaaagcttggactgtacgggatggcaaacattgactgcatgtggccgctgagcacttgaaatgtgcagagtgtgactgaggatctgaatttctaattttatctaattgtaacttaaattttaaaaaccaatacttcattcagctattgaaaaactttaaattatgagtatgtgaatcatctttttcaactataagtttttatgacatctaaatacagatcaagtatttctgatgaaaatttagtatctgaattcagatgttttataagggtaaaatacataatggatttcaaatactttgtatgggaaaatgtaaactgtcaataatctttttatattgattgcatgttgaaatgatatattttagatatgttggattaatcaaaatacagttttaaaaccaattttacctttttttacattttaaatatttgatttttttctatttacttaaattttttttgtaaatgctaataatttttaaaatatgactaccaaaatatttaaaatcacatatgaggctcacattagcttttctactggaaagtgctgagctaaagtatagctctaactgatcccataggaggtctggagagtgaatcgcaccagaatgatctccccttaaggcaacaggtcagtcttttgtgtcccagggtcagccagtcattggttgatcctttatcccctcgaagcataacttccaggcctaatgcagtttggaattttcgagagattctttcataaactttaccaccagcctgttgtgtgctatattggatttgatgagaccaccatacaatcagtaagtctcaaaggatggaaatcaccaaactccattgattttctatgtaatattttatttcctaagatgtctgcctttctcaggcagttaagcatgaaactcactacacagaaatagcaacatttagcatatctgttctgatgcttgtttctgagttacctaagtgctaaacaactatcaataattttgatttctcttgagaaagacttctagattaggtgccccaaggagaattttatgatcgaaagctatgttgggccccagtagctcatgcctgtaatgccagtactttgggaggccaaggtagatgaatcacttgagtccaggagttcaagaccagcttgggcaacatggcaaaaccttgtttctacaaaaagtataaaaagttagcttggcatggtggtgcacacctacagtcccagctactcaggaggctgaggtgggaggatcacttgagcctgagaggttgaggctgcagtgagccgtgattgtaccactgtgctccagtctgggtgacagagtgagaccctgtgtcaaaaataaaagtaaaaaaataaatagaataaaagctatgctgctctcctacgccttttagatcgatgtgattatcatgacatcattacgaattggtgtatagacaatgatgggattaggatacagtcaattcattggcattcaaagaaatgggaaaagcccagtgtccctacgaccaacccccaaaaaaaatttcctcaaaaccagagataaaatttgcttcctctttcagtttgcaagcatgcagcctggacagaaaaggaagcaagtgcaaaacttgcttggagaagggtgactgataagtcttgaggtacatggaagagacaacattccatagcttatgttttcttttttcacccccttgaaatcagactatgagacagagaacaggtgccatctccctatcttatgtgaactgacaggattgaacacatattcccgggaatatctcagcactcctaaaaaataatttcagaaacatttgtaaaagctgaaaagaagaataaaacactggcatatgagatgaagacagaaggttagatagactacagaaaatcaagtattatattagataagaaagttgaaagtcaagtccttccctttccttcccttcccttcctctctccctccctcccttcctccctccttccctctctccttccctccctctatccttcccttccctcaacacttaatacattatcacaattaaaaatatattgtactatgtatcaaatgctgataatctcattaaaaataagttctgattactgacttcaaggaacttcagtataacttagttttaggaaagtaaatgagaataattatagcagatgaaaatgttcaagatgttatagtacctttaaatataaaagtgttaagagagtacatgtggaatggtaagaatgaagaaggctaattgataattttccaggagttgaagttcagttcagatctataaaaattttagatcaaaatatgcatatcataaaacattaaacagagcagaagagcttatgatgaaaagcaataatcttttgccctgctccttgctactttcaatccaacaccctaggaaaaacctcctttgcttccagtcccacaatctggaggaagcaggtttgattttagatcttctggtgcttacttcataactttaagtcgtatgcttatatctcttttctttgattgatttatttaaggaattatctatttactccctacaatgaaatatgaaagttttgttcccctacctctgtgtccttaccctttcttccttccaatgtttgataatttgaattattttttgttttattattatccctctgttttgtattctatcatttttaattagtgtcctgaccactctttgtgtatagtaagactaacagcatccattccacttcctccccctttacttctgcattccacctttcccttctgttttctgtcacttcaaattgtattcttacattgacaaggttgttaactttttttttttttttttttttgagacggagtctcccactgtcgcccaggctggagtgcagtggtgcgatctctgctcaccacaacctctgcctcctgggttcaagctattctcgtgcctcagccttctgacaagctgggactacaggcacccaccgccatgcccggccaatttttgtatttttagtagagatggggtttcaccatgttggccaggctggtctcgaactcctgacctcaggtgatccacctgcctcggcctcccaaagtgttgggattacaggcatgagccaccaagcctgaccaaggttgttaacattttaattctgatatgcaaccataatgaagtcatctgcatttgttcgttagctaatagtaaaagttgaaaatcacagtgcaccattaatgttactgtgactctatacattttatttagtacagggtgatgtaggatactgaaatcatatcttcttctccaaggacccaatgtcacaacccctgggccactcagaggggaatgatttatgatgaaggtcaaatagattctcttttctattgcttaaagttgtgctacactgatctagtttatgtttgggttatgcgtttcctatatatattttttgttttctctggaggttctgaatcttgatcatagcctaaatttggtctctctttcaatcataataactattttgtgaagtcttcttctttttttcccccatagagatatttcttctgaaaccgtatgtcgtcctttcaattgtgtgttttgagacatctctggattaggcacaccattttatttatcctatgtctttctgtttctggcattttccctctttcttgccataaaacagcttttctctggggccatactccccagataatttcctcaaattatgttgtgaaaaaaagccctcattttatgacttggggttaagcgttgagctgttggcaaacagtaatagagaaagtgacagggagcacagcatttcacatataggaattcaagtgatcacctcagttttcagacccactgctcatttctgccttgtatcatacttgcctactccaagccagagattctttggattctagtgggcagagtgactctgacatcctctgcagactcctcatatcatattctaaactgtagctttctcttcttgttttcatctgtcaacacccttctgttagctttccttcttcagaaggctctcagctactgttggctccccttaacaatcttgttatggttgtattcctttgctgtagtttctctatttctgtctctgtgaagtctggagaaagacttgattaaaagagctcggggtgccattttgaaaaggactgatacacccagtggacctcctagtcaagggaatggtctgagcaaagatagattagtagagttaaaaggattatggtaaatagttcacctgaaacagagaatgaatcaagtgaaagtaaacactttaggacttgctgattcaaagttgaacccacccttagacagaaaagattgcattgatatgtgaggaatcagggagcaaccttaagttcttaagcagccaagtgttattatacatagactttagcaggctgggcttagttatttaaaagcatgaagcttctgaaggccatttcctgggcaggtttctgtaaaaagtaaacagttgtttacttttacatttcaggtttaattttaagccttgaccttgagagtcatttgacctaagtaaatagatgaattatctgaagtatctgggaatttatttaactactttaaatggccacatacaaatataatgagaggaggcattattgtatagttgttaatagttttccttaccccctctactataattgttgtataaaatctaaagtttttagttccatgagtggtacacggtaagctttcaaaaattagtaattataagagtgttctcttgcattcagatagtttctttattttattttattttattattattatactttaaattttagggtacatgtgcacaatgtgcaagttagttacatatgtatacatgtgccatgctggtgtgctgcacccattaacttgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcaatagtttgctgagaatgatagtttccagcatcatcgatgtccctgcaaaggacatgaactcatctttcttatggtgtcatagtattccatggtgtatatgtgccacattttcttaatccagtctatcattgttggacatttgggttggttccaagtctttgctcttgtgaagagtgccacaataaacatacgtgtgcatgtgtctttatagcagcatgatttatagtcctttgggtatatacccagtaatgggatggctgggtcaaatggtatttgtagttctagatccctgaggaatcgccacactgacttccacaatggttgaactagtttacagtcccaccaacagtgtaaaattgttcctatttctccacatcctctccagcacctgttgtttcctgactttttaatgatcgccattctaactggtgtgagatggtatctcattgtggttttgatttgcatttctctgatggccagtgttttggctgcataaatgtcttcttttgagaagtgtctgttcatgtcctttgcccactttttgatggggttgtttgtttttttcttgtaaatttgagttccttgtagattctggatattagccttttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacgtgaaacacccatgcctatgtcctgaatggtaatgcctaggttttgtatatatatgtatgtgtatatatatacacacatatgtgtgtgtgtgtatgtgtatatatatacacacatatgtgtgtgtgtgtgtgtgtgtatatatactacattttctttatccattcatctattgatggacactgaggttgattgcatatctttgctattgtaaatagtgctgcaataaacatacaagtgaaggtatcttttttatatattggcttcatttgggtagatattcagtagtggatggctggatgcaatggtagttctatttttagtcctttgggaaatctccatacagttttccatagaggctgtactaatttatatttctaccaacagaatataagagttttcttttctccacatcctcgccaacatctgttattttttgtccttttaataatagccattctatacatcagtgaactgtgtgggaaaaaaaataatagctattctgttctttttgctcaggattgctttgactatttgggctgttttttggttctgtatgaattttaggattgttttttctaatcctgtaaaaatgatattagtattttgataaggattgcattgaatttgtagattgctttgggcagtatgttcattttaacaatactaattattttgatccatgagcatgggatgtttttccatttgtttgtgtcatctacaatttcttatctgtgaattctagtgttccttgtagagatcttttacctccttgtttaaatttatttctacatatctttttgtagctattgtaaataagatttacttcttgatttctttcttagatagatcattattggtgtataagaacaccactgatttttgtacactgactctgtatcctgaaattttactgaattcatttatcaaatctaagagtttttgtatggagtctttagggttttctaaatataagatcatatcatcagcaaacagggataatttgactttctcttttccaatttggatgccttacatttcttcgtcttgcctgactgctctggctaggacttctggtactatgctgaataggaatggcgaaagtgggcatccttgtcttgttccagttcttagagaaaatgctttcaactttttcccattcagtatgatgttaactgtaggtttctcgtatatggtctttcttattttcagggagattccttctatgcccactttgttgagagtttgtatcatgatgggatactgcattttctcaaatactttttctgcatctatggagatgaacatatgtttctttcccttgattctgcttatgtaatgtatcaggttttattgattggccatgttgaactatccttgcatcacgatataaaacccacctgatcatagtgatatatatatatatatatatatatatatatatatatacacacacacacatatatgcatatatatacagttgttatactttaagttctagggtacatgtgcacaacgtgcaggtttgttacatatgtatgcatgtgccatgttggtgtgctgcaccgattaactcatcattcacattaggtatatctcccagtgctatccatcccccctccccccaccccataacaggccccagtgtgtgatgttccccaccctgtgtccaagtgttctcgttgttcaattcccacctatgagtgagaacatgcggtctttggttttctgtccttgcgatagtttgctcagaatgatggttaccagcttcatccatgtccctacaaaggacatcaacccatccttttttatggctgcatactattccatggggtatatgtgccacattttcttaatccagtctatcattgttggacatttgggttggtttcaagtctttgctattgtgaatagtgccacaataaacatacgtgtgcatgtgtctttatagaagcatgatttatgatcctttgggtatatacccagtaatggggtcactgggtcaaatggtatttctagttctagatccttgaggaatcgccacactgtcttcgacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgtctgttggctgcataaatgtcttcttttgagaagtgtctgttcatatccttcgcccattttttgatggggttgtttgattttttcttgtaaatttgtttaagttctttatcgattctggatattagccctttgtcagatgggtagattgaaaaaattttctcccattctgtaggttgcctgttcactctgatggtagtttcttctgctgtgcggaagctctttagtttaattagatcccatttgtcaatttaggcttttgttgccattgcttttggtttttaactcatgaagtccttgcctgtgcctatgtcctgaatggtactgcctaggttttcttctagggctcttatggttttaggtctgacatttaaatctttaatccattcttgaattaatttttgtataaggtgtaaggaagggattcagttttaactttctacatatggctagcaagttttcccagcaccatttattaaataaggaatcctttcctcctttcttgtttttgtcaggtttgtcaaagatcagatggttgtagatgtgtgtggtattatttctgagggctctgttctgtttcattggttgatatccctgttttggtaccagtaccatgctgttttggttactgtagccttgtaatatagtttgaagtcaggtagcatgatgcctccagctttgttcttttggcttaggattgtcttggcgatgcgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttgtttgtgtcctcttttatttcattgagcagtggtttgtagttctccttgaagagatccttcacatcccttgtaagttggattcctaggtattttattctctttgaagcaattgtgaatgggagttcactcatgatttggctctctgtttgtctgttattggtgtataggaatgcttgtgatttttgcacattgattttgtatcctgagactttgctgaagttgcttatcagcttaaggagattttgggctgagacaatggggttttctagatatacaatcatgtcatctgcaaacagagacaatttgacttcctcttttcctaattgaataccctttatttccttctcttgcctgattgccctggccagaacttccaacactatgttgaataggagtggtgagagagggtatccctgtcttgtgctcgttttcaaagggaatgcttccggttttcgcccattcagtatgatattggctgtaggtttctcataaatagctattattattttgagatatgtcccatcaacacctagtttattgagagtttttagcatgaagggctgttgaattttgtgaaaggccttttctgcatctattgagataataatgtggtttttgtctttggttctgtttatatgatggattacatttattgatttgtgtatgttgaaccagccttgaatcccagggatgaagccaacttcatcacggtggataagctttttgatgtgctgctggatttgtttcacccttattttattgaggatctttgcattgatgttcatcagggatattggcctaaaattctctttgtttgttgtgtctcttccaggctttggtatcaggatgatgctggcctcataaaatgagttagggaggattccctctttttctattgattggaatagtttcagaaggaatggtaccagctcctcctcatacctctggtagaattcggctgtgaatctgcctggtcctggactttttttgtttggtaggctcttaattattgcctcaatttcagagcctgttattggtctattcagggattcaacttcttcctggtttagtcttgggaaggtgtatgtgtccaggaatttatccatttctttgagattttctagtttttttgtgtagaagtgtttatagtattctctgatggtagtttgtatttctgtggtatcaatgatgatatcccctttatcattttttatgcatctatttgattcttctctcttttcttctttatttgtcttgatagcggtctatcaattttgttgatcctttcaaaaaaccagctcctggattcattgattgttttgcagggttttttgtgtctctatttccttcagttctgctctgatcttagttatttcttgctttctgctagcgtttgaatgtgtttgctcttgcttctctagttcttttaattgtgatgttagggtgtcaattttaggtctttcctgctttctctcgtgggcttttattgctgtaaatttcccttacacactgctttgaatgtgtcccagagattctagtatgttgtgtctttgttctcattggtttcacaggacatctttatttctgccttcattttgtcatgtacccagtagtcattcaggagcaggttgttcagtttccatgtagctgagcagttttgagtgagtgtcttgatcctgagttccagtttgattgcactgtggtctgagagacagtttgttataatttctgttcttttacatctgctgaggagtgctttacttccaactatgttgtcaattttgtaataagtgcgatgtggtgctgagaagaatgtatattctgttggtttggggtggagagctctgtagatgtctattaggtccacttgatgcagagctgagttcaattcctggatatccttgttaactttctgtctcgttgatctgtctaatgttgacagtggggtgtttaagtctcccattattattgtgtgggagtctaagtctctttgtaggtctctaaggacttgctttattaatctgtggcctcctgtatttggtgcatgtatatttaggatagttagctcttcttgttgaattgatccctttaccattatacaatggccttctttgtctcttttgatcttttttcatttaaagtctgttttattagagactaggattgcaacccctgcctttttttgttttccatttgcttggtagatcttcctccatccctttattttgagcctatgtgtgtctctgcacaagagatgggtttcctgaatacagcacactgatgggtcttgactctttacccaatttgccagtctgtgtcttgtaattggagtattcagaccatttacatttaaggttaatattgttatgtgtgaatttgatcctgccattatgatgttagctagttattttgctcattagttgatgcagtttcttcctagcatcgatggtctttacaattggcatggttttgcagtggctggtaccggttgttcctttccatgtttagtgcttccttcaggagctcttttagggcaggcctgctggtgacaaaatctctcagcatttgcttgtctgtaaaatattttatttctccttcacttatgaagcttagtttggctggatatgaaattctggattgaaaattcttttctttaagaatgttgaatattggtccccactctcttctggcttgtagagtttctgctgagagatccactgtttgtctgatgggcttccctttgtgggtaacctgatctttctctctggctgcccttaacattttttccttcatttcaattttggtgaatctgacaattatatgtcttgtagttgctcttgttgagtagtatctttgtggtgttctctgtatttcctgaatttgaatgttggcctgccttgctaggttgtggaagttctcctggataatatcctgaggagtgttttccaacttggttccattctccccgtcactttcaggtacaccaatcagacgtagatgtggtcttttcacatagtcccctatttcttggaggctttgttcatttcttttcactcttttttctctaaacttctcttctcgcttcgtttaattcatttgatcttcaatcgctgataccctttcttccacttgattgaatcggctactgaagcttgtgcattcgtcacgtagttctcgtgccatggttttcagctctatcaggtcatttaaggtcttctctatgctgcttattctagttggccatttgtctaatcttttttcaaggtttttagctactttgtgatgggtttgaacatcctcctttagcttggagaagtttgttattcctgatcatctgaagcctttttctctcaattcatcaaagtcattctccatccagctttgttccgttgctggcaaggagctgcattcctttggaggaaaagaggtgctctgatttttagaattttcagcttttctgctctggtttcttcccatctttgtggttttatctacctttggtctttgatgatggtgacgtacagatggggttttggtgtggatgtcctttctgtttgttagttttccttctaacagtcaggaccctcaggtgcaggtctgttggactttgctggaggtccactccagaccctgtttgcctgagtatcaacagtggaggctacagagcagcaaatatggcagaacggcaaatgttgctgcctgatccttcttctggaagcttcatctcagagggtcacccagctgtatgaggtttcagtcagaccctcctgggaggtgtctcccagttaggctactcgcgggtcatggacccacttgaggaggcagtctgtccattctcagatctcaaactctgtgctgggagaaccactactctcttcaaagctgtcagacagggacatttaagtctgcagaagtttctgctgccttttgttcagctatgccctgcccccagaggtggagtctacagaggcaggcaggcctccttgagctgcagtgggcttcacccagttcaagtttcctagccactttgtttacctattcaagcctcagcaatggcagatgtccctccctgagcctcactgtcaccttgcagttccatctcaaactgtgtgctagcaatgagcgaggctccatgggcatgggaccctgtgagccatgtgcgggatataatctcctggtgtgccgtttgctaagaccattggaaaagcacagtatttgggtgggcgtgtcctgattttccaggtaccgtctgtcacggctttccttggctaagaaagtgaattccccaagcccttgcacttcctgggttaggcgatgccccgccctgcttcagctcacactccatgggctgcacccactgtccaacaagccccagtgagacgaacctggtacctcagttggaaatgcagaaatcacccatcttctgcgtcactcatgctgggagctgtagactggagctgttcctatttggccatcttggaacccttaatccagtgtaatatatttttgatgtgctgttgggttcagtttgctagaattttgttcaggatttttgcatctctgttcatcagggataatgatctgttttcttttatatgtgtcacctctggtttaggtatcagaataatactggcctcaaagaatgagttagggagaattccttcctcctcaattttttgtaaaagtttcaggaggattagaattagtgctttgtatatttggtacaatgcagctgtgaatccatctggtcctgggcttttcttttgggggagtttttttattactaattcaatattgctactaattattggtctgtttaggttttctattctttcctgcttcaatcttggcaggtggtatgtttccaggaatttctccatttcttctaggttttctagtgtgtgagtatatcaatatttataatcgtctctgatgatcatttgtatttctgtagttatcagttgtaatctcttcattctaatttctgattttacatgagtcttccatcttcttggttggtctagctagcagtttatcaattttgtttatcttttcaaaaaaccaaccttttgttttgttgatcttttgtattttttttagtctctaattcatttaattctactctgatttttgttatttcttttttcctgctaatttggggttttgtttgtttttacttttctagttccttgaagtgttattagattataaatttgtaatacttctacttttatgatgtaggtatttaatgccataaacttccctctcagcactgctttttctgtatctcacagattttggtatgttgtgttttaattttcatttgtttcaaaaaaatttttatttcaataataatttcttcattgacccagtggtcattcaggagcataatgtttaatttccatgtgtctgtatactttccaaagttcctcttggtattgatttctagttctattccactatggtctgagaagatacttgatatgatttcaattttttttaatttgttgtgactgttttgcagcctaatatatggtctatcttggagaacattccattgctaatgtaaagagtgtgtattctccagttgttgggtagagtgttctgtaaatgtctgtcaggtccatttggcctaaagttcaacttttctttattgattctctatctcaataatctgtgtaatgccaggagtagggtgttgaagtcccctaatattaccatattgctgtctctctctctttagatctagtcatatttgttttatgaatacgggtgctccaggattggatgcatgtatttagaattgttctattctcttcctgaattgatccctctatcattatataatgatcttgtcttttttatggtttttgacttaaattctgttttatctgatgcaagtactcctgcttgctttggcttctgttttgtggaatatctccccaccccatccctatttttagtctatatgtgtcttttcaggtaagtttcttataagcagcatatgcttagatcttttttaaattaattcagccagtctacatatttaagtggagcaggtagtccatttatgttcaaagttattattgatatgtaagggattttttctgtcatattgttaattgttttctagtttttaaaaaaattctttgtacccttctttttctcttattgtttatcattgtggtttggtgtaattctgtagtggttccatttgatttctttctcttcctcctttgtgagcttgctctaccaatgacttacacttttaatgtttttcatgatggtaaatgtccttttcctttcaagtttagtactctcttttttgtgtgagacaggctgtggctctgttgtccagactggagtgcagtggcctgatcacaactcactacagcctctacctcccaggctcaagtgatcctcccacctcagcctcccaagtagctaggaccagaggcatgcaccatgacacccagctaacttgtgtgtgtgtgtgtgtgtgtgtgtgtgtgtgtgtgtgtgtgtgtgtgtagagccagagtctcactatgttgcccaggctggtcttgaaatcctggactcaagtgatgctactgcttaggcttcccaaagtgctgggatcatagattggagccaccatgctcagcctaagttcaggattcccttgggaatttcttgtaggtctggtctggtggtgatgaattctcttagcatctgcttgtctggaaagtgtttatttctccttcatttatgagggttaatcttgctggatatagaattattggctgatagttgatttctttcagcactttgaatatatcatgcaattcttttctggcttgtaaagtttctgctgagaagtccactgatagtttgatggagtttctgttgtgactaggggcttttctcttgctgttttagaatgtgcctttcactttggctttagacagtctgattataatgtgccatagcaaagtcctttttgcattgtatttatttggggatcactgagcttcctgtatctggatatctaaatctcctgttatacttgagaagttttcatctattatttcattaaatgggctttctaaaccttttgatccctttttgcccttatgaacaccaataatttgtaaattcagttactttatgttgtgccaaacttctcaaaggctttgttcattccttttcatattttttatatatttttgtctgactggattatttttaaagatttgtcttccagttctcaaattcttttttctacgtagtctagtctattgtggaagcttttgaatacattttctatttccatcaataaattcttcagttccagaatttctgtttcttatttaatatctgtctccttgatttctcattcatattctgaattgttttcctgatttctttacattggtttcagatgtctcttgcatctcaccgagcttccttaaaatcagtattttgaattcttcatctgggattctgataatttcttttttgttaagatctatcttattattaattattaataattaagaattattgtgttcctttaggtttaggtttcctgaatctttacattgatatctccacatctggtgtaaccgttgtttctatttttgaatttactttttttcatggagggtgcttcttcctgaagctgtgtctctggtattgcttgggtggggccctttggctttgcttgtgtgtgtgtgcagtagtgaagtatgacttctttggctataaaccttagtggtatctgcggtttccttgatacattaggtaaagttattagtggagactgtattgaatttatgggggggggactggattggcagatggacctgtcgtcaggctttagtggtagtagtggtgggctaagcattaaagtatgcatgggtttgattagtgctgtgctccacctttgtaggcatcctggcttctctgagtagtatacaaaaagttgagccttaatctttccctgaacactcttgaaattttaagttaattatccacttataagttaaggaaccattatattcattttattttactaggaatctaaaaatgtgttagatttttagaaatctaacacatttttagatatctaaatctaatgagaaaactattttatactaatatcatttttaaacgtttcaagaagaaagaatctatacactttaagaattaaaagcaaatctctttactttttttcctgtctgtctcccactaaaatgttagtcagctcagtgagggcaagccttatctatctagttgacttttgcgagcccagcatatataacagagcctggcccacaaaaaggtttcaataaataattatttttaaaagagagaaagaaatgtaaggctctggggaaagacagatagtatacagataatacttatctgtattcatatgagggagattcactttcccctacttaataatggaaaatgaaagaactttggaaacactatttggaaacgctatttgattgctttttcctatgtgcctccacagcctttgttcataccattacagtgtcatttatcagacattattacagctatttgcatatctatttttcccaatatactctgggtgcccaggacatatcttatttatttttatatacccagggcccaaaatagtaccaaatataggcactaaatatttaaccaaaataggtaaacagtagacattcaataaatgtttgcaaattaataggaaaaaggcataggaaaatagtataaatagtttcttttgtgatcctcttctttctctcctaacaacacccactgttatactgactaatcacttcctttccataatctttctctctcattataaactcttatttctgattagaacaaatgctgagccaggcttattttatattccactattttttcctgttctttttatattcatcaaagcattaatgaaaaaacaagagaatgccttttctattgcaattaaaatctataattccatgtgaaaagtttttagtagttgaaagcaaaagctaaaacctggataactgagaaccttaccctctgtggggatctcatagtactactaagccacctttcaagtaaatttcaaccaagtttgctctacaactctaaatttgactgacaaatctttaagacttgttacacacagatcattagttatctttttccccaacaacaaaactaaataatatttttgcttactatttgtctctagaatttattctgaaagacaactcatgatgctaaaaaaatctcaaagtcaagttatcccagctaccataataatagatcatgtatcactatgctgactacactgtatacatttttctctatcttagaaaaaatattcctaaatgtttatgaatacaaaatatattaattatctgttacaatactctgttctttgcaatatcatgtataagcagcaagtatcatatactacattacatcacttttgcaaaactggttactcacataagccaaacaaagtactaaggctttactatcctaggggatcccaaagggacaggccatgtgtgtttgcataattcaaatgttttctgctttttaaaattaccattcaaatgtttcatttcagagaaaacatctcatcaagtacctatcttaaaaaagtctattgcatttctatacaccaccaccaccagaaatggaattgatctgagtcaagaaacatagccatgcatatatggaactttggcatttgacaaacgtgacataccaaaactgtttttcaaagtagttgtaccaatttacattcccacaagcaatgtttaaaagatcctattgcttcaaagtctttctaacatatggtattgtcagactttttaatttttgccagtttaattgcataaaatgatacctcatttgcatatctatctcactaatgaggacagacatctctttatattcttattgatgtcatgtgtatactcttctgtgaaattcttttcgggccattttccttttgttcattttgcttttctttttgatttgtgaaggttcgctatatgttcttgttacaaatcccttgttggatttataccaatatcttttctcagtgtatctttccattttcttttaaaaattttttgacagaacaaagttcttaattttgaagtagtaagatttgaattagtaaaatttaaactagttaactttgagctagtaaaatgtatgtcttttcatagctttttgtttcatgtttaacaaatcttgctctactcccaaagcgtaaaaaaaaactcttattttttaaagagtatttaaaattgtttttgacatttagatcctaagtctacctggagttgactttttgtctatagttatgagaagccaagtggtagagagactgaacaacaaagaagtcaaaagaatgttgcagctgattagaggaactgggcaaataattttaagccttttctcagcaagttaggaaggtaaaattggagttctgggcctacctaggaagaaatgtctagccaacattccacattttaaatggtactttaccaaactttaaaaattaattctataattttaatacacaatatccagcatccaataaaaaattatccaacataccaaagacaatattggatacttaagaaaccaaaaggaaaaatagacaataggaacaaacctacaagagagccatattacacaaattagatatggatattaagtataaatgagatgatcaagaaaaattatatcatgatgaaaatttcagcaggaaattataatttgtaaaaacatattaagtggaaattcttgaaccaagtaatataataaagattgaaacagttggattcaatgtcacatagacatagctaaacacaggattattaaccataatatgttaatagaaaatgtccagatagaagcatgaagagaaaaacaaatgtacaaaatacagaaaagagcataagagacctatgagacatgatgaaaaaatattaaatgcataatcataatttgaaaagacatgtaagagaagaagaaaagggatatctgaagagaaaatgatcaagaattctccaaaataaatgaaagacatcaaaccatagacttccaagtgctataaacccctagcaggataaataccaagaaaaccacatgaaggcatattataataatattactgacagcaacaggagacaaattcctctgcagacagggatgggtccccagtgaaacccaaccttcaagcaaaggaaagtctaaaacctgaaaatcgaactgccagttcagcattagagtccacgactggagtgagaactttcatccctatcttaccccctctctctcaactggttccttctgaatgatgtcttttaaccaattgaatggtgctttttccaagaccactcaaggacctatcagcatgcagtcccccattctaagcccataaaaaccccagactcagcctcacagccttacccactttcaggacccctctcattgctgagagttttctttctgtcactcaataaaattttactttgtcttactcaatctccaatgtccatgtaccttattcctcttggtctcaggacaagaatttgctgaactgctggagcaaaatagctgtaacattcctcctcaccaagctgggggcagcaggagtaaaattgctgtaacattccctcccactcaccaaacaaagggagagaagaagctgctggacaccactctcttccactcgccgaactatgggagcaaaaaagccacaatatttctaaaaacaaaagattttaaaaatggtttaaacaagtcagagaaaaaaggcacagtaccttcaaggaagttgcaaaatgacttatagttaatttgtcagtagcaacaatggaatccagaggcaaaagaataacctctccaacttgctttaaaaaagaaaaaaagaactgatttccaacttaaaattatttactcagaggaaaaaataaactcaaaacagaaagtggcagtttccactgctagcaataataagatagaatacatatgactaatcctctcacaaataacagacaaaatatataaaccaactactttttttaactttctccttccaacatttattttaggttcgggggtacatgtgcagatttgttacatcagtaaactgcatgtcactgggtttggggtacaaattatttcatcacccaggtagtaagcacagtacctggtaagtagttattcaatcctaacccttctcctaccctccacctttaagtaggccccaatgtctattattcccttctttgtgtccatatgtacccaatgtttagctcccaagtataagtgagaagatgtgatatttggttctctgttcctgtgttcattcactcaggataatggcctccagttgcatccatgttgctgcaaaggacatgacttcattcttttttatggctgcatagtagtctatggtgtatacatggtacattttctttatccaatccaccattgatgggcacctgggttgactccatgtcattgctattgtaaatagtgctgcagtgaacacatgagtgtatgtgtctttttggtagaatgatttattttcttttggatatatatgtaaattgctttaggcagtatggccattttaacaatattgattcttctgatccatgagcatggaatgtttttccatttatttgtgtcatgtctgatttctttcagcagcattttctagttctccttgtaaagacctttcacctccctgattagctgtattcctaggtattttgtactttttgtggctattgtgaatggattgtattcttgatttggctctttgcttggatgttattgctgtatagaaatgctggtgatttttgtatgttgattttgtatcctgaaagtttgctaaagttgtttatcaggtctaggagcctctgggcagagacgatgaggttttctaagtataggcttaaatcgtctgcaaagaaagataggttgaattcctctcttcctacttggatacatttttttttctttctcttgactgattgttctggctaggacttccagtactatgttgaataggagtgatgagggtgggcatccttgtcttgcaccagttctcaaggagaatgcttccagcttttgcctattcatatgctgttgactgtgactttgtcatagatggcttttattattttgaggtatgtacctttgatgcctagtttgttgagggtttttaaactgaaaggatgttgaattttattgaaagccttttctgtatctattgagatgatcgtgtgttgtcttttagttctgtttttgtgattaatcacatttattgacttgtatatgttgaacggaacttgcatcccagggataaggcctatttgattgtcatgaattagctttttgatgtgctgctggattcagtttgcttgtactttattgaggctttttgcatctatgttcatgaggtatattggcctgaagttttcttttatcattgtgtctctgccaggttttggtgtcagagtgttgctgacctcgtagaatcagggaggaatccctcctcctcgattttttgaacagtttcagaatgatgggtaccagctcttctttatatgtctggtagaatttagttgtgaattcatctgttccagggctttttctgattagcagggatttttttattactgattcaatttcagaactcattactgatctgttcagggtttcaatttattcctggttcattcttgggagcttgtatgtttctggaaatttatcagtttcttctaggttttctagtttatgtgcatagaggtgttcataatagtctctgagggttttttatgtttctgtgaggttgatggtaatgtccccatttttatttctgattgtgtttatttggatcatctctatttttttttcataatctaggtagtagtctatcaatcttatttgttctttcaaaaaacaaactttaggtttcattgattttttattttttaaaaaaattatttccatgagttttggaggaacaggtggcatttggttacatgagtaagttctttagtggtgatctgtgatattttggtgcacccatcactcgagcagtatacactgtacccagtttgtagttttttatccctcaccccacctcccaccctttccaatgagtccccataatctattgtatcattcttatgcctttgcatcatcatagctcagctcccacttgtgagtgagaacacacaatgcttggttttccattcctgagttacttcccttagaataatagtctccagctccatccaagttgctgtgaatgtcattaatttgttccttttatgtctgagtagaattttatcatgcatatacacaccaaaatgtgttttacgtctcaattttattcagttcagctctgattttggttatttcttttcttccattaactttgaggttgtttttctcttgcttttctagttcctctagctaaaatttagactgtcaatttgagagccttctgcctttttgatgtgggcatttggtgctataaactttcctcttaacactgctttagctgtgtcccagagattctggtacattgtatctttgttttcatttattccaaagtatttcttgatttctcccttaattttattgtttacccaaaagtcattcaggagcacattgtttaattttcatgtcattgtatggttttgagagaccatcttggtatttatttctatttttattgcactgaggacctggaatgtggttggtatgatttcagtttctttgaatttgttgagaattgctttatagctgagcatttggttgattttagagtatgtgccatgtgcagatgagaagaatgtatattctgtggttgggtggagtcttctgtagatgtgttaggtctattcagtcaagtgttgagtttaggttttgaatatctttgttagttttctgcctccatggtctgtctaattctgtcagtagggtgttgaagtctcccactattatagtgtggttatctatctttataggtctgtaagaacttgttttatcaatctggatgctctagtgttgagtacatacatttttagaatagttaagtcttcttgttgaattgaaccctttaacattatgaaatgcccttctttgtcttttgtcatcattgctggtttgaagtctgacttgtctgaaataaaaaatatcaacctcagctcttttttgttttccatttgcttggtaaatctttctccatccctttattttgaacatatgggtgtcactgtaggtgagatgggtctcttgaagacagcatgcagttggatcttgcttctttatccaacttacttctctatgccttttaagtggggcatttaacccatttacatttatggttaacattgatatgtgcagatttgatcctgccatctatgttgttagctggtgtttatgtagacttgattatgtagttgctttatagtgcattggatctatgtacttaagtgttttgtggtggctggtaatagtcttttgtttccatgtttagcactcccttaacccatttatacctgaggttgcaatttttttaatttttacaatcagaccttggtgatgaccttgagtagtaggatataaataattcccatatgcttattgttccaatgatggaacactaggtgtaaatgggttttaaggacctcttgaaagacaggtctagtggtaacaaattcccttagcatttgcttttctaaaaagggttttatttctcctttgcttatgaagcttagtttgactgaatatgaacttcctggttggaatttcttttcttcaaggattaagcatgctgaatataggcctgtagtctcttccagattctagggtttctgctgaaaggtccactattagcctgatgggattccctttgtagatgacctgccccttctctctagatgcctatagtactatttctttggcatttgccttggagaatgataattatgtgtcttggggatagtcatcttgtatagtatgtcacaggggtctctgaatttcctgtatctgaatgtcaacctctttacagagattggggaaatttttgtggacaatatcctcaaatatgttttccaaggcattctctctttccctctctttcagggatgccaatgagtcatagatttggtctctttacataatcccatatttctcagaggttttctccttttttgtctttttcctttatttttatctgactgagttgtttcaaagaaccatccttcaagctctgagattccttcctcagcttgatctattctgcttttaatacttccagttatattacaaaattcttttggtgagtctttcagctctatcagatcagtttggttctttcttaaaatggctattttatctttcagctcttgaatcatttgactggattccttagattccttggattgggtttcaactttctcccaaatcttgataatctttcttgccatccaaattctgaattctatgctgtctttcagccatttcagttgggttaaaaaccactgctggtgagctagtgcagtcatttggaagtaagaatacattgacttttagagtggccagagttcttacactggttctttctcatctgtgtgggttgatgttcccttaaatctttgagcttgttctcctttggatcgagctttttgcttttatattctttgatgcccttggtggtttgactgtggtataagttggatttggtcaactggcttcatttctggatgatttcagaaggtcaaggctcagctcatcacttctgtgctgcatgctctaaccctgtgggggctgggaccaagcccacagctttgttctctggccctgctacactggagagaccaagattttcctggtccactggcaacaatactctgatggagggtgctgacaaaagcccttcatcagggtggtgtcagtggggttcatgctcacatgtgtgcacctgcagcaacagggcagtggtagggcggtgggggctgtgcatgcacatgtgctccagtggcaccagggtggcagtggcaaggtttataggaagaggctgcaggtgaatgcacaccagcaaagtggtgggtggaagctgtgagagggtgcacactggtgagggcccatctgcaaaagttatctgacagttatattggatctaccagccaaagagttatggtggtggctacaggaaagtatatcagctgggcgtctgaggctgtactgcaagtggatgcagccagacagagaccttgggagaggctgggcagacagaggagcactcatcagactggctccaccctacagttagatagccctgttctgtctagatctgacagttaagaaaggccaaaaccacctagaggagtatggcaagccttgggggctgggcatccctggccatgtgccactgtgatcattcttgttccaaaccttctgggttccatgcaggctggattcctgtctttgccagctctccaaacagctctccttgtcagttcaaatgtctatggggatcatggggtctcctgcacctaggattcttgaggtccctggtgagagcaggccactctatgcctatttaactcatcccttccctgggagcctctcagggccaggaatgagtcctggtgcttggcaaccccatgcagggttcccaacttcctccccccttcagcccaggatctgcattctccttccaaccactttcaatgccttccttccgaagtactgttcagaatgtgctgattttgacggtgtggtctcttggtgggagaagctcttcctgaaccctgtagtcagctatcttggctcctcccaaaacaactatttcaaggcacctgacaaggacagaaagaaaaaagaaactggagagaatttgactcttgaaatactagaaaccgtagtggttgagagttacatttatatggcatttcctgtaagtacactctccactgggacagcatagggcagttagaactcaagtagaaagctaccatcttactgatttaagatgtcacaggacagagtctgggaaaggacagaatgagcaaaaactgaaggtaaaaaaatctcataaaagagaaaactacagactggggagccctaaaggtacacatgaatttttctaaaattggggagatgctgaagaacccaatagaaaccaatactcataaggaaaaaaaataaaaataaaaatctgtgctgtgatttcaattgctgcccatttcatttcaggaacaacagagtttaaagtttgaatcctgcaagttagatgggttttgtaaacacatcaaactgtccactgaaactccaccaaggccacactatagaataaaagactatgtcccaggactaagaattctctgtaagaataaaaaccgaatcaacctgttaaaaaggctacacaaactcctggttattcatcagtaatttaaccacctgctgaagtaaaactcaacactcttccaaggaaaataaaagaatccgaaacatctctttctttttccatctctaccatttcacccaaacaagaatccaaaatacttatagtctattttctatgctgtcaagtatataaccaaaacttactatcatatgaagaaacaggaaaatgtcacccatagtaaaagaaaaatcagtcaacagaaacaaaacccagttgtagtcagcaaataaagggtgtaatgcaactatcataaatagattttaaaagaggctagtcctaatggatgaatagataggacatttcaggaatggaaactattttcaaaaaacaaatgaaaattcaggaactaaagtaaaaaaaaagttcactggatggattttaaaatagactggagagggcagaaagaattattgtgatatatttaaattaaatgttataaagtaccatttaaaatatcagaagatatgaaatacttggggacaaatttaataaaatatgtgcaagatttgtatccacaataaatgtagagatatataccatgtttttaatcagaagactcatcactgttaaaatgtcagttcagcacaaattgatccatagatctaatctagtcctaaccaaaatctcagtggacttttttgtaaaaattaacaagctaattctaaaatttctatgaggttcaaggcacctagaataacctaataaaaataatttgtatttcaattactatgaggtacagtaattaggactattgtggcattggtgtaagaatagatatataaatcaaagattcatattcatgtaagagcacctaagtagacccatacatatatggtcaactggttttcaacaaaggtgaaagagtaattcaaaagaaaaaaacagtttattcaataagtggtactggaaaaactaaacatctaaatgcttataaatggtactggagcaattaaatttctgtatttcaaaaaaaatatgacctctaattcacacaattcataaaaatttattcccaggtagattataaaacaataaagcttccagatagtaacgtaagaaaatatcttcttgactttgaagtagttatgttaacaaagtttttttttaacagaacataaaagtctctacccataaaggaacaaaataataatttggaatttatttaaattaagaacttctgaatattaaaaaatggttaatattatgaaagggagaagatatttgtaatacctacaactaacaaaaggactcatatctagaacatataaaaagttatcacagaaatacaaattaaaactacaatataataccactacatacatttgaattaaaaacactgacacttgccaacaccaagttcaccaagttcacaagaatgtggagcagttggagctcgtattagaaaattcactttggaaagctgtttggtaatatctactaaagctgggcatatgtataccttatgacccagaaatttcattcctaggtattagtccaaaagaaagtctacattaatgcactgaaagtaatacacaaatgtgtatataatagcaatgctcattaaagaaaaaaccagaaataattcaaatgttcatcagcaatagaacagatagataaattatggtttattatcaatgaatgaatgaactactacatggtgagctctcacagacatacaacattaagcaaaagaaatcagacacaaaatacaacatactgtatagtctcagtatttgaagttcaaaaagaggcaaaactcacctatggtgttagaagtcaggatagtgacagagtagtagctggtagcggggacaaggggccctcttagggttctaataatattctatttcttgacgtgggtggaggttacatgagtgtgttcactatgtggatatgtattgttgttagagataatgtgtgcacttttctgtatatatgttattcttcaataaaccatttaaaacattaaaaataaccacttgtgtggcttagaacagttgtccccaaccattttggcaccagaaaccggtttcatggaatataatttttccacagatggtggatggggggaatggggatggtttcaggatgaaaccattccacttcaaatcatcaggcgttagagtctcataaagagcacacaaactaggtccttcacatgcgctgttcacaatagggctcacactcctatgagaatctaatgccgcagctgatctgtcaggaggtggagcttaggcagtaatgctcacttgcctgccactcacctcctgctgtacggcctggttcccaataggccatggaccagtaccggtccacgacccagggttggggacccctggcttagaagcaatgtctagagattttagggtaatagaaactatataaaggtagtatatatgctacaggcaaaacatgtaatctagacattataaacaactcttacctaattcctgggtaactgctatacgaatattctaaaactatttaaagaaaatgtcaaatttaatactttgtcattgtattggtagtgtaggagtaagccataagatcatgagtaactataagtattacttacaatgtgaaccacctctgctgaatctctacacttctacccacatactacacatactacctttcctttcaccgtctctcctttatactacccctgtttcacctttcatgggcaggttctttaggtaaccaaaatacccacattatttatcacttcaagtctgtaaataaagccacggatagcaataaaacagaatcttgtagtaaggctacataaattatagtatgtctttattggaaggaaaagttttctaaattggtctcaaaattcttaaaaataagtcaataaatatataataaagctatctgtactctcaatatattttcacttttccaaatactttaaccttattagttgttcttcattagtccttcaccttatgccactggacaaatacctttaaaaaaaaaaaaactcaaagcaggaaactacttaaaatatgtttcaagtattttgtagagtttattggatcagaatccattcttcttatacttcaaccccaccactgagcttaaaattccttccaagcttttgggaacagtgctttcactgtcactatccctactatccataggataatcattggctgttccccaaattccagaacgatgtgccattgcattgctttcctcccacactgaagttgctggcggtagctcattttggcagtttgtcaaataaatcacacagtaaagcatttggtgatctttaaccaaatgaatctgttgtgtatacagcatatgacatgtagaggtatttcacacattataatagaacacagtgaaggatataccctgtacagcataatcctagaatcaagacttctctttgagaacttctctttaaaataacatcttttttttgaactaaaaagattaacttacttaaaaacaaagggaaataccatctcatggcaattattgttcccttctgagaatgactgatgacgtacatacttattaccagacagtttatggaaactatgttgtcaaatagatcacattttcctacagaaacaatgtcaggatagggctcatatcccttaccaaagaatcaacagagaaactataattatgagagttaattttccgtaaaagcaaagataagactattacaaaattttataatataaagtgacaaaaggatgcttcaactttttaatttatttaacaaacgtttaacaggtgtctgtgatgtgtcaggcattggtaatcaaataacacttggtacctgccacgctcaataaattaactaacagtcatgatttactaaacaagtacatcaatgtttactgtatggggtggttagtgtcatgaacgagaggtgctcagtctgtaaggacacagaagacagtcatctaaatcagcatacggggtcagtaaacacttcctggaaaagatgacctgggctcagctttgctacatgagcaaaaactggctgaattagaaaagcaatccaagtgacgggaataaggtcatgttttgcataacaacattttggtcaacaacagatgcgtacatgacggtggtcccataggaatatagtagagtcgaaaaactcctattgcctagtgacctcatagccatagtaacattgtagtgcaacgcctgtgggttttggtaacacttccagaagaaggcattgttatcacaggagatgaaaattcccatgcgtgttattgcccctgaagacctttcagtgggacaagatatgaaagtggaaggcagtgatattgatagccctgattctgtgtaggcctaggctaatgtgtgtatttgtgtcttagattttagtaaaaaaaactttaaaccgtaaaaaaaaaaataattaaaaatgtaaaaaagaaaaaaacttatagaataaggacataaaaaagaaaatattgtgcagctgtacaatgtgttttaatctaagtattactacaaaagagtcaaaaagttaaaaattttttaagtttataaagttaaaaagttgcagtaagctacggttaacttattattgaagaaggaaaaatatttttaaataaatttagggtagcctaagtgtacagtatttataaagtctacagtgatatacagtaatgtcctaggcattcatgattccctgactcactgagagcaacttccagtcctgcaagttccattcatggtatgtgccctacataggtgtaccattttttaattttttataccatatttttactgtgtcttttctatgtttagatatacaaatacttaccgctatgttatattaataattgctggcagcattcagtatagtaacatgctgtacgagtttgtagcctaggatgcctaggtgtgttgtagactatgccatctaagtttgtgtaagtacactctatgatgttcacacaatgacaaaatggcatatggatgcacttctcagaacatgtccccattgttaagtaaggtatgactgtagctgataacacatgcacagaggcataaagcaacacggaacattcaagaaactgcgagttcctgtttggaggaacatatgagggaggtgcatcacaggaaagaggtgcaagataatggtagaagccaaatcatgaaatgctttgggaggtaggtttaaaagtttgaactttattgaaaaagatagtccccctgatcctccaacagctactaaaaatgattttaagcagagaagtaaaatgagcatattttcatttttaaaagatctatttgattttactatggaggaaggctaatgcaataatcctgaattcatgaagcaatgttaggaatagagtagaaggaacagatctgagagacaacaaggagaaaaaattcattgaacctgactgataaaagaatctgtacaccaaacccccatgacgccaatatgacaaacctgcatatgtaccctgaacctaaaataaaagttttagaaaagtttttaaaagttcattgaacttagacattaattggaagagagggtggaatgaaaggaagagtctaaactggcttggtgactaagatgatgatcaagaacaaggacaaagagagggtctcagttggtagggagcagggaaaaacaacaaatatatttcaaattattttgcacattatgttttctatttattgtctgaagaatacctataaaatataaattgtatataacatacataacaaagtgtagccattttggaaaacagtatggaggttcctaaagaaattagaaatagaactaccattaagagccagcaatccctcttctgggtataacactgaagtaaaggaaatcaccacttcataaagatgcctgcactcccatattcactgtatcattattcacaatagtcaagatatgaaaacaacctaagcatccatcaacagatgaatcgataaagaaattggtctatatatacaaaggaaaaaaggagaacctgtcatttgccacaacatggatgaaagtgaagaacatcatgctaagtggaataagctagacatagaaagaaaactattgcaggatctcacttatatgtagaatctttgtttaagaaagtcatacagagacagagaataaaacagtatctaccaggggctgggggcaggagtgaggaaatgggtcagtgcaaatcaaaggatacaaagttgcagttatgaagaatgagctctagaaatctagtacacaacatgaagactatagttaataatgctgtattcaggatttttactaaaggagtagatttagatgctcttgctacacacacaaaaaaatgggtaactgtgagattatgaatatgtcaatttactttattacagcaaccattttactatttatatgtatttcataacatcatgttgtataccttaaatatacacagtaaaatttattttaaaaataaattcacataaatacaaaaatttttttttttgagacgaagtctcgctcttgtcccccaggctggagtacaatggtgtgatctcggctcactgcaacctctgcctcccaggttcaagcgattctcctgcttcagcctcccaagtttacaggcgcctgccaccacacccagctaatttttgtgtttttagtagagatggggtttcaccatgttggccaggctggtcttgaactcctgacctcaggcaatccacctgccttggcctcccaaagtgctgggattacaggcatgggccaccgcactcggccaaaaattttttttaaatcccctgtatcatacatgtgacataaagcttattgttactagtatattcattttaattatttaattagcaaaggcttcctgattttcttaaagttacgttgggggattgagggagaaaaatatttaaaaatcccaagtctcttttacaaagctgaacaagaaaatttaactttccttttcctcccaaaatagatacttgcagaaagctgatatatacgaaatcattccactaaccaaagaatattcagcaattattttaaactgtcctacagttgagacctatattcattagaaaattgctgtattatcataagtaaagatctcaaaaagatgaaatatatgcttttattatgtaatattaacaaagcagcaacttggctcattcacagtttatgcaaagcattttttgaaaagtttaggaagtctaaacctccagaaatttgcaaggttaaaaatgtacttctgagatggtcaggtctgaaacttctatttcccagctgttttcaaggaacttcataatttatttatgtatagacaaataaatcttcagcttcattagtcatttctcactatattctaagaccaaaaaagggtactcttctctttgtttattatggaaaagctatggcaaggcaggggaggaagaggaattgcctggggggaccgagcaactaaaaagaagagcctggagtgggactgagccttggagctgtctaatgagccactctgcctcccacagctagctcctcacagctctgcaaaagactaaaaaactggagccaacaaaaacaaaacactcacaaatctaatttgggtgactaacaccctaaagatatgcagtttgctcctgaccaggattggagtactcactttctttgcgaacttcctcaagtgaagccgtaagctcatcctttaaaactgtagcttcctgggcaatcttctctcccttgtctaataaattccaagttgcttcctccacagaagctagaaggacactggctcttttcgaacgtccttttttcctgctggaagggttctggggacagtttacaagtgtggtaacctaaaattggaaaaatacaaagtactaaattgacaaattgtaaggagaacacagtcctgggatattacagaccagaacaaaagacagtacagttgacacttgagcaactcaagggctaggggcgccaacccaccgtgcagttgaaaatctgagtataactttcaactcctcaaaaacataactacgaatagcctactgttgaccagaagcctgataacataaatagtcaattaacacagattttgtatctgtatgtactatataactatattcctacaataagatgagctagagagacgatagtgttatttgttattaagaaaatcataaggcagagaaaacataattaaataaatcaacaagtagaaatggatcatcataaaggtcttcatcctcatcatattcatattcctgaggaagatgaagaagaagaggagggttggtcttgctgccttgggggtgtaagaggcagaagagatggaggaggtggaagggaaggcaggagaggcaggcacacttgatgtaacttttattgaaaaaaaatctgattaaaagtgaacctgcatagttcaaaccagtgttgttcaaaggtcaactgtatttcatagtaacatgactcatttccagtgctgttggtacacctacaaaagtcaagtcatggcaccaagaacagcaacagcagccaccgtggagttcccaactaaaaataggaaggaagtgggagtcttagtgattgaatttcaaaatatagacattaaaatgtcctctcttcaactaccccagtcatcaaatcatttctatgttaaatatttactgaacacctattttttacattgttctggatgatggaaaagaaatgcatttcatgctttcatggagtttacattcttaatatcggcagcatacaataaacatataaacaaatttaaaaatgtaaggttcagtaaatgttttgaggaaaaataaagttggcggagggaatacagtgagagagagtggggatcggggtggtcaggaaaggcctcttgacaggggactttgagtgagacctgtttgagaggccaaatgagttaggggaaagggtagaagacagatctgaaaggttacaaagggcaagaaagtaggtcatagtaaggatttggactttgtcccctgaagcaaccactgttctatatgattcagaatgtttctccctctcctaatattagttatctctattctcagcctaaatagactaatactgacttaattataattatttttggctccctcttaatgtagattgctggcttaaaagtggtataaattttattttataattatttgatattttggagatacataattttctactctcatttttgactgttttatcaaagttctgtattttttatatgaagtttctgtaattaaaacaatacacacatacacagccttctagagcattcttcgagtagcaaaacttgaacaaactcctcaccacaagtatatgaagtgagaaatgtgttaattagcttgatttaatcattttacaatgtatacatatatcaaaacatcacagggtacaccataaatatatataaattttattcgccaattttaatttaataaagcttggggaaaaaaagaaagaaatgaatcttaacaaatacaagaacaaactcataataagaacattatttgaagataaaaattaagcttctgtatttggaaacaaaaacatcatactgaattacattattaaaaaacacccatttctggccaggggcagtggctcatacccataatcctagcactctgggaggccgaggcgggtggatcacctgaggtcgggagttcaagaccaacctgaccaacatggacaaaccccctctctactaaaaatacaaaattagccgggcatggtggcgcatgcctataatcccagctactcaggaggctgaggcaggagaatcgcttgaacccggcaggcagaggttgcggtgagccgaaatcacgccattgcactccagcctgggcaacaagggcaaaactctatctcaaaaaaaaaaaaaaaaaaaacaacccatttcttaattaaatcttggatcacaattacaagttttggattaaatttttataaacaaagctttaaaatcaccatcgtagaggaatgagagaaaggaaaaaaacaacttgtatctaatatttaaaatagaagacctgaaactcctcttgaaagctaatctgctgcatgtcatgaaacagtggaggctcatgataatcatgcatcacatctttgacagcaaactacataatgcttcctgctcagtagtccctagagattttcgttgttgtttgtttatggagcattcgatgtttgtttacttggatatctggacccagtttttatccatgaactaaaaaaaaaacttaagaagttatgggggaaatatgcggatgaaaatcattttcatctgccctcctaccctcctccccttacccaatagatcctctgtttcattctaatttgctttatttccatgttcatcacccagagtggaatgtcttgtggcaggcctttgtttcctctcttagaaaataaaaacaatcattgttatcctacaagactggggaaggtcaaataaggtaaagtattttggaaaatgcataatatgacacaaatatttgttggcatttcatgtatattttctagtttgttccccatgtaggtgcagaaaattggttataggaatctttaacaaaggtattctctctggatctaagtttatcttgctcttggggccccccatgctaaatgtggcagttagcaaagctcattctatatgctttacaagcagctaaataagatcatgtgtcttcatcatggattatataagaataataataagcctgatttattacatgggttttcacaaattccaaaaggcaaatatctcactcttgtcagtctaatttatatattgagagttgaaaggtatttgtccagattaagacaaattataactaccagtttaaaatctttgtttaaaacaaagaataagtatcattgtctgaagtgttccctcggaatgtattttaagtgctgcaattcatgatgcttcccactgcacattcctcctctattgttcagatcctccatgcgccaaatgttttccatagaatagcctgggctttgaaattaaaatgagcgttccagaaatgctttgttccttataataaatgccagagaagtaagaaatgtgaaaagaactttgtataagaacatcatgcttccatcaaaaaaggcaattgcaacttgcaagttattcacttttataagttgtttgtacctacgtcttcttttaaaatactccaatacagttatttgatattgattaaactaaagtcaagtgaggttttcaatgattccttttatttcagaaagtaaatatggcttggcaatcctgtggaaaaaaagaaagctgaaactattttttttaaccctaactcacctaagagatttaacttactcctatcagtgactgtgactcaccatagcagatgattctcaccaaggcggaggataggagggcgctatttgaaaaggtctcccacctcttgaaggaataccagcaaccagtaaaattagctttcaagttatcctgtaaaataaatcctgtgtcctcattttctttttcagtactaaatcagttatatttctgtaaggaagtttagttggaacaacttgcaacaaagatgattctaatgtagggtttaagcccatgtcttgctaactttaccttttgccatagatacaaaaccctcccattcccctctttctcagacttcaggggtccctctcatatagaaaatctccaagcttgcagcattagagagcttgggtttgcttactttctttagtctgtaaatctgtgctaggctataaagacacaccttcatcgtagatacaggaaggaacttccatgggaatggtgctaaattaaaagtttcaagtaatttataaagaagaaattcccactctattaattctgcaagtttaacattccacaaaaccggacatattttcaatggtgtgtaaaaatatttatatattaaaattaagagtataaaaaaggtttttatagattttccaaatttaggtgtgcttctctaaatgctctaaagatgctgaaaattaaattgataagcttaatgaaccaagccatcaactgtcattatatagagccacactggcacacaatatgaacactgtagaatatgttgacttttttttttttttgagacggagtctcactctgtcgcccaggctggagtgccgtggcacgatctccgttcactgcaagctccgcctcccaggttcacaccattcgcctgcctcagcctcccaagtagctgggactacaggcacctgccaccacgcctggctaattttttttgtattttttagtagagacagggtttcaccatgttagccaggatggtctcgatctcctgacctcatgatccgcccgcctcagcctcccaaagtgctgggattacaggcgtgagccactgcgcctggccgtgaaatgtcttttttaatgccaacttgggtaacacaattatattctataaccttgttccttcccaatatagttctgattttttttaattctaccctcattgtagtataaaaaggccctgttaacagccatctcttttcttgtttattagctaaaacactttgaatttcaaccttcctccaatagctcacaggagccttcagggctacttttgctcccttgagttaattttaatgtatgaaataaaatataagacatttaagctatgttaattagctaaaacttcaacagggttctgaaagaaattagaagggtagaaaaataaaactgcctatagataagtaaaaactgtgatctttcaaagtaaaaggtacaaaccagtctcggggaggagagggggtgtcccttcttcaagtcattgataatttcaactattcttttacttctaccaaaacaacccttactggattaacaaaagtacagaggaagattaaagggttgagaacccaaaaaatgcctctagataacattcaacacccccccaaaccaacttcaatcttcttttagttcctttcaagccaataaacacttatattttgttcaaaataataccctaggcattcaggaaataaatatgaataagctccaatatggcaataagagaaatacacaactagttgcaacattaaaggcagaatgataactgtttacacttatataagtacaaagaaagtgctgccaaaattgcaaacattcacaaggattaagtaggacttccaagaagagcctttaagaacagataattttctaccagaagagataaaagggaggtatgtaagccagggaaagaaaattgtgtgcaaaggggcagagaaaaaaatttattttgtctgaaaatagcagatagccaaacttagcaaactgtggggtaaacacaggcaatagggtgagaaggccaagaaataggtttcatcttaaataaaaagttataaaagtcaaagaaagagttaatatttaatgtaataggtgatagaaaatgaaaacacagcatgcccaaagtagagaagcctttgcccatcaacctgcctctccaccatctgtattttttacctcagtggctaacacctctaacctgaagcagaaacccagaggtcatctgggctagtctctctctcatcttcctctccaagtccttgtcatccaagacacagaaacggggcatcattctctgccccattcaccaatctatcattatgaaaagtgtgtgcaatgattctgccctcgttgaatctttcatgaagcgtcttctgagaggtctcactgcctctgcaccagccctacattcccactagagccgtctcttgaaaatgtaaatctctcatatttgcactacctgtaggctacctgctgcctacaagcaaagtccaaactctttagcgtagcttttgaggcaattttgatctcactgctcactaaattttcattctcatcttctatctgtggaatctgaccacaaactacttgttaggctcagaacaggaaatgttcagcaacctcaacctggggtgactccctcccctcacagctccttgttcgtagctcttgtatcactcattatactgtcttgtaattagctgttcacatattgcctcctctgctctaccacgaactcaataaggacaggggccgtgcttgactcatcctgaaaacacagagccagcgtactgtgaaaaataaacaaacagtggtttactggatgaaaaaaaaaaaagaataaaaccctacattttagaagcctttaaatcaagagtcacaatgttcagtgattcatacgaggttaccaaaagaatgggttgctacagcaaaattaaagtttagtgataacacatagcagctttcattaaaaggaagtccttaatgtgggattttctgccatatctcctgtctagtttagttggggtctgatcagttcaatgtaatctaggatcaagtatattatatccagtctttttttgccccccccaacaaagacacgttacataattcattttcaaactacaaataaaaagagctggcacatcctttttattactgattttttcatttttttcaatccttgtgttagttttctagggctgccataacaaaataccacagactgggtggcttaagccacggttccccaacctttttggtaccagagacccattttatggaagacaacttttccacagacccaggggtggagtgggggtagacgtttttgtgcccggagttggttccttctggtgggttcgtggtctcgctgacttcaagaatggagccacagacctttgcagtgagtgttgcagctcttaaagatggcatggacccaaagagtgagcagtagcaagatttattttgaagcgtgaaagaacaacacttccacagcaaggaagcggaccctaccaggttgccactgctggctggagtggccagcttttattcccttatttgtccccgcccatgtcctgctgattggtccattttacagagtgctgattggtccattttacagagcgctgattggtgcattttacaaacctctagctagctgcagagcactgattggtgcattttacaatcccttcgtaagacaaaaaagttctccaagtcccctacttgacccaggaagtccagctggcttcacctctcagtttcaggatgattcaagtggattacatttattgtgtactttatattattattacattgtaatatatatgaaataactatacaactcaccataatgtagaatcagtgggagccttgagcttgttttcccacaactagacggtcccatctgggggtgatgggagacagtggcagatcatcaggcattagattctcataaggagtaggcaacctacgtcacaataaggttcactttcccatgagaatctaatgccactgctgatctgacaggaggcagagctcaggcagtaatgcaagcgatgggggttggctgtaaatacagatgaagtttcttttgctcacccacccactgctcatctcctgctgtgtggcccagttcctaacaggccatggacatgcaccagttggggtactcaactggtactggcactggaggcctaggggttggggacccctgggttaaacaacagaaatttattttcttacagttctggaggtcagaagtccaagaccaaggtgtcaacaggtttggtttctcctgaggccttgctccttggctatcagatggctgtcctctctctgtgtcctcacatgtatgcacacaacaatgatgtctttccctgtacatcctaatctcttctgataaggacaccagtcatattggattagggcccacccaaatgaccccattttaatttaattacttctatatccaaaggccctgtctccaactacggtcacattctgagaaactggggttagggcttcaatatgtgaatgttggggttggaaatggcacaattcaatccataacaatctttaccacaagtgatacaaaaagtgtaaaataaccataacctttttaaaaatataatttagggttttgtttgtttgttagataaacaaccactgctaacataagccattactccgaactattgagggacagtaacaaagcacatgtagatccctctccaattccaccagccctctgtgccacacagatggcataacaaagcaaagagatttacgtgtcaaacacataagcagttgtagctaaatatcctaatccaagaagtgcacttactcctggataaatataaagctaaacacaactaggaaaagaccacatgctgagaataataccaaattagtttcttctagttttcacttaaccacttaccatccaaaaacaaacgagtttggactttaccattcatttattcaacaaatattgatggtgcacctacactgtgccagaacatggcaatgagcctcattctaagaaggtgggggaacagagaataaacaaatacataagtaaatgtgtaacacaacggcaggtattctttttttttttttttttttttttgagacagagcctcactccatcacccaggctagagtgcagtggtgctatcttggctcactgcaacctctgcctcctgggttcaagcgattctcgtgcctcagcctcccaagtagctggcattacaggtgcctgtcaccacgcccagctaatttttgtgtttttagtagagatggggtttcacccatgttggccaggctggtctcaaactcctgacctcaagtgatccacctgcctcggcctctcaaaatgctcagattacaggcgtgagccactgcacctggccaatagtaggtattgacagatgctatgaggaaagtgaaaaagggtaagaaaataaagagtgaaagagaagagctagtttagactgcatattagggaaagcatctctgattaagtaagaaggatccaaggaaacagaagaataagacatttaaatatctggaggaaaacatcccaaacagaagaaacaggcgcaaaggttccaaaacaagagcttgactgttgtattccaggagcaataggaaggctggtatggaggcaccaaattgtgcaggacttgtagatcaccactaatgctctcaattctattcttatgactggaagttactgaagtgcttgaaacaggaaagtaacatgatctgaccccaaattttaaagcatcattctaaatgctctaggcaaaacagactagagacagctctatgcaaaacagactaggcaaggatgggatgaggaatagaagaagggaaagcagttaggagtccgttgctgtagcccaagtgaagaccacactggcttctttgaggaagcagtggcggagttaagaaatgacaaaattttggtatattctaaagtgtcaacaaggtttgctgacagattgaatatgggttatgaaagcaatatggcatcaaggatgactctggcatctggcctgagcagctgagtaaatggaggtaatatttactagttgaggaaagtaaagggacatgagtaggaagggaaatcaagagttgatggattaccatggcattagccatgttaaatttgccttttagagtttttaaagtggagactagtatacaattctggaattgaaagaggtaaaagttggagatatgtttcgtataggttactttttcaatttaattgttcacttgtcagtagttttgctgatcttaccaaaattgcaaagacgtttggggaaaaatttttttttaatcagagattgaatgagatctcttaaaaacgatgtataactggagaagaagtcacaggactgagctttgagaaaccccaacaattaggtgtagtatttctcaggaaacccaaccgttaacatattaattctaggatatgtagattttgtcatttcgaacattactattatttagaggaaatgcctggtttttgaaactaaatttaatagttgttttttaacttttattttaagttcagaagtacatgtgtaggtttgctaaataggtaaactcacgtcatgaaaagttgttgtacagattatttcatcacccaggtatgaagcctagcactcaatagttatttttcatgattctctccctccaccctcttataggacccagtgtctgttgttcccctctatgtgtccatgtgttctcatcatttagcttctacttataagtgagcacacaagtggtatttggttttctgttcctgcattagtttgctaaagataatggcctccagctccttccatgttcctgcaaaggacatgatctcatttttttttaatgacagcatagttttccatggtgtatatatgccacattttctttatcctgtctaccactgatgtatatttaggttgattccatgactttgctattgtgaattgtgctgcaatgaacaggcacgtgcatatgtctttatggtagaatgatttatattactctgggtatatatccagtaatgggattactgggtcaaatggtagttgtttttaggtctttgaggaactgccgcactgttttccacaatggttgaactaacttacattcccaccaacagcgtataagcattcctttttctctgcgacctctccagcatctgctttttttttttttttactttttaataatagctattctaactggtttgaaatgttatctcattgtggttttgatttgcatttctctaatgatcagtgatgttgagctttttctcatatgcttgttggaaaaatgcctgttttatacagaacaaaaattcagacaaattcagttttaaaaatgtaatgttaatcatatagtctccttttctacaaataaatatttcaaaaaatgagaagaaaaactataaagatattaaattaagcaaactaaagagaaattatattcatgctgtaatttattcctaaatcaaacaactagtaattccagtaaatcaataatccatagtttataggacagtactgattcaaagaaatgttgaataagaaaaagcaaaaagtcaacctttttccatcaataacctttgactgcttaaaggaagcaaaacaaaaagtaaaaaatccaatcataccaaagaagactctaaaataaataagttgactgcacatgtaatagcttagatatgttcacataatcccttggtccgtccagccccgcattccacttccagcagtgactgatggtagaatatggttatgactcctacttacgtattccagaattgtttgataatcatttacaaccctatcaaccataaattgaataaactatgccaatattttgtcatttgtgtttgctttaccaacataaacttagaaagttttatctgcatttccctcccactatctgctgccggattccctttttcacatctaccttagatggtcagatttactctttcttgttctcttctaacacaaaactccattttattgacgatatccaggagaaaatatacatagctacttgctcatcatgatgaatatgagagataataaacattaagcaaaaaagatcatcaaagatagtgattagatttgcagggctgaagattttatagcaaccaaaatatgatttaaatatagctcatcagcaaattaaatacttatattcagtttaagattgattaggctgtatccacctcatttgtcagaactctctctaagtcaatagtcattttgtctcattgtttggggtaaaaattaaataccagtcacccatcttgaatctcattggccagcacttgatctttaatgtcccaaagtcccttctttgatattaccatagtctctcaattctaaaatactatcaactacaacacaaaccaccaatgtaatcacttctcttaaaagtgtaaatatggatattttgtcaatattgaaccttccataaccaaggtgaagccaagagacttattgtctaggaataaagacagcagacagaacaaagataccattgatcatctttgagtttcaaagctgactttcttaagctctcaagaaagaaaataattgtgaagctggaggcatcatactacatgacttcaaaatttactataaagctatattaaccaaaacagcatggcactggcataaaaacagacatgtaaagcaatggaatagaatagagaacccaataccaaatccatacatttacagccaactgatttttgacaaaggcaccaagaacactcactggagaaaggacaatttcttcaataaatggtgctaggaaaactggatatccatacacagaagagtgaaatgagacccctatctctcaccatattcaaaaatcaactcaaatggactaaagatttaaatgtaagaccaaaaattatgaaactagtagaagaaaacacagaaagagaaaatcattttctaaatccttttggctctcatttagcaaaagctagatctgatagactagatcacagttttatgataaagaagatctggtcagacaggaaaaagaagtgtggactattggaagaaaggtctcagaaacaggttagacacattttatttctcttctctgggcttcacccagattaaaagctgtaatggctctcaactaacacagttagttgggaaacacagaaagccgaggaatttttattccatttatcttcaagactttgaaagaaaattgttttatgagctcccctgcacaaaacttcaggggtagctacagtgtaatcttgccatcacaatcttgaagctcaataatacataacaatgtaaatgggtagagagaaggtcagcttagctttcttaaatcagtcttgattcccatgaggcttagatgaaacccagaacatcctagataccatgaaaaacaatcaaaatgaggctatgttgaaaagcagtgggcctgccctgagttcaccatggtgaagagccaagtgatctagcagagtctgagggtacacagataatgccagatactggatggaggatgtagctgggacttcgaatctgaagcaccatcaagggccaaagtggggttaaagcatcctggagaaaccacagaccctagccaagctacaaaagaacgccccacaaagcatataaggacatcaagaaatgcacagaggtgcccacaagatgaccatgcatgggacccatcactccctcaaaggtcacagtccagagagcattccagaccagccactcggcaggcactaagtgtccaaaggtcaccacatgggtccaaaggccgcatctcccaccgtgaaatcatataagcaacaccctcaacccaatctcctgttttagagcattttatctaaaaagactgagcatttaccaaaagggactgtttatattgttgaatcacatcagtttaccatcttattggcttaaacagaaggcatttattccaattcccagtaggtaggagtttatgaggaaggtcagatcacttacgaaagataaactaaagtgtgctgtgggaaaacttgtaatcccctacaagtacaaaaaggaaagctacattaaatgtttatttccattatacgatgcatcctaatttcagaaatggtaaaaaatgtgaggtggacaatgtgggaaaatgtgtttaaattaacgaaatatggtatcttgcaaatcaagattgcgaatgcaaactgtttcctaaaagaaaaaactcatctgaaaaaccacatttattaagccttaatttatttaatttgtagagctttcactactgtacatatatatgtgtatatatatgtatatgtgtgtgtgtgtgtgtgtgtatatatatatatatatatatatatatacagaaatgtggatatctatgtattcaaattcagctacaatgaggttaaaaaggcatagaaggggcaccattttatggcaagctttggaccaagaggcagaaccatgctcactactggctgatatcatggccagcataacagttctgacatggtaatcacctgggagctttaaaaattattgtctagtcctacttccagagattctgatttaactggttttgtgtaaggcctgggcatcaggacttttaagagctccccaggcaattttattgtgcagccagggttgaaaaccactgggctaacagaatctcaacaataacagggattttctgaattgcctacttagtactcttcctccaagtaagccttctgtatctcccatagggcttggccacaaaccactccatcatactttatctcactgggggctctcaattgtgtgtgagataatgcccatttcttacccttccttaaccagggagtgcagagtagctccatgagaaaatggtcagtctaggccaggcgcagtggctcacgcctgtaatcccagcactttgggaggctgaggcagacggatcacgaggtcaggagttcaaaacctgcctgatcaacatggtgaaaccctgtctctactaaaaatacaaaaaattagctgggcatgatggtgcacgcctgtagtcccagctactcaggaggctgaggcagaagaattgcttgaaactgggaggcagagattgcagtgagccaagatcgagccactgcactccagcctaggcaacacagctagacatcatctcaaaaaaaaaaaaaagaaaagaaaagaaaacggtcagtctagaaccagggccttccaagacatagaaggggcaccattttacatcgtaggagccaaatctggcctcttgtctattttggtaaataacaaaattttactggaacacagccacacccatgtgtttacatattatctaagtttgctttcacattacaacaatagcagagtagttgcaatagagacgctatggtccccaaaactgaaactatttactatctggacccatacagtaaaagtttgccaaccactggtctagagtcagagttttcaagctgcaacagtatctcataagacaagttagatgtcctgaaatagccccggggagtctatgaagggtagagtcagaccttgagcagtgaaaatgacgacatctggggagatatggactcttctatcctttcagccagctgaagcacaattgcttctatcaatctattaatatcattttccactaagagggcaggtgtatcttggcttatcagtctgcatcacctggctgcccacacaatcagtttataagagaacaattatatcctaaagctaagttagaagtgggtatctatggaatcagtctgaattcattgaggaaaagatgagctgtgattgaaagataaagtattaacagaaacagagtgaactggggttggttggagaaccctgaaaaagaggggagcaacattaaagtgaagaaaatcacagtctaataggacaaaaggtttaggaagcaagctgagaagaggtgaagcacatacaatgaatggcagctacccacagatcatctcaaagctaccagtttctgctggtgggggcctccttgtatccttgccatgcacgctcccactggacttgtactattttaatcaattagctatgggttttcctatccttattttaatgtaatgagtgacttcctttttctccactatttgtgtcttaagaaatactatagcctagccattttcccatgggagcagttttctggcagtaaaatcatgcagaaattggagaattcactttattagaatcaactcagctatactgaatcatcttaaactttaaaacattactgaggcagaattaagtttatttcttcatcctaccataaaaataacatctttatacttattaagccttaagcctattagtatttaaaagacacttaatttactaacttttaaggttactcgttgaggttatagtcaaaactccaatatttgcttacaacgtgccctacaagaacactctatgtgtgcagacttccttttgagatttccttggaagcttcaagattaattctgatacaaattctattgatagaataatcagcaagagtacaaaaaagaagcttggaggtaaaaccaagaaagcataagtaaatggcatcatgcttattcaaaatgacctatagaaatgacagaaagcaaccacaaacaaaacttgaactgttttctgaaagaaacaaaggaaattatcttctagaaggctaagaagccaaagggggcagacatgttctctccctgctacctgaaagccaatcaaatctgtctgtagagcagtggaaaattaactctttgggcatctaggcatctctttgcataaattgatatatatgattgcttgctgcctttagagggggttgtggtcaaggagagtagaaaggaattttgacgagagtggggtgtagcagagaggttcttcataggagccaggcaggaaagaaaaacatggtgcttggaaaagctaggactaactactccccatgcagtcactaggactggccttgactctagtaaggagcggggagagagtagagaagaagctgaaagggatcattttcataggaattgtgtgtgactctaggtgcaatcattgcctcactggggcccatatgagagagtgcagcacagaattgggaagagaggcattctcccctcttttgtaggagcctagcgccattctaccacattgaggattggcagctgaaggagaccagagaatttcaccccaaaatatggtaccctggtatgtttattattattattattttgagacggagtttcgctcttgttgcccaggctgaagggcaatggtgcgatctcggctcactgcaacctccgtctcccaggttcaagcgattctcctaccttagcctcctgagtaggtgggattagattacaggcatgcaccaccacgcctggctaattttttgtatttttagtagagacaggtttctccatgttggtcaggctggtctcgaactcctgacctcaggtgatctgcctgcctcagcctcccaaagtactgggattacaggcatgagccactgcgcccagccgattattttaaattaaacacccctggggaccagcagacactggaaggagctttactttgatactccctaatctgcctaatgtccagactcgccaaagaaaaaaataattacttctggtcccttccctgagttttcatcaatttaataataactctaatcacaggcaggtagactgaagtctgtcaacacacctggacagacgtttgtcaaaaatcatgctctgcgggcccaacaaactttgtcccaggccactgtatgttctccaagtccactgaatttcccctaaaaatcatttactacaccccaagttgacacatttcccctatctcccctcctctatgaaaaagggtatataagcttctgtacccgttgggttatgaggtaatcattctcctactattcccctgtgttatgcacattgaaataaattttgtgtgtcttttctcctgttaatctgcctcttgtcagttgatttttcagcaaaacttcagagggcaaagaggaagcaatccctttgaccttacagatttggcattgttggtgggataaccaaaactgctctgctcctctagaagctgcagtcaaaggaacacaggacctgataggtgaacagaatgataagaaattcttaccagtcagactcccagtctctctctctgcataatctggtcaagcagacgagaaaaatcagtttgtctcttttttctttccaaatttaagattaatgggagaaaagcatttgtatgactagtcttagatgtaatgactctggtatatttttgctatgaatattcatattgtccatccttttcctcacagaagtagtctttattttttcctttgtctctgtctttctgtgaagagtccctcttgttttatgtccttgagagcttgacttttgaccacgtaggagccctatctcttggtctctgccatccagtgggcatgatttttgggccacgtctggtggccagcctaaaaggactaggaacccggaggtacctaagatattaagcagcacactctgttccaaatgtgccaagctctcagcaaagtttttcttaaataagaaatcccatccataaggggcttttgttgtcctaactcttgttgcctggatagtcctggaaagtccaatcccaggaggacctactcagtgtcacagattaacagatctatgactggtgcccctccctcctcaatactggaggcaccatatgaacaaacacctcctcaaccatctgtcacaagtgtcctttgctatattagactttttctgaaagtgaattttgaggggatcatgagaactacatcatcttcccatttttatactgccacttatactgtccatgatagtctaaacctggaaagctacctctgagactccatgaaaatggctcattaacttgagtcatttatggaataaataaattggctatacttaaaagaaaactttttagagagtgcttgtcttaaacagctatcttattcgtacctatttttaaaaatattaaaggaatatagccttagaaattctcttagtaagatttttaaagcagaaataatattcaaaggaaacttaaaatcctgtacactcaattgcctgctttggatccatctaggatctgcaaaaagcactctggcctatggtctaatggctaggattccactgtttcattgcctcaactcaggtttgatttctagtcagggaaccagccccttggagatgtaaatcctttaactcaggggaaaaaggaaacatttataaaaattagtttgagggtcaggcacggtggcttatgcctgtaatcccagcactttgagaggctgaggcaggaggatcgctggagcccaggagtttgagactagcctgaaacagatcccttctctacaaaaaattaatttaaaaaattagccaggtgtggtggcatgcatctgtagtctcaaatactcaggagactgagacaggaggatggcttgagcccagagatcaaggctgctatgagccatgattacaccacttcactttagcctgggcaacagagcaaaaccctgtctcaaaaaaaaaaaaaaaagaagtttgaattacttattttgaatttatatttgtgtgacccttgactttttggggtacccatttgtcattgatctttttcccttccatggacagttatgttcctgttcatcactaagtctctattttcttccagaggtctttgtggggtggctctggattttgtgaagactgcttctttgtacctctttggagatgtcttgtgctcccttggttaaatcataaatggcttttttggttctgaatcacttggtagttacctttggtttaaaagaaaaaaaactgaagttcagataaataaagttttaaaaaaataaagtttacttctccttcctttctctacgtctgatacacatgaagggatctagatgggactttgagtgaccctgaagcctcttgagaaccacaacaaaaaggtaccactgactccctgttttggggttctctgttttcctcatggagactcaaaagtcgtgaatgggttcctctcaggtctgaaatctctactcttttttgcattaaactccctcatctatttgacttttgtatacatacatgtatacgtgtgtgttgtatgttgtgtctacatgtatgtgtctatacatgtgtttgcatattatctacatgatatcaaattgacttaaaaataaatgagtactcataaattatataactagcccaaaacttttcaagttcccttgactttaataaatctttggtaaataaagctagttttaaaattgctagtaaaataaaaatgtcttcaaaatttaatttagacatttttgcctaggtctactggtcacacaggtttatgctacctctgttagatgttttaaggtcataaaactgttgtttctatgatattcttgatattttcttgatttgtatataaactaaaactgtaagtgctggctgctgggctcccaaaagtcttacacacatcctactgtggcttgttgagccaagcccaatatggccccatcctccctggtccagctctgcctcctggtcatgctgagaggggtcagatcctcccaacattgtcttcacaagtccgtcctctgccctgggccctatattaggtgtgcaaatccaggattcagacaggtcctacccttcgtagtcatcctgggtgccacatgggtactcagaacccaggacaactagagtagggacaatggggagggacctgtgtccagtatctcaaaggccttagttaagataaaattagctgatgctggttttgctttttcaaaaaaaatacataataacctaaataaatagctttattttccatgaataattcaaatataactgttaaaaaatatttttcaataatttaaaatcttaaggacatgttatgttaagtagtagagaatcatgaaatgtttgagtcatttctaagtaagttaaaatactaaaacattaattattaagcatagtttagataattttgacatcttgttcttatatggcatagaaaagctaaatatatctgtatctgttaatgagcaaaaaactgatgaaacatctttctaaaaattataaaattgttttcatttacaaacactgatataaaacagttcaaaattacttacttcctaggttttcagtagaaactagggttactaagagttactattataattagtatataattaaaactactgtatatgataaacaactatgtatggagtatgtaagggaagtaaaatgttataaggtatgaggatgtgcttttgttgagaaaaagcaatttcatatagttcagagattatgtaaaggttgtttcaaaatgagaaaaatgatataaataaaactaaatgggtatagaaagttgagaaagagagaatttcaaaataattaaggtgaatgaaatatttaatatttaatattaaatttatttaaaatttactatttgtttttaaactgagccttaaaatcaaaaatagtctacaaaactagaattttattttctcctttgaacaagattttcatatagtatcaataagaaatagtaaacgactttggttcacattttgagtaaactgcaaaaaaaaaaaaaggggagaaacagcttttgtgtgcctcatgctatcttaataggtcttttgagtatttgaaaaactaagtctcatctctgtcaaactgtcaaagagtaaaggttttggcttttggaaatcctttattacaccagctaaatgaatgactttatttcacagtaatttttgatcaaatattttaaatgtttgacatacttgacaagcttcccaaaatcaaccttcaaattctaaagtaagtctttttgacttcaaactaactttgggattttcccaaagacccctgaagtatccaaaagagaaataataaacaggtttagtttatatattaaattatatgggaagaactgtcaaataacaaataatgtttaaccttttttctgagttatatttatatggctatcttgttagtatgtgttccaaaactgtatgagatttcttaaaatatgatatatcttggtatatgttgtcattcataattatgagtgttatgttgaattgttgtaggccacaaaaaaaagaccaaatatctttgtcaattgtttatttaaccatggccattttaagtcccattgtccacagttaattgttttattctgatgctttttttttcttgaaagctcttcccaaatcctgaagtatgggtcttcaaagaagttcatgggaataacactgacaaataaaggtttctgacaactctgaaactgtataagtgaatcaatgaactgtgtaaaaattccagaactctaataaaaaaaaaaactggactcataaaattgctaaactaccatcaagcagaacaataattaattacatgggactgaactgataaaagactgaaatgattatttatgattttttatttaggctaattatttttatgttttgttctccagagttaaaaaaaaaacaacaactttttaaaggctacaattcccctgtgttatgcacactgaaataaattttatatgtcctttctcctattaatctgccttttctcaattgatttttcacccgaacttccagagggcaaaggagaaatttggccttcacccctacactgctttgaagccactaggacatggctaccttggcatgttcatttccagtttcccagagtaccaccagcagcagtcaccatccaccagcaataagctgaagccagacaaaactggaatacacggcagatacgctggtttgggagcacaagtgagtcataattcagagacttcaaaatttggaaatgcaggaatgaacagaagagaaaagaggttttataggaaaatccccactctagcacaagcaagtgaggtcaattacaggaactctggattgctgctgctaatgggacttcctttgaacttgcaagggtagagtaggaggccagggaatcagattacataaggataagcatctggcctacatggcccagtggtctgggaactgaaaacaatgagtcccacagaggctgaagtataattctgagaatagaatgtagtttggaaactgaaaaaaatctgttaaaaccctggcaactaggtaatcttattgttcctgaacagcaggagtttgtgaatccaaacctgaaaatgccacattcactatgactcaactcttccccttgtttctactttctgtgtatctttcagctttgcacctaatagaactgtttaaccctaggtactaactgcttaaatctcagaatatagtcaactcctcaaaaagaggatgctaacgggaccaattcataatcatcccccagaggcagagctctcatggcagagcacgtcacagggttcttgccaacctataactgagtgtcactaagtcagttgcccaccctgataaagttagctgtaacaagggtgccaaagtgtcttgagagcattatggagacttaacaaaaggaacccctaaaaagaaggcaaagggaatgtaatagttattaaggctgttcacaaatattcccattgtcctctgggcacagggcaggatcacatacccaacatccactttgaccacataacttgctttgacaaaagcaatgtaaatagaggattgacatatgtcatgtccaggtgaacattttaggagttctcgcatgatttatcatgttccatttccccagttgcaatgacagtggaagcacatgttgagataagtctatattagcctgggtctctgagtgcctgtctcaagcagaaaccccagctcacattgaacatgtagcttgagcaggaaataaattttattaagcctctgagatttgggggttgtcttcttatcacagcacaaccttgcttatgctgactaatacaggggctggtaggtaaacttgccccagtgagtattaaaagctatccccaaggggacaggtgggagacactatggaggtagaaatgaaaaaaaggccaagaggtcctacaatacttagaggtgaacgacaaagaaataatgtttattactgttcttctaactctagatttacttcttgaaaacatgggatatatttacagtcagaaaatacatttgacctttgcccttcaaaaaaaaactttacaaaagataacacattataaagagtttgttattactattattttaagggattttgagtaagtcaattcttttaactcacattcaacataaatctgacacctaccaaactgtattttgcagcaaataagattatagacagtttcattatataatgactgtagcatgatctagcagtttatatccccttcagagagtatacaacatagagatgtaaattctttgaagcacaattctgcataaatagactttctgcattgcattgccaaacttggatcttgaaagtgataaagtgcagatgcctacagttgcagtcataaaaatgtaattgctgagaaattatttctgatccattggaagaatttattacagagggatgcaactgtgtaagttatcacacaagaaactgaaagtgaatgattgaaatatatcccaggctaaatatccctgcaaaatgacccaagagaaaaaaatctctgtgcccaagagaaaaaaaaaatacattaaagataaatcaggtttggtagggaagaatttggtaaccataaaagagcagaataaagatttatgaagaaatgaattcagaagttagagtgacataatagtatctatgaccaattactccaaaaattaaaatgtaattttgactttgagttatatacagaggtgataagtaatttctgtggaaccctggaagcaaaggaatataacatgaagataaatcatgaggaaagtgaagaaatttttaatgggactactgaattaataactttagctggtggcaatgtgaacttaaagacatgaacttcttttggaatgttttccagtgaaatcagagactatatcatgtacttaaaccatgtaactatttcaaattaaacactctttgtaacagtagccaaaatatgggaacaaccatctacagatgaatgaataaagaaaatgtggtgtttatgcaatcgaatactattcagtcataaaaaaaagtaaatcctgccattttctaacatggatgaacctggaggacattatgctaaatggaataagccagacacagaaaggcaaatactgtatgatctcacttatatgtgaaatctaaaaaagttaaattcaaagaagcagagggtaaaagggtggtttccaggtgctagcgaattggggaaatggggaagattgttgatcaaaggatataaaatttcagttttaagatgaataagttttgggactctactgtgtagcatggtgactatagttaacatattgtattctttacttgaaatttgataagaaagtagattttaagtgtcttagccacacacacacacacacacacacacacacacacacacacagtggtaactatgggtagagatggatgtgttaattcatttgactgtggtaatcattacacattgcatacatacatcaaatcatcacatcgtacaccctgaatgtacagaatttttatttgcctcattacctgtccattaaatatattaaaaaaaaaaaacactccttctcctcctcccctggggtagatggcggcggctagatttggagccccaacctcgctgccggcaccaagatggacaattagaagcagctgcggtctgcgcactcagagaggaaggaaaggagcaagtgaattcagcaccttcaactgaagtatccaggttcttgcattagggctgactaggcaaacaatttgacccacgaagaacaaagaaaagcagggtggggcgatggtccacctgggagcagcacggagccaaatgaacccccaccctgagccaagtaaagcagtaagtgattgtgagaccccacctggaaaaccacgcttttcccacggatctttgtaatccgtggatcaggagatcctctcgtgagcccacaccaccagggcgttgggtctgatacacagaactgtgtagaatgttggcaaagcagccgtccaggcacacacagagacccaggagttttccacactccagccccaggatccctggcaagacgagagatctgtccgtatatatccctaggaagggggctaaaaccagggagccaaacagcgtcattctgcaggcctgctcccacagcaccccacaagttaagacccactgattggaattccagccagccaatggcaacaggctgagatgagaccaagttccttgcgggaggggcggccaccatctccatggttcagtcgactcagccattccagcctgatggctttggagaatacaaatggtccagacaaagaagggtccccgacaatagcacagctgccttgccagattatagccagactgattctttaagtaggaccccaatccattcctcctcacagggtgggacctccctgtgggggtttcagccaccccagcaagggctctacagacaaagccctgatctctccctgggatggagctctcaggaggaggggttgccacaccatctctgtggttcagtggactcagccattctagcctgccagctttggagaatacaaacggtccagatgaagaaggatccctcactccccgccccaacgcagcatatctgctccaccagaaagcatccagactgcttctgatcccattcctcctgaccaagtgagccctcccaacaggagtctacagacacttcctacaggcacattaggaacagcaacatgtcagtacccccactgggacagagcttccagaagaaggagcaggctgctgtctttgttgtttcacagccttcactggtgatacttccaggtaaggaaaactgaggcaactagggtctggagtggacccccagcaaaccacagcagcccaacagaagagtgacctgactgttaaaagaaaaacaaacagaaaacaacacaacaccaacaaaaaagaccccataaaaaccccattaaaagtgagcttgaagactatcttgctgaaatagagcaggaagacaagattagagaaaaaagagtgaaaaggaaaaaacaaaacctctgagaactacaggaatacataaaaagaccaaacctatgactgattggagtacctgaaagagacagggaggatggaaccaagttggaaaacacagttcaggatatcatccaggagaacttccccaacctagcaaaacaggccaacatataaattcagggaatgcagagaaccccagtaagatgctccatgagaagatcaaccccaagacaaataatcgtcagattcttcaaggttaaaatgaaagaaaaaatgtcaagtgtagccagaaagaaaggccaggtcacctacaaagggaagcccatcagactaacagcagaccactcagtggaaaccctacaaggcagaagagattgggggccaatatttaacattcttaaagaaaaaaattccaacccagaatttcatatctggccatactaagcttcataaatgaagaagaaataagatccttttcagacaggcaaatgctgagggaatttgtcaccattcagtctgccttgcaagagctcctaaaggaagcactaaatatggaaaagaaaaagcattatcagccactaaaaaacacactgaagtacacagaccagtgacactattaagcaactacataaacaagtctgcaaaataaccagctagcatcatgatgataagatcagattcacacaacaagattaaccttaaatgtaaatgggctaaatgttccaattaaaagacacagaatgacaagttggataaagagccaagacccatcacagtgctgtcttcaagtgacccatctcacatgcaaagacacacatcagctcaaaataaagggatggaggaaaatttaccaagcaaatggaaaacagaaaaaaagcagaggttgcaatcctagtttctgacaaaatagactttagaacaacaaagatcaaaaaagacaaagaagggcattacataatgataaagggttcaaactgacaagaaaagctaactatcctatatacatacacacaatatgggagcacccagatgcacaaagcaagtccttagaaacctataaagatacttagattgggaaatttaaataccccactgacaatattagacagatcatcaagacagaaaattaacaaagatattcaggacctgaactcagctctggatcaagtagacctaatagatatctacagaactctccacccaaaaacaacagaatatatattcttctcattcaccacagagaatactataatcacctctatgcacataaactagaaaatctagaagaaatggataaactcctggacacatacaccctcccaagactgaaccaggaaaaaactgaatgcctgaatagaccaataatgagttctgaaattgaggcagcaataaatagcctaccaaccaaaaaaaaggcccatgaccagaaggatttatagctgaattctaccagaggtacaaaaaggactggtatcatttctactaaaactattcaaaaaattgaaaagaagggactcctctctaactcattctatgaggccagcatcatcctgataaaatctggcagagatacaaccaaacaaataaaacttcaggccaaaatctttgatgaacatcgatacaaaaatcttcaataatatactggcaaactgaatcgaagagaacatcaaaaaaattatccaccatgatcgagttgtcttcatccctgggatgcaaggttggttcaacatatgcaaatcaacaaatgtgactcatcacataaacagaactaaagacaaaaaccacatgattatctcaatagacgtagaaaaggacatcaataaaattcaacatcccttcatgttaaaaactctcaataaactaggtattgaaggaatatacctcaaaaaaataaccatctatgacaaacccacagccaatatcatactaaatgggcaaaagctggaagcattccccttgaaaacgcacaagacaaggatgccctctcttaccactcctattcaacatagtatcaaaagttctggccaggacaataaggccaagaaaaagaaataaagagtatccaagcaggaagagagaaagtcaaattatctttatttgcagatgacatgatcctatatctagaaaaagcccattgtatcagcccaaaagctccttaagctgataagcaacttcagcaaagtctcaggatataaaatcaccgtgcaaaaattgctagcattcctatacatgaacaataggcaatcagagagccaaatcatgaatgaactcccaattatgattgctacaaaaataataaaagatctaagaacacagctaacaagggaagtgaaagccttcttcaaggagaactacaaatcactgctcaaagaaatcagagaggacacaaacaaacggaaaatcattccatcctcatggataggaagaatcaatgtcgttagaatggccatactgcccaaagcaatttatagattcactgctattcctattaaactaccactgacattcttcacagaattagaaaaaaaactattttaaaatgtatttggaaccaaaaaacagctcaaatagccaagacaatcctaagcaaaaagaacaaagctggaggcttcacactacccaaattcaaactatactacagggctacagtaaccaaaacagcatggtactggtataaaaacagacacgtagaccaatggaacagaatagggaactcagaaataagaccacaaacctacaaccatctgatcttcgacaaacctgacaaaaacaagcaatggggaaaagatttcctatttaataaatagtgctgggagaactggctagccacatgcagaaaattgaaactggacccctaccttacaccatatacaaaaagtaacccagaggaaagatcaggcagcaacatttgctgttcaccaatattcgctgttctgcagactccactgctgatacccaggaaaacaaggtctggagtggacctccagcaaactccaacagacctgcagctgagggtcctgaatgttagaaggaaaactaataaacggaaaggacatccacaccaaaaccccatctgtacgtcaccatcatcaaagaccaaaggtagataaaaccacaaagatggggaaaaaacagagcagaaaaactgaaaattctaaaaatcagagcacctctcctactccaaaggaatgcagctcctcactagcaacgtaacaaagctgcatggagaatgactttgatgagttgagagaagaagacttcagatgatcaaacttctccgagctaaaggaggaagttcgaacccatggcaaagaagttaaaaaccttgaaaaaagattaaacgaatggctaactagaatacccaacgcagagaagttcttaaaggacctgatggagctgaaaaccatgacactagaactacgtgacgaatgcacaagcttcggcagctgattcgatcaactggaagaaagggtatcagtgatggaacatcaaatgaatgaaatgaagcaagaagagaagtttagagaaaaaagaataaaaagaaatgaacaaagcctccaagaaatatcagactatgtgaaaagaccatatctatgtctgattcgtgtacctgaaagtgacgggcagaatggaaccaagttggaaaacactctgcaggatattatccagaagaacttccccaatctagcaaggcaggccaacattcaaattcaggaaatacagagaataccacaaagatattcctcaggaagagcaactccaagacacataattgtcagattcaccaaagttgaaatgaaggaaaaaatggtaagggcagccagagagaaaggtcgggttacccacaaagggaagcccatcagactaatagctgatctctcggcagaaactctacaagccagaagagagtgggggccaatattcaacattcttaaagaaaagaatttttaacccagaatttcatatccagccaaactaaacttcataagtgaaggagaaataaaacactttacagacaagcaaatgctgagagattttgtcaccaacaggcctgcctaaaagagctcctgaaggaagcactaaacatgggaaggaacaactggtaccagccactgcaaaaacatgccaaattgtaaagaccatcaaggctaggaagtaactgcatcaactaatgagcaaaataaccagctaacatcataatgacaggatcaaattcacacataacaatattaaccttaaatgtaaatgggctaaacactccaattaaaagacacagactggcaaattggataaagagtcaagacccatcagtgtgctgcattcaggaaacccatctcacgtgcagagacacacataggctcaaaataaagggatggaggaagatctaccaagcaaatggaaaacaaaaaaaggcaggggttgcaatcctagtctctgataagacagactttaaaccaacaaagatcaaaacagacaaagaaggccattacataatggtaaagggatcaattcaacaagaagagctttctaaatatatatgcacccaatacaggagcacccagattcataaagcaagtccttagagacctataaagagacttagactcccacacaataataatgggagactttaacaccccactgtcaacattagacagatcagtgagacagaaagttaacaaggatatccaggaattgaactcagctctgcaccaagaggacctaatagacatctacagagctctccaccccaaatcaacagaatatacattcttctcagcaccgcactgcacttattacaaaattgaccacatagttggaagtaaagcactcctcagcaaatgtaaaagaacagaaatcataacaaactgtctctcagaccacagtgcaatcaaactagaactcaggattaagaaactcactcaaaaccactcaactacatggaaactgaacaacctgctcctgaatgactactgggtacataacaaaatgaaggcagaaataaagatgttctttgaaaccaatgagaacaagatacaacataccagaatctctgcgacacatttaaagcagtgtgtagagggaaatttatagcactaaatgcccacaagagaaagcaggaaagatctaaaattgacaccctaacatcacaattaaaagaactagagaagcaagagcaaacacattcaaaagctagcagaaagcaagaaataagtaagatcagagcagaactgaaggaaatagacacataaaaaacccttcaaaaaattaatgaatccaggagctggttttttgaaaaggtcaacaaaattaatagactgctagcaagactaataaagaagaaaaagaagaatcaaatagacccaataaaaaatgataaaggggatatcaccgccaatcccacagaaatacaaactaccatcagagaatactataaacacctgtatgcaaataaactagaaaatctcaaagaaatggataaattcctcgacacatacaccctcccaagactaaaccaggaagaagttgaatctctgaatagaccaataaaaggccctgaaattgaggcaataattaatagcttaccaaccaaaaaaagtccaggaccagacagattcacagccgaattctaccagaggtatgaggaggagctggtaccattccttctgaaactattccaatcaacagaaaaagagggaatcctccctaactcattttatgaggccagcatcatcctgataccaaagcctggcagagacataacaaacaaagagaattttagaccaatatctctcatgaacatcgatgcaaaaatcctcaataaaatactggcaaaccgaatccagcaacacatcaaaaaccttatccaccatgatctagtgggcttcatccctgggatgcaaggctggttcaacatacacaaatcaataaatgtaattcagcatataaacagaaccaacgacaaaaaccacatgattatctcaatagatgcagaaaaggcctttcacaaaattcaacagcccttcatgctaaaaactctcaataaattacgtattgatgggacatatctcaacataataagagctatttatgaccaaccgacagccaatatcatactgaatgggcaaaaactggaagaattccatttgaaaactggcacaagtcagggatgccctctctcaccactcctattcaacatagtgttggaagttctggccagggcaatcaggcagaaggaaataaagggtattcaattaggaaaacaggaagtcaaactgtccctgtttgcagatggcatgattgtatatctagaaaaccccattgtctcagcccaaaatatccttaagctcataagcaactacagcaaagtctcaggatacaaaatcaatgtgcaaaaatcacaagcattcttatacaccaataacaaacaaacagagagccaaatcatgagtgaactcccattcacaattgcttcaaagagaataaaatacctaggaatccaacttacaagggatgtgaaggatctcttcaaggagaactacaaaccactgctcaatgaaataaaagaggatacaaacaaatggaagaacattccatgctcatggataggaagaatcaatatcatgaaaatggccatactgcccaaggtaatttatatattcaatgccatccccatcaagctaccaatgactttcttcacagaattgggaaaaactactttaaagttcatatggaaccaaaaaagagcctgcattgccaagtcaatcctaagccaaaagaacaaagctggaggcatcacactacctgacttcaaactatactacaagactacagtaaccaaaacagcatggtactggtaccaaaacagagatatcgaccaatggaacagaacagagccctcagaaataatgccacacaagtacaaccatctgatctttgacaaacctgacaaaaacaagaaatggggaaacgattccctatttaataaatggtgctgggaaaactggctagccatatatagaaagctgaaactggatcccttccttacaccttatacaaaaattaattcaagaaggattaaagacttaaatgttagacccaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttccgcacagcaaaagaaactaccatcagagtgaataggcaacctacagaatgggagaaaatttttgcaatctagtcatctgacaaagggctaatatccagaatctgcaaagaactccaacaaatttacaagaaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaaaaacaggtgctagagaggatgtggagaaataggaacacttttacactattggtgggactgtaaactacttcaaccattgtggaggtcagtgtggtgattcctcaggggtctagaactagaaataccatttgacccagccatcccattactgggtatatacccaaaggattataaatcatgctactataaagacacatgcacacgtatgtttactgcagcactattcacaatagcaaagacttggaaccaacccaaatgtccaacaatgatagactggattaagaaaatgtggcacatatacaccatggaatagtatgcagccataaaaaatgatgagttcatgtcctttgtagggacatggatgaagctggaaaccatcattctcagcaaactatcgcaaggacaaaaaaccaaacaccacgtgttctcactcataggtgggaattgaacaatgagaacacttggacacaggaaggggaacatcacacacctgggcctgtcgtggggtagccgggagcggggagtgatagcattaggaggtatacctaatgtaaatgacaagttaatgggtgcagcacaccaacatggcacatgtatacatatgtaacaaacctgcacattgtgcacatgtactctaaaacttaaagcaaataaaaaaacaataataataattaaaaaacccaagatggattaaatatttaaatgtaaaacccaaaactataaaaaccctagaagaaaattgaggcaatagcattcaggacataggcaaaggcaaagatttcatgatgaaaatgccaaaagcaattgcagcaaaagcaaaaacagacaaatgggttctaattaaactaaagagtttcctcacagcaaaagaaattatcatcagagtgaacagacaacctacagaatgggagaaaatttttgcaatctattcatctggcaaaggtctaatatccagagtctacaaggaacttaaacaaatttacaagaaaaaaaaaacattaaaaagtgggcaaaagacatgaacagacacttctcaaaagaagacatacatgcggccaataaacatgaaaaaaagtttatcagctgggtgcggtggctcatgcctgcaatcccagcactttgggagactgaggcaggtggatcacctgaggtcaggagttcgagaccagcctagccaacatggtgaaaccccgtgtctactaagaatacaaaaattaaccgggtatggtggcatgtgcctgtaaatccagctaccaggaagctgatgcaggagaatcactgaaacccagcaggtagaggttgcagtgagctgagatcatgccactgcactccagcctgggtgacagagcaagactctgtctcaaaaaaaaaaagttcaacatcactgatcatcggagaaatgcaaatcaaaatgacaatgagctaccatctcattgtcagaatgcttattaaaaagtcaaaaaacaacagatgctgacaaggttgcagagaaaaaggaatgcttttacattgttggtgggtatgtaaattagttcaaacattgtggaagacagcgtggcgatttctcaaagacctagatgcagaaataccatttgactcagcaatcccattactgggtatatacccaaaggaatatatatcattccattataaagatacatgcacatgcatgttcactgcagcactattcacaatagcaaagacatggaatcaacctaaacgcccatcagtgatagactggataaagaaaatgtggtacatatataccatggaatactatgcagtcataaaaaagaacaagttcacgtcctttgtagggacatggatggagttggaagtcattatcctcagcaaactaatgcaggaacagaaaaccaaacaccacatgttctcacttataagtgggagctgaaggatgagaacacatggactcatggggggaacacactggggtctgtcagcaggggtgggaggagggagagcatcaggaagaatagctaatggacgctgggcttaatacctaggtgatgggatgatctgtgcagccaaccaccatggcacgtgtttacctatgtaacaaacctgcacatcctgcacatgtactcctgaacttaaaataaaagttgatgaaaaataaatactgaggtctacttagtcttttcaaataaacaggttactctttttttttcttttattataccttaagttctgggatacatatgcagaacgtgcaggtttgttacataggtatacacatgccatggtggtttgctgcatccatcaacccatcatctacattaggtatttctcctaatgctatccctcccctagcccccacctcccaacaggccccagtatgtgatgttcccctccctgtgtccatgtgttctcattgttcaacttccacttatgagtgagaatatgtggcgcttggttttctcttcttgtgttagtttgctgaaaatgatggtttccagcttcatccatgtccctgcaaaggacatgaactcatccttttttatggctgcatagtattcaatggtgtatatgtgccacattttctttatccagtctatcattgatgggcatctgggttggttccaagtctttgctattgtgaatagtgctcccataaacatacgtgtgcatgtgtatttatagtagaatgatttataatcctttggatatatacccagtaacaagatggctgggtcaaatggtatttctggttctagatccttgaggaattgccacattgccttccacaatggttgaactaatttacactcccaccaacagtgtaaaagcattcctatttctccatgtcctctccagcatctgttgtttcctgactttttaatgatcaccattctaactggcgtgagatggtatctcattgtggttttgatttgcatttctctaatgaccagtgatgatgagctttttttcatatgtttgttggccacataaatgtcttcttttgagaagtgtctgttcctatccttcgtccgctttttgatggagttgtttgttttttcttgtaaattttaaacagctattcttatctaaaaaaataaaaataaacactttttgaaaaacaaaaaagaatgtaatgagacacttaacatgatgttatcctagaaaaaaaaacctttaatataatttaatgagatattttatttgtgttggtgggttatacatgatcaaagtgacagatacaagaaggctgaacatcaaatccagaaagatcagttattttaaaatataactctttgactttgaaatgtactggtttttgataaggagaatcccattattaaaaaaacaagagtgtatacaaataatttagttaaatagaattctgctttataagatagttattgcataagttgatattatataaattattaatattttaatttaatatcacttgagtattgctaagaccataaaatcatttttatacctgagacgttgatgttttataccaaagtacttttaagaaatcagtgactattttgaaaacattgacatcaatcttaaggaagacaaaattagcaattatatttacatgtaacagaactgtctggtatgtaaaaggtaatgagttccatttctgtgactcatctacttgtggatcatgaaaagtttgaatccaagaacatcaaaagccctctaaaactagtataatcacactttttaaaagagatacatttctttccaatcaaacaagattactcaggtcattttcatccttctaattttataggtgaactcaataaatgtttatagatggttattatctatttagaacatgccataaaatgtgcacgtgcgcgcacacacacacacacacacactgtgactagcattaccctttaatgtgaatttacttagaatactttctattaacttctttagcaatgtacttgactaaagcaaaatatctattagtttcagttagaatataaaaagtagtttccccatgatactctctctgtttataagcaatatgtcagcaacctttgtgattagcaagttttaagtgaccaactgtaatgttccattgttatagagcaaataagggttataaactagcattaatgtatttgttttcaccagccatctccgaaatgaaggtcatttccctattcctactccttataattggataggaacaaaaccttaaatgacttgtgagaactcatttaaaactgtccccaaaaaacttggtgatatgtatgaaaaagtataaaaatattcatatcttggccattaacttttacatttgtaactaattctagtgaaataatacaaattgatgacaaaaatgtatatacaaagatgttcagcagagcaatatttataataggaaaaaaatagaaacaccctaaatgtccaaaaatgtgaggctactttaaaaaaactgtagtgcagccatatcatatataagtaaatagcagctttattaaaccatgcttacaaataaatagggaaattattaaaatatcatttaaaatggaaaagtgggattaaaccctgcatatatagtactagctccacttgttaatatatatatattcttcatatatatatatataatatatatacgtgtaaggatatatataaagaagatatattctttaatattacaaagtacaaagatgataaaaatctcccacaactttattgtactggaagtaaacgcaccaaaacattaatgtttatctcttggtaaaattatgagtgtttttattcttttttttaactttttttgacattccaatttttttgtgaacttcattagaaaaacaaatgagggtttttctttctttttttttttttttaaacagggtctcactatgttgcccaggctggtctttaactcctggacttaagcgatcctcctgccttggcctcccaaagtgctgggattatacacatgagccactgcacccagccttttttctttttaacatgaaactgtttagtgagtggctaagacggactttaatgaagtctccacagtcatctagtataaatttcacaccagatattagtgccgttaagactgccaaagttaactattaaggtatcatcagggatgcacatgttttgaattgtctttcgagtagcagatatcaacttgtacaacatgtacaaattgataaaaatatgtaaacttgtaaaaatatatacaaagtctattctcagagctactcccctccccacatccatctcacaaaaaagataagcagaacatatttaaattatctgaggaaaggtcggcatagtttttcacccaagtaacccttgggttctttgagtccctaggaaaagggacttgaatcttgtattaggaggcaagatgtaaggcaggcctaaaggggagttccctcacaaattgtgggttaatgacaaaaatttaaatctataccactgcataagtttcttcaagccctgctctaagaaaatccaatacatgaaatctcgacttacataataaaaaaagtcagagaatcattatgcatatcatcaaaggattattcaccttatgaaagacttcatcacagaattcctttaaatagctgcttttctcatacattttagtattttaaaggtagtttcccatttggcaaatgagatgccatgtgcctgaggcaagttagtgaaattctctaggcctcagtttcctcatctatgtaataaagatggttttaaccatgttacctgcctcattcagttttcacgattatcaaagaagataatttatataaaggtactctgaaaattatatatatatatatatatatatatatatattattactgctattcttgctaaaagagaatgtgggggaaactttcagaatacatactttttcacatcttaacaacacacatacctacttttcacatcttaacaactctttaaaggacaattttagatgacatatttatatataaaaatcaaatcttttattcttcattattcatttttcccacatatttttcattcttctgcagttactatatatcataatttccatggtattaatacctggattatgagaggctccagtagcttctccacggtgaatgtttggacctgcagatcctgaggatcgatattcaatgtgattggtgtttcagctgacatgctgcctgtgcacaaacacaaaaggatgcttattaataaagaaaactgttttctaaagaagaacacttatgaaatcatggaataggtaaaacttgtattcagcacctcttcctgatatcaaccatagccctcagaggaccaggctacaaaatctaccttcagagaaagaagatattccccaactgttccctgaggtcatgctgcctgggcttaggtcctgtaacaaattaatctacacaagtatgttcatgattaaattaacaactcatccggggtgggtttgtatttgatcagtagtcttaagtgatcagaaaggtaagacacatcttacagcattcaagtcctttggcttctgtgaaatcacagcactgaggcagcctatgcccatattttgcttcttcttgttaatgatgacttagacaaggaacaagtaaacctttgaaagacatgggaacaagtaaagatatgtccttacttgatttagagattgtttatttgagggttttgattggagaaggttaaaggcaatttaccttcttggacaggaaaagaaactaatacaaattgcacagttgttgtaaaaagagagaagcccctgagaaggcattgatatttggtcaagacaaaataagaagaaaaaaaagaattgcaagccattctctaaggcattaacgttatccttaaaaatcaattcagtgagatttttgcctaacaatatacatttataccaaatgaccatatgtggcatgtcatagtcggattaacgttcaaaaactctagccatattttcaaatagctataatatattatttattaatctactaaaaactacagtaagtgttaagaattttagatgaaacccactggcatcgttgattgcaaagagagagcacacttcctgaaatgtagcacatttctagatagttctctttctcttattgaaaataacccaaatggcctgcccagggccccatttgccccttcaaacctgccaagtgtgtccttgttcctagtctgtgcttaactctatcacaagccacttacagggtggctacaattcctttactttttgaaagattttgccttgaaaaaataattattcaaattctattaagtgaaaagatattacttgagtttcttctcaaatcaaagtttcaaattactgttattggcatatgatacatcaacatataaagtcaaagccctacaatttagccctgttttaccttgtttctctctcctttgcgttgatttcattctccttctaaaagtagaaacatggtctcttttctcagcgattcagctgcaatgtaagagacacgcttcaagaaaggctccaaacactattgccaaatggtttctctcaaatgcatttctagaactgaaatgttttagtttggtttggttttgattttgctttttcaatcatttcacctaccactttgattccttctaacacagggaaatctaaattgacagatagcctattcctgtggtgacctttctgcatagcccagagccaatctgtgcaataggatatgtccttcagtgtatagccttagggttctatcaaataagtgctcacaaaagaatttatttgttactcctctacgacaggtactatcctacataaaaatcaagtcaagatttctgccattgctttgttctttcatctgaaggacaaaagtagaggagactgttgtgaactaaaataaaatttggtgaaccttcgcagcctttaaaaacatgtcattttcaccgtgaaattcacgactggtttccaaagctacatggccaccagaaattgaaagtaaggaagataaaaaattaaggagagcaaaaattatccatatcatatgtaaatccttctagaagaatttttcaacctagaaggagctttctaaaaggagtgctttttagccaagagataaaagacaacctaatttagccaaagtatcttttaagtctgtgttcatgtctttaacacaaattaagtaaaagtttttcaaaagttcatttttccatggtaaaaattacttaaaaaaaataaatccttaaagaacttggcttcatataattattaatctttaaataaatgctatttcttatttttaaaaagtcttcctgctcttttgtatgtcctggtcagtattcctgactgattggaaattagggctatcataggcagaaaactgcataattttgcaaatgaaattgaagcaaagtcaaaatctgacaaatttgtagatatagcaataccacaacgcaaatccaaaacaaaaatcctactaggttgtaagtattacattctgaggcatttgcattttattttgttttatttttgagactgagttttgctcttgttgcccaggctggagtacaatggcctgatctcggctcaccacaacctccgcctcccaagttcaagtgattctcctgcctcagcctcccaagtagctgggattacaggcatgcacctccacgcctggctaattttgtatgtttagtagagacagggtttctccatgttggtcacgctggtcttgaactcctgacctcaggtgatccgcccgcctcaccctcccaaagtgctaggattacaggcgtgagccaccaccctggccggcatttgcattttgtaatctataaaatcttaggagttaggcagtacctcccaaacgattcaagaataccttctacacaaccttcatttcaccaacacactgggcttggatgaatagaaatgatgagaagcttactataccattagatgctcgttgagttgaaacctgccacttttaaacttttatccaaaagagatggcttaataaaggggaaaaagtacgctttataaataaagtaagaaaagtacagatttggagagagactataacaaaattccagttttcagaattaaaggaaggagaacaaatctcttgacagtggtgatagatgtctccagagaaagacaccaaggcagggcaaacccaaccatatggatccttcccttctccccaaactatctttgtctgcaatgactcaattttcttcattccactttattccctgctggaaactgaacttttatcattttatatcaattttaagttcatttggtttaacacacatttcatttctaaatgcagttaattctgagaggtcatggggtgcacacattcagtcacacattagtatgaactagctcattgcttgccatttgacaccctgtgcacgtctctattacagcacgaaccacgttgtgttttcatcgtgccctggcagcaaaggagagggatgatggaagatcagagagatgcacagagaggccagtggaaaactattcatttccaaaatttgcctaagggttgccattccctcacaaatattaaacagaaaacatttggcacctacttctcctccctacagtaacacataaccaccaccccctcccccactgcctccccactcttcaccacccactctagagctcaggctcctcttagtaaaactacaattcttttacataagttgtcatgttcttgtgggatggcttggaaacctaaccatctgtaatgtggttcctatagaaaattccctaatatcaaatatttaatttaaaaaaaaaaagattaacttttgtaacacaattagtttgtaaggtgatggctgattctcctttaagcttattaaattccatgacacagtcatcatacttacctaattagtctaactttatactcacttttcaactaaaatgtttaagtcttttttatttcaaagattattgcaaactcaagtctctcatcacatctttaaacaaatgatttttatttactcctaaatgcagaattttattttgtcttcctaacaccttatcctgtagaatatggacttttattcctgctagtcaaaaattggtttgggagaacccaacacattaacaccccctcccatttccctgtttatccattaatttgtccagtatgaattctagaattccctattaagtcattaaacaggtgaaggccagacataaaacctaattttgatactgttacaaatctctttccagatatgtaatgatcaattaataaacactttagacatgattttcaatattattaaacactgttgtgtgaaataatctacctttttcatttcgtcaaaaatatagatatatcatgaagaggcttttcccaatgttttaatgaaatagaaacaccctttctacaccttcctgtttaagagctcaaaaaatatatatttatagtttggcatgacttgttcgtgaagaattcatgctgactgctagtaattactgccctttatttacaaattaggtttttagttttcctacagattggcacctagatgtccagtctaattaaagagatcatctttttacctatgttgaaaataagaatatttgctcttctctatgtattagttcatggtgctataacaaatatatcatagactgggtggcttaaacgacaaacatttacttctcacagttctggaggctgggaagtcctagttcaaggtactggcccatctggtgtctggtgagggccagctttctggtctgcagatggctgccttctctctgtatcttcgcatggcagatagcagaacacatcatgtctcttcttataaggacactaatcctattgatgaggactatacactcatggcctaattagctcccaaaggctccaccattctaatatcatcaccctgggagttaggatttcaacacatggatttgcagtggcaggtggggaagatacaaacattcactccagagcactctgctttctggcaggtctaccatttctcagggattcccaagaaagtttctgttatcacatctaaagatcattttagggttcagggatatactccttttggatgtatgtacttcaactaatttaaagagactaggctatcttctttactttcatcatctagagtttcaattattgtttaattaattaaacattttattaggtaatacaaggtttaataatgtatatagtgaaaccaagtctctctctctctcatccctgtcttcctaccacctaatttccctcccagaggcaactactttgggcacttactcttatagttccagagatatcatacataataccagaacatatggatttatatatttaatacgaattataacatttttgtttttctactcaattcaattcccttaatctttgttccacccttgccaatttgacatcatagtttagatgtatcataagtcatctattaatcccttatcatgtgactaatgtagaggatctattccttcctgtttttgtttttcttaccttcagcatgtcctgccagacctagcaaatgagaagtgctttagccttcccaactttacttttcctagtttctgccattctcttttatttgccttcagtcaggtgtccctgtattaagctattcttgtattgctataagaaatacctgagattgggtaatttataaagaaaagatatttaattggctcatggttctgcaggctatacagaaagcatggtgctggcatctgctcagcttctagggaggcctcagggagcttttactcatggcagaaggcaaggtggggagcaagcatctcacatggtgagaacaggagcaagagagaaagagagagaggtgccacacacttttaaacagccagatctctcaagaactcactcactatcatgaggacaacaccaagaggctggtgctaagccatcatgagaaatccgcccccaaagtccaatcactccacaccagaccccacctccaacactgggaatcacaattctacatgaaacttgggtggggacaaatatccaaactacatatgtccctcttctcatctttaattcatattctttcaaatttgtacccctacacagatacattggagtttggggttgtttatgttgttgttcaacaactatttatggaggacttaaacacatcagccacaatcttaggttccagtgaaagaaaatgtagtaaagcccaggccctaccaactatgcatcttctttcttcatgtttaatttatcacattccttttatgtcatatatagtcccttggaatcatatttcgtgttaatctgaaattgttgaaatttacttctcttaaagtctaggaggcatgtctaacattatcttatttgggattatcacccaaataaatggccactttctctataaccctgggcaaaagcttccccaccccctatcctcatgctttggaagtgtccatggggccaagatgatgcacccacccagagcccacatctattctatcctatcctacccagggtagccagtgtctcaactccctgctcaacgagtgcaaacccacttccagtgcctatgttggcctcttcgtggaatccatccttccaagactgaaccattcaatgtgcccaaccctatacctgagaggtagccaaaaggcagctgtttgccaatgagtgcagattgagtttgggtgtacaggctgggctgtcaacttgcaggcactcaaggcccctcaagtgcaagacagccagaagtgggaagagaagagaacaggccatgtgtcagggacacagaggtgagctccacctccaccacctccttctaaaaggaacccaaggattctaaaaccaatcttgccttctgggttatttgaaggtatatttctcaaagtagaaagattggcgagtagagcctactttagcagcctattacatagaattgtaacttatacacataggcatatggtgtgcaggcctccgtctgtaccctcacacttcccaatacaaacgttaaagataggcctgcccagactttctagcactccatatcaccaagtggtcagatttgcttctttcattgtttcctcaatatgccaagatatataattgccaaagagttaaggtgaaaagtcatgttattccacttttttttttttttggaggcagggtcactctgttgcccaagctggagtgccagtggcgtgatcacagctcaccactgcaacctccacctcccaggcccaagcaatcctcccactcagcctctcaagtagctgggaccacaggcgcgcaccaccacacctggctgttattccacttctaagagaaggtttcttaaaatttttagaatgtgtcatctgttactgtaatagttttttaaatctggaccagtaaagttactgaagtattaagctgtgtgacaatatctcttctcttacttctctttcctccatccaaatgctctctgttattattctttccttaagcttctgatttccatgcaagagtgtgcattcactatatgtgtatttctctacctcttttattaaaattattttgtgaacattcaaaattccattcatgagtaaataattaaaggttaaatagtcgaaaacacagaaataaaaaacattcatgatttattagtatatctgtgattatatttaatttgtgttctcccaggtaactattcttatttattatcgaccttctcccatgttttctcctgataagtactatacatcatctctattaacatggttctttctatgccctgattattgtcataacactaacacatacacacaggtgtgcacattcatatatgtttgatggttttatctggaaataagtgtctcttcctcaagtttaaactattctgatcatgtcaacaagtcttccaccaaaagtatctttgggcttcatggattcacagtggatctcatttagtgaaactctatttagttaaatataaaagagaaatatttgtattaatagtaggtgccaatccccaccatcatcacaaatgttaacctttgcctaatacctgtctcccaaaatatcagaagaaaggatcagcaactagtgaaagactgtcaagtactgaaataatgttataaaagagtattttaaaaattttcattaagaatttatcttgaggtcgcgtgcggtggctcatgcctgtaatcccagcactttgggaggcagaggccagccttccactacaatctcctgaggtcaggagttcaggaccagcctggccaacatggtgaaaccccatctctactaaaaatacaaaaattagacaggcatggtggcatgtgcctgtaatcccagctactcaggaggctgagacaggagaattgctggaacctaggaggcagaggctgcagtgagccaagattagaagatcgtgaaacagagcgagactccgtctcaaaaaaaaaaaaaaaaaaaatttatcttgaatgcataactgaactttataagcctcgctctcccccatcaccatgcctcagaaaaattagtataatatagtcaggaataatgtgaaggattgaaaccagatgttaactgaaaaaaaaaatctaaatcatcacaagaagatttaagtaaaggaaaaggaggcaagggaagtttgccatacaatattatcatagctgattttatacaattgagtcttggctagagtgaaataaaatggaaagaagacaactgtaatataaaacttccactacaatttctatacacactggttttccaagccccacctccatgtttccagtgcaataatttgctggtatgtttggcctaccaagaaagaaatacatacaccttctactctcttggtaaacaaaaggatctgaggtttgtcagatcaataaaatcaagaaactgcctgatatcgtaagtgatgaaggaatagttgggtctcattcttttcaaatgctcttcctggactttacaaatatttttgatgtgtttacatagagggcaataatctatataaactctcccacctagctttttggtaggctataagagcaaaatgatgtgagatcagacgtatccctagactatagggcatcattcatttattcattctttcaacttatatttactgactatctactctgtgccaatcacgaggagagtgtgaccataaacaataaagataataaatagtaaatgatttcgtatattagaaaataacatatgccattttaaaaaagaaaaagcagaatagagtaggcagggctgggtgatagggaagttcagagcagatttcagtattaaataaggtcaagactagcctcattgagaaggggacatctgagcaagactcgaagaggcaagaaaattagccaagcagacagccgggggaagagcactgcaggcagaagtaacatcacaacagaagcctaaggcagaaaagcagtggcagaacagcaaggaggccagtgtaagcagggcagagtgagctacaaagagcatagtaagagagaaagtcagaaaggtatggaggctgcagatcataagaactattgcagatgtttgagcactaaaacatcaactgttttatttagaggaatcactctggtgaatagaacgaagtacgaagggcaaaagaaaaaatagggacagccattgggagttcccatagtaacctagatgagataaaataatggcttagaactggttggtggtagcagaagtggacacagggttcagattgtagatatagtttgacaattgagacaacaggaattcatgaaagattaaacataggctagagagaactcaagatatctttaagtttttcgatctggagcaactggaaggatagagttgccattaactgaggtgggaatggctgcaagaggagcaggaagaagaagagtccagctggggacatgataaatttgaggtgcatattaacatcaaagtgaagatgtaaagtaggcagttagatatacaagagcagggtttgaaagagaaatctgaaatgaaaatataacttttggagttgtcagcataaaggtagatacaatgagactaccaaggaagcatgtagactagaaagaggtaggttgaagtccactattgcaagtgaatggaaatacaggcagtgatattcagagtatgactgtagaattgagatttgccttcaggtgaattaaaaaaatatgccccttctggacagatggattagaaaactgaccaggcacggtggctcacacctgtaattccagcactttgagaggccaaggcaggtggatcacctgaggtcaggagttcgagaccagcctggccaacatagtgaaatcctgtctctaataaaaatttaaaatattagccgggaattgtggtgggcgcctgtaatcccagctactcgggaggctgaggcaggagaatcacttgaacctgggaggcggaggttgcagtgagctgagatcacgccattgcactccagcctgggcaacaacagtgaaattccatctcaaaaaaaaaaaaaaaaaaaaaagacaagacaagaaaaaaaagaaaactgtgccactctctgagtagacacagccctgcaagtgttagcagaaaggcccacagtttgcccagcagagggagggctagatttcatctccactcagacccttagcagggtaatatgcagcagcccatgtgagacatcctttcgcttcaccctgcaacccccaccgtctgctaaagagttcttaaattctcttacctctcaccactattgggcctcagtgattatcagcatcagctttaaagttggactgcctgggtgagaatccaggctctgttccctgctcgctggtgactttagataaattactgatctttcctgaacatcagtttcctaatccataaaatgagaataataagagtacctacctcaaaaggatcttaaagattacctaagaaaatctatataaaatccattaacttagccaatatctctgacacctggcaggggctcaacaaacattagttgatatcattatccccttttaagtgaaagaacagaatctacttgtctacattcagattaaacctctccctcatctatagacctcataattattattcaagagtgctttcattgattgttttcataacaaaagactttaaaacaaagcttccctccggtggcctcattttattggatttcttgacttcaaaatcaataaggcatatttcctacatgtgcactaattagaaatgcaacatgcctaaagtactgtcttaaaaaaaacaaacaaacacattcctaatgcacaacagcctcctaaaggatcttgagccctttgaaatcaattccagagtggtacataaaaggtatgccccagggttagggctacaactgttagatgcactaagtgtggggaactccaagagtctgtactttttatttccttagcatccaaaatctctgaatttcaacagaacaaaacaatattacattttagaacaaaaggtaaatatcattagcatgttgtaattcaaactttataagcttgagtatttgaagttctctttattaaacctttagatagccatcttattgatgtttttgaaaaatgatcaaattgagcctcccccaaaaatgatgagttttatgaattctttatgaaaagattcaaacaaaattaattaaattaaaaaatgtgtttactctagccagagcaaccaaaattaaacatgtttcctcacacatacaaccaaaatgaaagcagcaaaaaaggtaaaaaaaaaaattactttaaccaatatgaaatatgaaaacaaaggaaaacaacagattctacttatatttaggtcttacaatgtccttctgatcatgaatagctggtcaaatctaatctccctcttaaaaaaagcaaaaagtcataattcaatttctgacttacctgaaaagtaatattgtacatgagaattccacaagatgactttatgaccctgacaacataccatttagttattttataacatgtcagttcatactaaaagctcaccacaatggcacacattttcaaaattgcagctacagagaaagaacagaaatgccccatggtcagttactctatgtagcaatgccttctacttaaggacattttgtaccatataaaaagtatgccaaaatggagacccatcttatataagcccagcatgaaggttacctacatattttttaaaagccatagaactaaattagtcaaattgaagtcaaagaagaagctaatctaatatatgagacaacagaaaagctttcactgaatcaccagaacaagaataaccttcagctacaaggcatcaactttaagcaaccacggcagaagtaatgtgcccttcacatacactttgaaagtgacagaggcttctgttgctgcaagtccagtgagcctatgggtccatcccattccataatattgtaaaacagctcaactgtatatgaattctcgtaaggtctgatatttttaaaaagcagagaacaaaaagagaatggcaaaggtagtagaattctcatcaacctcaatgtgaagccaaaaaattcccatttcttctttgttctctgttcagctagaaataaataaaagcctgcttatcagaataaataaaatgaaaccaaagtccttgaaaaacactatattcatttttctgtaaatcaataaatacacttaggaaaacaaatagtatgtaactggggaatttcagcttcttctgtgtctcctagttttccattctgtcataatccttgaagagaattttaaaaagtctctgctagaatctttaaatctaaccatccaagttcattatttatcaatattttcttaaagtttctccaggaacactagctaaatacctattaaccctacttaactgtttcttattacacatgttaaatatcctctctataggaaatagatgacttttctcccctggcttcaaaacaccaccctcctgcttctccccaacaatttagaattcaagaaacaaatggaagcaagcaacaaaacattagtaacattagaagtatcccatacacatggactgagaacacatttggggacatggtgggcagactagcaatttgctgtggaattacacagcaaaaaaagaaaagatggaaaagccacaaacactcatcttcactcatctttcatagcaagagattaatagatactatttgaggttgaatgcaatttctcattcatggaaaaatatgtaaacttaaccatgtaaaaagcctcccaacctcattcataataagagaaatgcgaattaagtccgggcgcagtggctcatgactgtaatcccaacactttgggaggccgaggcggtggatcatgaggtcaggagatcgagaccatcctggctaacacagtgaaaccccatctctactaaaaatacaaaatattagccaggcatggtggtgggtgcctgtagtcccagctattcgagaggctgagacaggagaatggcttgaacccgggaggcagagcttgcagtgagccaagatcgcgccactgcactccagcctgggcgacagagcaagactccgtctcaaaaaaaaaaaaaaagagaaatgcaaattaaaatacattgagatattctttctcacctttcagattggcaaataccaaaatttttataacaaactgttagtaaggctgcagagaaacaaatactcttataccttgcttgtggatatttaaaacattatccctatggagggcaaatatgcaatacatgtatatgtatatgtatgtatttaaactttgacccagcaattcagtttttaggactctaccacaaatataaaaataaaaagtgatgtattcccaaggcaattaattgcagcaattttactaaaacaaaaaaaaaagagagagagagaaaaggaaggaagaaagagaaaaaggagggagggagggagggaagaaagaaggaaggaaggaagggaagaaagtcaggaagttaggcagggaggaagggaggcagggagggaatgttggccctttcttcacatcacatacaaaaacttacttgaaatggatcacagagctaaaggtaggacctaaagctattaaacttctagaagaaaacataggaaaaaaatcattgtaaccttggcaaagtcttcttagatgcaacaccaaaagcatgatccataaacgaaaaagttgataaactggacttcatgaaaattcaaacttcgtgaaaatacaaaccatagacggggacaaagtattttgaaaatctacatatgacaaaggtcttgtatccaggaaataaaaagaacccttagaactcaataattaaatgaaaaacaactcaactctttaaatgggcaaaaaaaaaattgaaaagacatcttaccaaagaaaatatatacatggcaaataagcacatgaaaaatgttcaacatcattagtcactagagaaatgcaaattaaagccaaaatatgtactcctccacacatgctagaatggctaaaatttgaaagattataaatactggagctagcaaagatgagaaacaactggaaatctcacacattgctagcaaaaacgtaaactggtacagccactttagagaaaagcttggaagtgtcttataaagttaaacatatacccactctatagctcagcaattccactccttaggtatttagccaagagaaataaacacttatgtccatatagatacctgtatgcaaacattcatggtggccttactcataagacagtcatccccccaatccttgggggatatgttccaagacccccagtggatacttgaaacctgggatagtaccaaaccctatatatactatgctttttcctattcaacacacatataataaagtttataaattaggcacagtaagagattaacaacaataacataataaaatagaatgattttagcaatatattgcaataaaagttatgtgaatgtgctcactcattctctctcgcaaaatatcttattttgtgtcatatttttgaaccatgggtagctgaaactgctaaaagtgaaaccatggataagaggggactactgtagtcagaaactagaaacaactcaaattttcatctacaagtgaatggataaacaatctgtggcacaagaataccatcacatgttatgcaagaagaaagaatgaaccaagtatacatgcaatgacatgaacgaatatcaaaagcgttttgctgagtgagaatcagacataaataagtacacactatatgattccatttatataacatttttgaaaggacaaaaatacagggacaaaaaacagattggtagttgccagatgccaacagttgatgtaatcagttgactgcagaagggcacaaagaaactttttagcatgttggggatattctatttgattgtggcggtgatggttctataactgtatatggttgtcagaactcatcaaactgtaaactttaaaggagtgaatttaatatggtatatataagttatttctcggtaaatttgacttttaaaaacatcttttgtgttcatctcttatcccagtggcacagaaatatttctacattatttcattcactatataattacaagtttccactgatatcctttggctccaggagctcttccttaagttctctgaattaatactttcaaaagttgattcactttttcgaagtgtcttggcccttcttgtacatctgtcaatttacagtatttggtgcctaaaccctacctaacttcttaatagtattcattcccaggcttcacacctgtgtgttcaggttattctcaatatcatcctgtgcatctgatcagttatgtgttatatatttgatttataatttttctggcaagaactctaagtcaacctatctatgtgtttacaaaactacaaaaacaagagctttcagtatttgtttttgtactgctttaaaaaaaaatttctttttatttttctttgtgtgtgtgtgtgtgtgttaaagctagctgaggttttattttggaccaaaaaaaaaagcaattgaattgttttgtagctggaggcatgggcaagtgcggtccccagtcagtaaactctcccgtgggtgggctgaggggctagggctgagcctcaggtgggtctcctcttccctgtgctcctctgcacaacggcctccctcccaggatctggggcagccgcaggaggggcaggctgggaggggctgccgcagctgttgacttgggcaggacgtcagaggactcggacaccagcttcccatcgcgggtctcggtcttcttcacaaccacagccctggtgaatcatttcttattgaccttacttttaacaacgaataaaaaagagccaaatgactgtccctggctcatcatgttaatatcagaagacaacactgaaaatccttcgcaaattttaactactaccctcttgtcttttttcaattctgctctctgacagcagcgagtttctaagctagttcacttagacaagcccagtttagtgagtacaaggcccagagtccagaatcttcaacatagtaggtgtcctgcgagtatgtgaagatgaaagtacattataaagtcctgtctctggtttccttctttctacccaacaactttttttacaagttagatcaatccagttaattttgaccttactgaagttgaaattcaagttaaatttactgctagattaaaagtgtgaaaagaaggaaagtagctaatcccatttacaacaatttattttttaaaattgtaggactagtattcatacatttatacaaaattgctaaatatattttattttaaacattgtcttgatcatgtctgttctattatgtagatattttatcttatttagatcactctggtgtttccaaaaaactaagcttctttaatctctcttctgaactaaccaaatttttttctgaacatttggggccacatttactttcacataagttagtgtgtgggttaaaagggcagcatttcttcactatttttcaccaaaacacgagtgacatttaaagcatatttaatatttataatctaatatactctcctcattccagactgccaccaaggtaagagaaggcaactggtttgtatgaaactccaccataagatttctgaaaccctatattttctctctcatctatccataatacaccagagttatcattgagaattgctgcatttattttattgttttttttcttactcctggctctgttttatatcccacacttgttttctttcttctttcactccacatttaatttatcctatcttgaatttcatgtagccttataagtcaccttaaatcctttctagaacaagacaaggaataaataaagagtcattctaggtatctgaaaaagcaatcttttctcatttaccttagataaagccttacaactttaacttcttgctgcctcttagctatgctctaccgtattgaatacacaagtatcaaaaatcatgagtttctccttttttgctttaccaattctctgtttaaaaatatttaagtctgcgcacaaaaactacagggaaaaatccatgcacaatttaagtttaaaagcccataacttttaattaaaagcaattaaattatttgcacaaataacctactcgctgtacaatttttgtgtctaaagtatgtaaagtttctagtgccttgcatacagttactcaatcattatagtaatagctcagttacagagtaggagtttttaaatgagctgatgtaagactactatagcttgggtattggcacatgagaatctgttttagtgctatttttaaaaccactaataaacagcagactcgagcctctgctcaattgaatctgcctgagttgtgaaagaaaaaatgtgtaagagaaccacatttttatctaaatctgaaatgcctgctaatatactcggaaaagtagacatttaaaattggagctttcataaaatagtctagagtttagtgttactaaaacgaaaattagttataaaagtaaaaattgcacaacataatagtttctattcatcccattttatagaaataatgtcctttcatttcccccaaagttatctaaccgagcaacagataatctataattactaggatttgccttatagcaaagtttgatttttaaaagtttgacactccactcacctactgcaggacagagtattgcccatatacagatactaaaccaattgtctaagcaatttcttgtatttagaaattcagtgccactatcatggctcacaatttggcttatgatgcatctgtaagcaaacagcctgacaagcaccctagtgtatttcaggatgactgacaggacacagtggcccaagcaagaaggggggatgggtgctcttaaagcaacatgccagtgaagggtaacatcaaacagcagaatcagacctgaaattctatttttcagatttacaatgaaataataatacattacccactatcaacttctaaatacaacttgcatggtcattatgtacccaaaacactgtaaatcccaaagtagaatttttgagaatttgtaaaagtagaaagaaaaaatataaaacaggcatgttatatgatacttccctgaagcgatcaagctttcaggttacttaagaatatgcctgttatttttaacagaaattaaatcaggctatccacagaaaagccattctttcttttccttataatatcaacttttattttagattcaggaagtacttgtacaggtttgttatatgggtatactacatgatgctgacatttagggtataattgatcccgttacccaggtagtgtccagtggtggggtgagaaaagcagttcttatctcaccttcatatatttgtcaatagctcttacaacagtaatttaggaataactaatgaaggtaatttaaatatcttgaattaatctgaattgttattgaggataggggccagagattcacgtattttccccctactgcattccttccctatgacctacttcatgattaaaatatagaccaaaagattcagaaattctacttatagatatttctacattaatttcactttagaaaacattttagtaacatattggcttcattcttcacatttacaattttttcctatattatttcacaatactctgcactgctcaatccttttataatagagcaatcatccatattttaaaaacaaacaaacaaaaaagccaagtcactcatttttaaacacaattcctcatttagccagcagagggtattattagattctgaaagcccacatattgcacccaatgacatgtatttttatacttcagctaggaactgggacacatcatctcaactttccttagtaaatgtgcttagaaatatcccattttattttgcccatataaatttgacttttagagcccagattaatgcttctcatctgtatcacactaccattatttcctcctctatctgctccaacagctgcatcctctgaaaaaaagcactagaagaccaagaagtggcagaattaccaagaagaagcagaattgggttcaatcatcagaaagacttcccacaatcctaaatttttctgggacaaacaaatgaacaacaatcttacataaagattctaagctccattagaaaatcgaaaacaaatcctgaagaaaacagaactaaattacaggataaaatctctcttcaaaattatatgacatttgtaacctctttaactccctgtttaatatttgctaaattttcattatatattagaagccacagactaattttaaagatatacttcctgttattacagcattaatatatttctcataaacatgcggtattatgactaacaaagttcccttacaatttataggttctttatttcacaacttaacactcacttagtgtggaaagacatggacagcaatttgcctgatttattctaaaaataaaaattttactatctaattagctaaaatcattaacttccacaaatttatcttggctgaagataaaaaattttctgtttctttgatgcaattatatcacaaacatcaagttaactaagttaactatggcaaaagtgaaaaagcaatttcaaagagcaatctctttttcctgctctcagatttgccactaatggcacatcctctatgctaaagtactaaattttccaaagagaaaataaatgttaattctcttcctcaattgtcattcaaaataaaaaattataggttattttcctttaaaggggaattctatttctaataataaaaacaagcattgggttcttcattgaaagaaactgctctataagatcgtctctcatactcaaatgtggcagtttctttcctcatgtaataactaacaatagccaggtaaatatcatattttacatttggaaataaaataggatacctcttaattatattcttttatgaaattttatatcttcaattttctaaacagatacattcgctgtaatataaaatagatacctgggcttttttctcaaattaacttataggataacccactattcagaataaaactgaaaagtcagttttgccagtaatttgcttatcctttttgccaatcatccacacattttggaatatgtatataaataattttgttattgttgttgtttctagttacccacttaattctactttacttttcagctctgagtttggtacctgacacaggctctcctgaactatgtctcactcaatggtttttggttttcgcaggtgccttaagaacctacatctaaaggccttattagcctcaattctatttgtagattaaaaaaaattaaggataacgcttaggggtagggagagattgaataagcagtgaatagatactacttacttaaaatactcctttttacttttagcaaaaatgcctccatacactatatgctgtatctgaattttcaatatattttatataggcaatagtccccccttatagacaaggtatgtgttccaagacccatagtgaattcctgaaaccacagatagttctgaaccctatatatgtttttcctatacctgcaaactatgataaagtttaatttataagttaggcaagaaattaacaataataattataaaatagagcaattataacaatatgcttgcatcagaactcttgcgctttggggctaggccacgacagtccatttgaaaatctagatggcctctaggagtgactaatgggcaggcagcatatacagcaggacatgctggacaaaaagatgattcgtgtcctgattgagacataacaggataacacaagatctcattgtgctactcagaatggcacacacttaaaacttgtggattggttatttctggaatttccatttcatattttcagaccagggttgaccttgagtatctaaaaccacagaaaatgcaaccacagataaggggcctactgtgtttcttttttttttttttttttttttttgagacggagtctcacactgtcacccgggctggagtgcaatggcgtgatctcggcttactgcaacctccgcctccccggttcaagtgaatctcctacctcagcctcccgagcagctgggattacaggcactcgccaccatgcccggctaattttttgtatttttagtagagatggggtttcactatgttggccaggctagtctcgaactcctgaccttgtgatctgcccgcctcggcctcccaaagggcctattgtatttcatttatcttcaaaacaacttattattcccctaaattacagcagtgggctcttagcaggtaatattcacaccaattgacaggtatagtgcaagctcggactctgacataggttaggtatgctaagtttgaggtgcagtggcatatgcaaatagttatgtcccatgagcaactggaaatgcagaatccatgaactttggagaaaaattatgcctagagatacagatatagtaacctgtccatccatgttacactctaatccataagagtagatgagctctcccaagattaactatagaaggaatgaggcagccacattacaaaacaagtacagtgaagaatatgatgagaagaaatgtcataataagaatagtaagaaatgcaaaacaaactgggttcaaattcaaactcactttaccctctttggcctcatccacaatgaccccaatttaccctgttttcctgatgtgaaatgagacctataaaacttctatgaagagtaattacttataaaattacacatagaatataatggaatgctaattaccatgccaaataattcatttatcaattattgttattttgtggaaagatacttttctctttgtgaaattctgcttttcaaaaccaaaatgccattgaattttagagggctgctgtgaaacacatcaaacagattgcccctttgatttttaaatggatagagaatgattatgtccacacagctttatttagcaaattgaatccatgccatcaatggaagtcttctactccatccacgttaataatttataattggatagcaagaaaacctggtactgaaatggaaatatgtttagagcttcttccaaagttgcaacatgcttaataaattaaagggacactaacacatattaataaactgagtattttttggaagagtgggtatagaatggttaaagatagaataccgaactaaacacaaacaaatgacactaagaaaaaatagaaacctctgtgtcttgttcccacataagacttgtggagttgtgccaacctgcttcattccagagcagagagccactcagtcactgaggctatattagaaagagaggaaggaaatccttttctcccacactctctgtttccaaagataataacagaaaactagagagtgatggatttcactactaagcagccatgtctattttactcatgtctttcattgactctctaagtctagttctactgattttgcataatagaacaaaagaaatatatgtacaaaaacaaaatcaattttgcaaaacttgtaatatccctaaattttccaaaatataactgctatagtcactaaattaaaactataacatcattcctattaggtcatcaattgtattcaaaagaatgaagcttatcacagagaaaggtaaaataattaaattcagtcatagagccaatgaatcacacttcttttacttcaaatgataaccctgccaaatcaaacagtctgagtaacccacacacacacatcccaagccaatccacttttatccccctgggtcttgggtgcacagaattagactgacacaatcaatcatggtcctaactggtggactagtctatgaaaagcctgttttattttttgttttcatagtctatattccctgttctcagttccattcccctctctgcttcttatggtagttaatgggtacatttccaattaaacttccgtaactttttttacatatgctatatacgtctacaagaatatataactttatgtgtatggatgtttaaatttacacaaataatattgtatttcccatctctttctacttctatctctctgtgtctgtttcattgtgtggttttgtttttttgtttgtttgtttgttttttggtctatctatgttggactataaagatgtggtaaacattgcatgtttgctcactcagcacatagtcccaaccttattctcccttatctttctctgctatggaggcaggacatttgatttcccagccttctttgcaactcagaatggcatgtgaaagaattctggccaatgagacggtaaagcttttgctttccctatcaaaaggacatcagcatccttgccatgtcttccttaacctgactgtggtaaggtgcctggaaataaaacaatcttactgcaaagctgaagaggaaggatgacagagcagaactatagaaagaacttgggcccttgatgacatccgttattaacttcttttttcttaattttattattattatactttaagttttagggtacatgtgcacaatgtgcaggtttgttacatgtctatacatgtgccatgttggtgtgctgcacccattaactcgtcatttagcattaggtatatctcctaatgctatccctccccgctccccccaccccacaacagtccctgaagtgtgatattccccttcctgtgtccaagtgttctcattgttcaattcccacctatgagtgagaacatgcggtgtttggttttttgtccttgcgatagtttgctgagaatgatggtttccagtttcatccatgtccctacaaaggacatgaactcatcattttttatggctgcatagtattccatggtgtatatgtgccacattttcttaatccagtctatcgttgttggacatttgggttggttccaagtctttgctattgttaatagtgccacaataaacatacgtgtgcatgtgtctttatagcagcatgatttataatcctttgggtatatacccagtaatgggatggctgggtcaaatggtatttgtagttctagacccctgaggaatcgccacactgacttccacaatggttgaactagtttacagtcccaccaacagtgtaaaattgttcctatttctccacatcctctccagcacctgttgtttcctgactttttgatgatcgccattctaactggtgtgagatggtatctcattgtggttttgatttgcatttctctgatggccagtgatgatgagcattttttcatgtgtctttggctgcataaatgtcttcttttgagaagtgtctgttcatatccttcgcccactttttggtggggttgtttgtttttttcttgtaaatttgtttgagttcattgtagattctgggtattagccctttgtcagatgagtaggttgcgaaaattttctcccattttgtgggttgcctgttcactctgatggtagtttcttctgctgtgcagaagctcttgagtttaattagatcccatttgtcaattttggcttttgttgccattgcttttggtgttttagacatgaagtccttgcccatgcctatgtcctgaatggtatcgcctaggttttcttctagggtttttatggttttaggtctaacatgtaagtctttaatccatcttgaattaatttttgtataaggtgtaaggaagggatccagtttcagctttctacgtagggctagccagttttcccagcaccatttattaaaaagggtatcctttccccattgcttgtttctctcaggtttgtcaaagatcagatggttgtagatatgaggcattatttctgagggctctgttctgttccattggtcgatatctctgttttggtaccagtatcatgctgttttggttactgtagccttgtagtatagtttgaagtcaggtagtgtgatgcctccagctttgttcttttggcttaggattgacttggcgatgcgggctcttttttggttccatatgaactttaaagtagtttttcccaattctgtgaagaaagtcattggtagcttgatggggatggcattgaatctataaattaccttgggcagtatggccattttcacgatattgattcttcctacccatgagcatggaatgttcttccatttgtttgtgtcctcttttatttcattgagcagtggtttgtagttctccttgaagaggtccttcacatcccttgtaagttggattcccaggtattttattctctttgaagcaattgtgaatggtagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtgtttgcccattcggtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggttctgtttatatgctggattacatttattgatttgcgtatgttgaaccagccttgcatcccagggatgaagcccacttgatcaaactaaatctattatattagttaagaactcatttttatcacataacaagaagtctagaggtaagaagttaataacggacgtccgttattaacttcttacctctagacttcttgttatgtgataaaaatgagttcttaactaatataatagatttagtttgttcctttattttccattgtgtagcattctatcacatgcatttataaatatattttgtgtccatatcactaatcaagcacgtttcggtaatagccaactctttgctgtaggagacaatgctgtaataaacattctcatacatgtctctttgtgtgcctatgcaagagtccctctggtgtatacattctgttatgggctaaattgtatctcctcaaaattcctgtgttaaagtcctaaaccctagtacctcactcacgatatgactgtatttggagataggtccgttaaagaggtgattaggttaaaatgaggctgttaggatgggccctaattcagtcatactggtgtccttctaagaagaggaaattaggacatagagaagaaaagacatcaggaatgtgcacatagaggggcaaccatgtgagaaaggtggtcatctgcaagccaaggaaagaggcctcagaagaaaccaaacctgccaacaccttgatcttggacttatagcctccagaactgtgaaaaaataaatttctcttgcttaaagatcccagtctgtggtattttactctggcagtcctagcaaactaatacaattcagaagtagaatttctgggtcagaatgtgtgttcagtttcaataagtattgtcaaattggtctccaaaaaacaccaccagcagagaatgtaggttcacatgtccccacctcctcaccaaaacaagatattacatgacattttaactcccatcaacatgggacatgcaaaggagatatcacatcactattgttttgatttgcacttctgattaccagtgtaaatgctaatctctttttagttgattagtcagccattcaaatatcctttctatgaattgcttacttgtattcttcacctgtttttctcctaggttgcctgttcatttccttactgacttcaaagaattccctatatattgtaaatataatcttttgtcagtaatattccttgaaaatatcctctccctgcttcatatgtccctctttgtctaggataccttcccttgaacattgtaacatctgtatatgaaagttccattttcttcatatccttacacattctaggttattgccatacattaatatctaccaatttaatgagtagataaagtatcccattgttgttttaatgtgtctttacccagtaactagtgaagaaaactaagtttcttttgacttatttatgggtcattctagttttcttttctgtgaattaccttttcacatatcattgaccctattggattgttcgttttttgattatcttttccttattaattttttggagtttttaataaaatcttatgataaatgacttttgttaaatgatgtatgagtcaactattttgacaataacaccatataaaaaaaactaccactgaggtttagaactcagtggcctaagaaaacatttattatttcttgtggattttcaggttggctaaagattggctaattcagaatggacctggcttagcttgccccaggctatagttttgggatccagatctgctccacatttttctcatcctccttggacaagtaggccacttggagcatattcttctcatgaacagaaacacaagatgggcaaatggaaacattgagtacctcttaaggtgaaggctcaaagttggcactctgccttttctgcccacattctaatgggcaaagcaagttatatggccaagtctaacttttctgcccacattccgacaggcaaaacaagtcatatggccaagtctaacattaatggagcagggaaatacactctgcctctagcaggaggaattgcaaagacacatggcaaaggggatggatatagggagcaagaggattgggaaacaacaatgcaatccactttatatggatgaatgtaaacataccctgtcaactggtagtttttgtttctttttattgttttttcagtcttttaattaattaatttttgcattaatgtaataatttcagttttttactttatggctatgttttgggagtcttatttaagaaattatgtcctatcctaagatcataaatatattctatattttcctctagaatgcaatcatagggatcaataaccaatatattttaaattagcatatgcctaaatgtaagattatatcatataaactaaaggccgaggcacccaagttaagtaatcaaaattaaaaatatttacccaaggatggctacttatttcaggttaattttttagcttggtctttaaaatatattaatgatacaggctggcaaagaagagaaagacccaggaattataagaaatcacaaaacttgattgtcttttataaacagatctttattaatctaagcagtataggtatattcaaaaatgcaaagcacaagaacacagaaaaatatatacaatcttctgaggtcatgccactggaaaaggaaaaaagaaactttcacagaactgaacaattataaaatgatatatgttatgatgtcatatttgtaaaatatatgtgtatatgtggtaatagcagggtccacttcaatagttttgggtaaaaatgaggtcattactattaatttttcaagctaaaaccacttcccaattgccagactggcagggaatccagtatctctcttgtctctcaaattgttcaaaaactctgggggcatcttcattcacatgccacagagaaagaaaggcagagaagtggattagaatacaagtgggctttgttgaaggatgctggtgctctgttcctggtacacagtttactgatggaagctgactccccatagttcagtgagaccctttctcctgctgcactctagctgttgctgtggatccagtgagaggccacaatgatttaagacaagcataccattccggcaaatgtatggcacagaacccatgccttcaacgttttaatttaccaagcctagtggctgagtcaggagggccttccagtcagttacacatgtgccagaaacaaacacttctagggtaacataggccacaaggggggttctagtttaagggtctttggtgttctttctcactagcaaattttagtcagtactaatttgatgcaggggtcagaagaactcttcctaacaacagatacattgtaaaaggaaagagtccaggttttcagtcttctcctgtttgaaggctcccagattctacaaatttcctccagtctccccagtgttgaccagccctgcagctgaaacaagactagaaagggcaagctttctcaagttagaaaaagacccttttacgctagtatctgagacacaaaatgataaggatctcattaatgatttccaaacactggaggaaaattttcccttaccttaaggttcacagataaaatacaaaatgcccactttgactttcagataaacaaagaataattttttggcataagtatgccctatgcaatatttgggacatacttacacacgcacgcatgcacacacacatatgtgctgtttccttggaatttaaatcaagagtgtgtcctgtatttttatttactaaatctggccactttaccttatctacttcatgaattataaacaaggaaaaagggagctgaaactcacttgtgtctaaatttgcaacaacctcacatcccacccatgtatcctcacatcctatcaaagacttggggctggcacaaccaatcaaaaagtcagcttgcacccccttacttcaaagaagctgcttttcaggtagccaggggtgtttcctagacacctcctagcaatacatttctaactacactcagccagaagattttgagtcgcagaaatgcagcacaggatgagaggggacaaggaaagaatgacatattgtactctggtatgagaaagccccaaaagagaaggcagacataagaaaaacacagacagaagggtgctctggagattaggttttatgtgtctcttttagaaaggtgaatcgaattgcttcagattatctagggttaaattcacctccaagtagaggaacaaataataggagtaggagaagagttgccccgatgcaaatgtacctcctgtagcccagaaacttaacaagatacttgtccttcactttaagatttgagagaataattctgtagaatcaaaactaatactgattgagctcaaaggctacacatacctcatttctgacaaacaccaggactaaatataaatcttatgtatttcaaaaataacagaaaaaaacaaaatttaaaaatcgtgtaacataaaagaggaagacactttcttaaagatgtaagggaaaattatcaccaagacaaaagaaaatttagaatatatctcttctgtgttctcagtgaaatacccaaaaatgtaaattctaggaaagaagtgatggaaaggctaaaaagaaaagaaagttgactgaagtgacaggtcaagataaaaagagacctggcaaagatttaaacatccaagaatttggcaaaagaaaaagacaatgaagtaattaaaatctgaatcattcctctcctttatctcctgcctctctaccagcagcttcatcattcagagggcaaaagaagcaaagaatggaactgctaccctggatttaattattaccaacaaagaatgatacgttagggaagtgaaagtgacaggaaccttggggaaaattgaacatatcaccttagagttcattacagtaaagaaagaaaacacaaagcaaagtaagacaagtatcttagattgcttagcagttgagagaaaatataagaatgtcccagagccacagactttaaatgaaaaataggtcaaaaaacttaagccattactacatcacacagatggtatacaaggagccttctaaagagctgagatgtttaaagaacacacaaaagaaggaagaaggtaaaggttaggatgaacacatcactgtagtatcagtctattagaaaagtagtgtaaacctaggatgagcaaagacttaaacaacacaaaaacttttaaggttgtgtttgatgatggaagtagataaaaaaggtacaagtctcctcctcccccagacagatttcatattaacaagtaatagagagaaagcaaaataacaatatttttactttgctttcatcttgtctcccaaggagaatggtctttaaaataaaaagattgtaccaacaatcttgagatgaaattgataaacgagaaaggagaaaagatagtaagagaatgcttaacaatttagataaatgaccatttctgggtatattccattaaagcagggtttctcatcttcagtgctattgacatttgaggctggataactctttatggttgggggctttcctgtgtgttgtaaaatgtttagcagcatccctggcttctacccactagatgccaaaagaacctgccccctagttatgacagccaaaaatgtctccagacattgccaaatgtcctctgagaagcaaaagcaccctgagttgagaaccactattttacagagcactgaaaaacatgcacatattatcacagaattcttgctggcatttggcatactaatggaaaatgagagtggtaacagaatattgggaattcacaaatgttttcccatatatcagaaaggtagaatttaaaaagtaaaaccaaattctatcttggtctctagaaaagtatcaaaatattattaattagaaaagagaacaatgattttttgctacattggtataggttcattaggagccactcatagtaaactaacttaattttcttctcttcctttttttaaaaaaatcattgctaaaagataaaattggtttcactcaaacattttttaaatcttttgtgaaattttctttgccaagataaagaaatgtgagctatctcatacactgttggtcaaagtgaatattggtaaaatctctttgaaaagcattctggcagtatccacaaaattttatatgcacgaattattgaacaaagtaatgccacttctagggatctgaacatacgaacaaagatgtatatcacaaactgcagaattgtttgtagcaacaaaaggtagaaacaacctaaatgtgcattaataagggactggttaaataaattgtcatatattctttcattggtctgacttttaattattattagtgggtcagaaaagccttaaaaaatatatagaatctaattggatgtcaattgagtaacagtaggagagatattaaaaatatttaacaaccagcatggctcaggccccaagcaatcagagcttaggctggagctgtcttggaagcttcatcctgtgccaagtgtttacctttcagttgctgggtctaggaaaggtccagggggtctcaagcagaggccaagtgaaggaaaatcactggtaagggtaagggagaagtacaaaagcatttcatattttaacaatttgtatgcctcactagggactatcagtcctcactaacagataaaacattaaaataactcagaataacatggagcaataaattgactgaaatagaacccagatttcaccaatcaatcatggcttgggtgagattttagaacgtcacaggaatcagatccttctaggaaagctgcgatggggcttccagtgtccagcccaaaagcaccaaacggtagaaaccagtacttctgtatcactgtccaatcttcccagctgcattgtctttgtttctctggctctcatggagaatctatgaactacctaatgtcatttatgaaactcttgttgcttaaaccagctaaagtagactttagttataatcaaaaaccctggctaaggtaccctttactaaaataaatatgcatatataactttttactttaagaaagttaatttttataaatgactttttaaaaaagatatgtggactgattagttacagatctgaggaaacacctggttgaagaaataaatccaaaagagcagtatagagatctagatcccaaaagcccatatgaatattagctgtgtatcaaccaccggaggcacttcttaaaaatacaaatgtggacccaaatcaatggctcactttcttacacataataactaattttaaaatatgatggaaggaaagagaccgtttatgataccaataaaaattttttaaatactgatatgaaaacaactttaaaactctactgagggttgtaaaagaagaattaagtatattaaaaagtgatgtataggcaaattgaacattacagaagtgttaattctccctgttaaatgtccacagaccacttgagaacttgataaaatgttaaaattcatctagaaataaatattatgtgattacatctaggaaaatcctgaaaggacagaaaagaatatggagaaggattattccttccagttattaaaacatattatgaaatgaagttattttaaaagtagggattggaaaaaataggaacaaatattaatagaacaggaaagacagctgagaaatggactccaatataaacttagcttatgataaatacggcttttcaaattatcaggaaaaaaggtgattcttaaataaattataatgatcaactgaataaacatttaggagaaaaattaaaaataaagcttactccctgctcactcttttgcccaaattcaattccagatgtagcaagaattttaaagttctgaaagtatgaatatataagtttatgtataataaatgtataataactaagtggaaatttttatgtataatacatttttaaagtatgtataataaatttataataattaagcagaaagccctttctaagcaaaactcaaaacccagaagctataaaggaagaggtttaaaattttgactacaaaaatattttgttttctatataattcaaaaataaaacaaaagtcataaaataaacaacaaattatggggaaatacctggaacatattaaacaggcaaaaagctaatttgcttaatttactatggtgggataaaaagaagaactcagccaggcgtggtggctcatgcctgtaatcccagcactttgggaggttgagggagatggatcacaaggtcacaagatcaagaccatgctggctaacacagtaaaaccccatctctactaaaaacacaaaaaaattagccaggcgtggtggtgggcacccgtaatcgcagctactcgggaggctgaggcaggagaattgcttgaacccaggaggcagaggttgcagtgagccgagattgcgccattgcactccaacctgggtgacaagagcaaaaccccgtctcaaaaaaaaaaaaaaaaaatttagcccagcgtggtggtgggcgcctatagtcccagctacttgggaggctgaggcaggagaatggtgtgaacacacgaggcggagcttgcagtgagctgagatggcaccactgcactctagcctgggtgacagagcgagactctatctcaaaaaaaaaaaaagactcaatagaaaaaattgggcaagtatttgtaaaggcaatttatgtaaaaagaagggcaatgggttaataagtacttagaaattgttcaactatacttataattaattaaatgcaaatcaaataaaacaagatattattttcaccaagcagccaaaattgaaaatttttgatatggtatcatcagtgctgtttaagtgttaggaacataagctcttagtatacactgttgaaggggtataaactgatatgaacttcttgaagagaaatatgacaatacatctcaaattataaattatgtgtactcttgaatatttccaattaaatgtaatacttatgaaattttaaaataaacattcccattgatacagcaattccacttccatgaacgtattctaaggatacactcaaaaagtacaccaggatatatgaacaagcatattcattgcacacagcaacaggacaaacaaacaacaaatactgaaaactacaaacatgtccatcaattcagaatgggctaaataaattctgctacatacacagagtaaaacacgacaaagctgctggaaagaatgaggcaggtctattagaactgctatgcatctgtcttaaccaaatataactgtcttaagcgggaagaagatacaagatcaacctgcataacattatgccttttttttcttgacccaaattagggttctgtcaattagcaagcagaggagaatacatggatattgcataggcaaccaacagtgtctatcacagactatttgattcttaagattcctttgtaatcccacattgggaaaatagaaattgcagagtctaacagaaaagcaagttaatcctgcaaattcccatgaaaacatgacccatgagcttcagccctggactaagaacccaggatctcttctggtgaatctcagagaagttggtttatgtattactctgtcttcacccccatccacaaaaacacacacattagaaaggaaacatcatgaggacagggtctatttttggttcactggtatttatctccagactaagaactatgtctggcacacaagtcatatagaatgaatgaatgaattccaaaccaacattagagtagacccagtgtagcccttcagcaatcctgcctctcagttattctgtgggctcctcaatgagctaactctgggcctctttgaactgatgccacccctagaggcctcatcaactgagaattggtaattcatttattacccagttaattgtataccttcatcccaattctctgccttcatgcatataggtaagagtgtgtccagaattggttccttctggtgggttcttgatctcactgacttcaagaacgaagccacagacactcgtggtgagtgttaccactcttaaagatgttgtgtccagagtttgttcctttagatgtgtccagagtttcttccttccggtgggttcacggtcttgctgacttcaggagtgaagccacagaccttctcagtgagtgttacagctcttaaaggcggcatatccggagtggtttgttcctcccgatgggttcacggtctcgctcacgtcaggaatgaagccgcagaccctcgtggtgagtattacagctcataaaggtaatgcgaacccaaagagtgagcaacagcaaaatttattgtgaagagcaaaagaacaaagcttccacagcatggaaggggacctgagcgggttgccgctgctggctcaggtggccagcttttattcccttatttggccccacccacatcctgctgattggtccattttacagagcgctgattggtccgttttacagagtgctgattggtccgtttttacagagtgctgattggcacgtttacaaacctttagctagacacagagcactgactggtgcgtttttacagactgctgattggtgcatttacaaacctttagctagacacagagtgctgattggtgcatttttgcagagtgctgattggtgcatttacacatctttagccagacacagagcactgatttgtgcgtttttacagagtgctgactggtgcgtttacaaacctttagctagacacagagtgctgactgatgcgtttacaacctttagctagacagaaaattctccaagtccccacccaacccagaagcccagccggcttcatctctcaatcccccctctaaacaggacaccccaactgcttttgggaattgggcgatgaccgctctagctacttcctgctggataggggcaaagaaggggcctgccctgcagttctagtttcctccagaggggatctctttaggccagtgaaagggccagcgggtcactccaggggtcctcagtagaagttgttagttgagctcatttggggttccatttgtaagaccatctgtaacttgatggccttgattctagaggaaacaaatttgacgaagaggttaaaaatacagggcccgaaggtgagtaatagcaagattgctgtcatgggacctagaaaagggagaagccatgttgcccaactccagaggttggtataagagtttgaaaggtgttgtctgatttcagaagccttttcctgtaaacgctgggcggcatcttgtactatccctgactggttagtgtaaaagcaacactcttccgctaagaaggtgcaaagtcctcctttctcagcagtgaggaggtctaagcctcggcagttttggagagtcactgctgccgaagagtctatttgggattgtagagtaaggatagattttgttatttcttgcaaactgtctgagaaatcctttgagagtgtgtggtagtaggataatacatgttactccgttaacttttagcaaactttacttttgttgaaaaccttgtaagtttgggattttaattattctttgctattaataaaccctcgttcagtccatattaacttagaattggtatagatggctccttcctgattctgtaagtactttaaggtttagctgagtgcaaacagcttgcacatttaagcagaccaattattaggcaattttcctaactctgcttctacaagagtttccttatcacttactgaacacccattgtctttttcccttaatcgcccaggaggaaccatctatcgtcctgtcctgaagggagttcctcctaggtctggttggacctttgtatggtaattaattatgatttagatcccctgttaggaaacttgctgtgttaaggattttagataggaaggctatgggttgtcagtggcctcagtgctttcgggctacacccttgtttacactgacaacaaggtggtatttgagtgttatagggttacagagaagaccttcaattatcaattataggtttttaatttaccctggcttttaaaggaatagggtacactgttttttctttactacttctatctctctctttctccctctttgatttcttcatctgtctgtctctttctctctgactccctctttgtctcttcctctttccttgtttgactttctgtctctctgtatcttcctctctctgtctctctctttgactccttctttgtctctgtctcttcctctgtctccttctctttgtctatctgtttcttcctctctctctttccttctgtctttgactttgtctctctctttctttctctccatcttttctctctggtggttttggcagtcttatactccttgggtttttgcattgtatgcaataactccagggtttccttgtgatatttaatgggggttcccccagaggttaggaactccctttctttccatattgcagcatgggcatgtaggattagataagcatacttgctatctgtatacacatttattcttcttccctttcccagttctaaggcttgggtaagtgccactagttctgctaactgggtgctggtccctgggggaagaggcttagtttcaagtactgttactatggcataacctgcccttcgtatcccattctccacaaatgaactttcatcggtatataggttaaggtcaggattagctaaggggacttctaagagatcatcttgggtggcataagtctggactataacctgttggtagccatgcttgaccagctcctcatcctctggtagaaaagtggcagggctgagggccacacatgtatgcacttgaagcactggtccctcaaggagtagcgcctggtatctaagcaggcggttgtctgataaccataaacttcctttggcacctagtatgccatttacattgtgagtagtccagacagtgagatcctttccttgtattattttgatagcctctgacactaagacagccaccgccacaactacctgtaaacagtgaggccagacttttgctactatatcaatttccttacttaggtatgtcactgattgtggggttgtcccatgagtctgagtaaggaccccaagagctattcctgctctctttgtgatgtataaagaaaagttttgtcctgtgggaaggcttaaggatggaccttgagtttgttccttccaatgcccagacttcagggttgattccctcctcaagcaggggacaacaaatgggtaacttgttccccatattcatagataatagctccagctttggctaatatgtccctccctaataagggtgtgggactttcagacacaacaagaaaggcatgtgaaaagagcaaagtctcccagttacaactgaggaggtgggagaaatacctggttacaggccatcccaggattcctcagatggtaacggaccttgaggacagctgtccaggacaggagattaacactgagaaggccatgccagtgtccaggaggaaatcaatttcctggccctcaatggttaaacatacccggggctcagtgagggtgatgacatgagctggcacttgccccgggcatcctcagtcctgttgttggatcatctggttgggggcttctggcccagagaaccattgtactctggggcagtgagccttccagtgattgcctccgcatagtggacatgggtgagggagcagcttatttctagtaggacaatcttttttaaagtgtccttgcaaaccatactgaatacaagccctaccaggtgattgacctgctctattttctgtcctctctgaaccaccaaggtttgtttgtctgagggccatgactaaggctgtggcctttctctgatcttgcttttctttttgggcctgtttctcttggtccctattatagaacaccgaggttgccaggtttaataatgcctccagattttgttcagggcgcaaggctcgcttttggagctttctcctgatatctgtggctgattaggtaataaacttatcttttagaatcaattgaccctcgagtgggtcgggtgacaggagagtatattttcttaaggcctcccatagctgttcgaggaaggcagaaggattttcttcctttccctgagttacggtggacatcattgaataattcacaggctttttcctaattctccttagtccttctaaaacacaggtcaacagatgtttgcaactccagtccccatgatctgagtcgaggtcccagtggggatccatactggggatggcttgctgaccagtagggaatttgcccctttcttcgactgtcattctatcatttacttgactaagataccaggtatctccaaactctcgggctgcaactaaagccacattcttttcattaaaggccagagtttgacctaatagcatgatatctctccaagtgaggtcaaaggtttgccctagaccctgtaagacatctatatacctaacaggatcatctgaaaacttccccagatctgccttgatctgctttaaatcagagagggagaaggggacatgtacccgggttgggccaaattcccctccccctacagcttgaaggggacataaatgatagctcaggggtttttgtggtcctttggagatttctttgtttgtttccttctgggtgggggagattagaggaggcttatcattaataggaaggggagctatagggaggctaggatatggaggtaagctgagaggtcctcctgtgggatgtaaattgcaagttttgcatagttgtgtattctccttcaatgaaaagaaagcttggacataaggtatttcactccatttgccttccttcttacagaaaaagtcaagctgcaggataggattgtactttatacttccttcaggtggccatctttcccatcagagagagaatattggggccaggccatagtgcagaaaaaagttagctgcctctttttcagggtttgcaggtcaaattggtcccaatggcttaggatgcatttcaagggtgagcctgttgatgcctgagtgtttcccatctgaaagacaaaaccacccttggtcttggtttgtttctacccctccccaagaacccacaatagtccctggaccctgctgattggaatagttgcacttactgatgcagcaacagaaacacctcttgcccaagaacccgcaacggtccctggaccctgctgatcagaatagttgtgctcaccgacgcagcatcagaaacactagttttcctcttagaccaaaaagaggaccgaggaaggtcagatttagtggcccttactgatgcattctcaaaaacctgcattcttgcctgtcctcttagaccacaaagaggaccaagaaaaattggatttagtggcccttaccgatgcattctcaaaaagctgttagagtcctaagcattatcctgttagtattgggaccttaccactgtcctataaagatgttatgccccaaaaatgaactggacggacataccctgagagagggaaaggatctccagagttggaagagtgatgctttttgtcctcacttatatgaataggaaagataccatttccgaagctccccatatcctagcttcaggaatagcttttgttaggcctgcttgtctgaagagggatcctaaaattccagatagtcccttgcccagatgggactttgggcaaaaattatgtctttctgattggtgagcccgggtgcctaaagaaggtaaaagagtcctgaagtttatactagaaatcattcttataggagaaactagaaaagcaccagagacagggagtgctttttagaagtggactagcctcagagaagagaggcgagaggaagtttgtctgacaggcattaggacccaggaggcaagggtcaggagataggatagatgggcaagtctcgcttgggtgacatgattttgagagttccactcatggccgcagggtcaaccaacttgttgttgggaccccggagctgaatggctttcctctctgtcaaccctcggctcagcctggaagtaccattaaagtggaagctggctccaggcaaaccaacattcccaactccatagagtcagggattgttagagagccctatcccagaaagcctggcacctgtgtctttagtccagcggccgcgctagttgcttttagctgaccgacaggtgcccagtatttacccccagaattctaaggaaaaacaggacagaatagcaagcaaaaggggtctgatggtactcatcacttggcaataggcgagagtcccatctgggttgccaaaatgtgtccagaattggttgcttctggtgggttcttggtctcgctgacttcaagaatgaagccgcagaccccacggtgactgttaccactcttaaagatggtgtgtctggagtttattccttcagatgttcatatgtgtccggagttactcccttccggtgggttcgtggtcttgctgacttcaggagtgaagccacagaccttcacagtgagtgttacggctcttaaaggcagcacgtctggagttgtttgttcctcccagtgggttcatgatctggctgacttcaggaatgaagccacagaccctcacggtgagtgttacagctcataaaggtagtgcggacccaaagagtgagcagcagcaagatttattatgaagagtgaaagaacaaagcttccacagtgtggaaggggacccgagcaggttgccactgctggctcaggtagccagcttttattctcttatttggcccccaccatgtcctgctgattggtccattttacagagtgctgattggtccattttacagagtgactggttctgtttttacagagtcctgattggtgcatttacaaacctttagctagacacagagcgctgattggtgcatttttgcagagtgctgattggtgcgtttacaaacctttagctagactagacacagagcactgattggtgcatttacaatcccttagctattcagaaaagttctccaagtccccacctgaccctgaagcctagccagcttcacctctcaagaggagataaatgtttatacagtgtaacttaagcaacgctactcaaactgcaggtctgcgatgagaaaaggagcttgtaccagaatgtaagttaatgagtgcttccttcatctagaaagtcttgctacagcctctccctctccctctccgtctctgtctccctctccccacggtctccctctccctctctttccacggtctccctctgatgccgagccgaagctggacggtactgctgccatctcggctcactgcaacctccctgcctgattctcctgcctcagcctgccgagtgcctgcgattgcaggcgcgcgccgccacgcctgactggttttcgtatttttttggtggagacggggtttcactgtgtcggccgggctggtctccagctcccaaccacgagtgatccaccagcctcggcctcccaaggtgctgggattgcagatggagtctcgttcactcagtgctcaatggtgcccaggctggagtgcagtggcatgatctcggctcactacaacctccacctcccagcagcctgccttggcctcccaaagtgccgagattgcagcctctgcctggccaccaccccgtctgggaagtgaggagcatctccgcctggccgcccatcatctgggatgtgaggagcccctctgcctggctgcccagtctggaaagtgaggagcgtctctgcctggccgccatcccatctaggaagtgaggagcgcctcttcccggccaccatcacatctgggaagtgaggagcgtctctgcccggccgcccatcgtctgagatgtggggagcacctctgccctgccgccccgtccgggatgtgaggagcgtctctgcccggtcgccccgtctgagaagtgaggagaccctctgcctggcaaccgccccgtctgagaagtgaggagcccctccgcccggcagccgccccatctgagaagtgaggagcccctccacccagcagccaccccgtctgggaagtgaggagtgtctccgcccggcagccacctcgtccgggagggaggtgggggggtcagccccccgcctggccagccgccccgtccaggaggtgaggggcgcctctgcccggccgcccctactgggaagtgaggagcccctctgcctggccagctgccccgtccgggagggaggtgggggggtcagccccccgcccggccagccaccccgtccgggagggagggaggtaggggggtcagccccccacccggccagccgccccatccgggaagtgaggggcgcctctgcccggccgcccctactgggaagtgaggagcccctctgcccggccagccgccccgtccgggagggaggtgggggggtcagccccccgcccggccagctgccccctccgggagggaggtggggggtcagccccctgcccggccagccgccccctctgggaggtgaggggtgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtgggggaaagattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacatgtgctgtatccactcagggttgaatggattaagggcggtgcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaaaaaaaaaaaaaaaaagtcttgctacaaagtgcttagggtgtagctgatttactttcaggcacaagcctcttatctcgtttcatagattagttaaaaattgggaacttctaattacattttgaacagtgctaatttaaagtaggggcctccattgttcaagttccagtatttgagagactttctttgcactaaacattgccttctccttcaaatcaatttccccattgccaggaggcatctgaagcagaaaatcatcctggttaggataatgaaaggcaaagaaaagaggtggggagggtgccaaataaacttgacctaatcttccattttgcacacaggaactcaaagtcacctatcatatgctagaagctagtgattaaattggttacagattactcgctgaatcccaggcaaaaataatgtggttaaaaacagtatttaagcatgtgaaaaatcagatgtatcggctaacagtcctgttcaccttcaaaaattctgcagcctcaattatctgtcactttccattagatttgcaactttgctaaactccggagttccaccccgctgtaccatctcacttaaaatccagtatccaaacaagaatcagaaaatcacactttttaaatctctagactagcattcccatgagccaatgatccataaataaacactattttcaagttttcattacaaagcgcataatttctcttcaggccagtttgggttgccaacttctcttcttaaatcttaatcccttctattccaaaaaaaatagaaacatgcaaacagaagttcatggggaatagagaatgaaactcccatccttctgtagctatggtttttctctaaatattattactgaataataaaaacttcacaatttaaaaagttttttaatacaggaagaatatattatttgataattcataactctacctctcacttcacaccacataatattgatatctctaatctctccactttgattacttgggaccagtaaccacttccaataattagttgtatttatcactaattccttagctttcttccttctactctatttacacaacatggttctcaaactcaacaatgacagaattaaaacttatcttctctgactcctaccatagccacgcctaattccattctcatgttttccctatagaaaaacccaatactgaattgctcctctagcatgtgccctctatcccttttctttctagtctgttgcctacagattttctccaaatacttctaatttctccaaagattcacaataagtaaagaatttattcttcctattcctatttctttgtcacagttgtatcataaaagtcatataaatcactatgtctacatggtcttctaataaagttacttatacattctgttattttcatgtgcaaagtaacgtaagtgatcaacaatactatctatcggtttcaggcagagctgaagtattttcaactctgacatgtagctttgttgatatctgtaaaagtttattgagtggaaattttgtaggtaggagagattccatccttctaaacactaagtattttggtatctatgtgcctgataacaatgttttgcacatcatagacaataaatatatcatttggtagactaggaattttacaatgctttaaaagaataacagtaaaaacacatcttaaatatcacaacttttaccttcaaacatagtgttctctaatccaacacttctacagttagaaacagagattaaggaaattatcttaaacatatctacaacatacatatacacataagtaaataaatacacaaagatgtttaccatagcatctagatgttcagcaatgattaataaaattatattcattcacttgaacaaatgttacacaaatttaaaataacaccactgtagaataggtaatattctgtggaaaatgttttggtatatggttaaatgaaaaagcaaggttccaaattttatctatactattattgcaattatttttaaagccatctagaaaaaaaaagactagaaggaaacacatcaatgaaattacaggaaatatttttctgtgctttcaaaattcctacgatgaacatttaatgcttttataatgaaaaaaagttttaccaatctttactcaaataggaagatttagactatgtgtaggaggtaacaaatgggaataactttgtctatactgtctgtattttaggtttctccatttaacaaacttgtcctatggttctactgagataattttttataatggacaatgaaattttaatagcacactcaaatatgccattcaaatctgaccatggataatctgaatcttcaaatcacaactattctcaatatgttgagctttcaatctgtctaaaaagctagccacaaacccagaaccaatgcaaacttgaaatcctgctttttccactttgttttaagcaaatcattgcattctcacgttatctccagagatcttagtaggcacatatcagtgactcaaaacctctacagtaaatgaactttctgatgtctaaccccaatttcttcttgtttccatttgaactcatttcttttatttgtcttccgtgtaactgacagcagctgctcacaatcattcagatcccattagatagtgaccttttctttacatgattgatcattacatctcatgatcattccatacagtgattttcatttgactataactggtcatcaaacagttctgagagcattcctcaacctcttaatattccttccaattataaaacaaatagacattaaattcagaaattaatgctttttgccattatctcacttgaaacatcttccatttactatgaattagcttttggttgaaagtaaaatcccttcaaacatattccatctttgcttccttttccccactcccatgccaaagcacaagcatccaggccatatcttatcttttcctgcacagtatccaatcggctttttatagccagaaactctctgaatgcaaagcacgaccttggctaccagcttcccctggcaatagttcgaaagttatttataactttaaaattagcgtgaaagcctacgtttctcataactagtcaaaacattcctatttcatacaataatgtgatcttcctcagttcagaagaaaaccccaaattttaaacctatgattataactaagacacaggaattcaatgcagaaatgagaattcgctgaagttcagctcttctctttacaaacttgattcttacctttctgtttcttcctataaagtaaatgggcttaaaattcagctcccgtagggaattttccaaaaagagctttgtgggggacggaaaaaggcttcttggtggtcacagagttacagagtaccaaattgagaggcagatgacagtggggcagtcaatttcgctgagcgttgttcacccaggataagaaagaaa

SEQ ID NO: 1640 - DNA, 930 bp, Homo sapiens
atggagaataggaataacatgacagagtttgttttgctggggcttacagagaatccaaagatgcagaaaatcatatttgttgtgttttttgtcatctatatcatcactgtggtgggatatgtgctcattgtggtcaccatcactgccagcccatcactggggtcccccatgtacctttccctggcctatctctcctttattgatgcctgctattcctctgtcaatacccctaacctgatcacacattcactctatggaaagaaggccatcctattcaatggatgcatgactcaagtctttggagaacatttcttcggaggtgcagagggcatcctacttactgtgatggcctatgaccactatgtggccatctgcaagcccttgcactatatgactatcatgaaccagtgtgtgtgtgccctgctaatgggagtggtgtggatgggaggctttcttcatgcaaccatacagatcctcttcatcttccaattacctttctgtggtcctaatgtcatagatcactttatgtgtgatctgaaccctttgctcaacctcgcctgcactgacacccatatgctggaactcttcattgctgccaacagtggattcatctgcttgttaaactttgccctcctgctggtctcctatgtggtcatcttgtgctccctaaggactcatagcttggaggcaaggcacaaagccctctccacctgtgtctcccacatcacggttgtcatcttattctttgtgccctgcatatttgtgtacatgagacctgcagctactttacctattgataaagcagttgctatattctacactatgataactcctatgttaaaccccttaatctataccttgaagaatgcccagatgaaaaatgccatcaggaaattgtgtagtagaaaggacatttcaggtgacaaataa

SEQ ID NO: 1641 - DNA, 7703 bp, Homo sapiens
atagtgaaaccaatttattcctcatcaacgttataagtaaacaactttgaacaaaacagtggtgttggaggacctactgtacattgtttccataaagtcaattttcaggcaaacacaaaatgaagtcaggacttcctgtatatgaaaagatggttgtgatttcacctggaaaacaggtttattgctcagaaactaaaggaggccacctaggtagagaggattcagtcgtgatgtttacgctaaacaaaggatcccagaatactcatcattccagttaaaggcataacaaagaagacaatattcacataggaaatgtggaaaggaataaaagccatcaagcaacaaaaataatgtgaccaagggggtaggatttgcagatgtagagatttaatgtgcttgccctttctaacgcacacaagaaaaaggatggaacagatcatgagattagactgttctgctgtgcagcctccacagggcactttgaatgtccctgtttctcaggctgcagatgaaggggttcagcatgggggtgaccaccacagcgtacattactgacgccaccacatcattcctgggggatgatgacacagcggaagtcaggtacacgccaatgcctgttccataaaataagcaaacaactgccaggcgagagcctcaggtggagaaggctttataattcccatctgaggatggaattcttagaatggggaaggcaactgtatagtaacacaaaaggatccctgaaatgcgaagaaaaccaaatatagtactatctaaatatatgtatatgttattgatgtcactgtcagaacaggcaaggttgagacgttgaaacgggtcacagaaaaaattagagatttccacattcttgaagcagatgaattgtaacacaatcaaattgtgcagctgggaatccaacaggctaaggaaaaaaggcaccaaaactaataagacacagaggtgaggattcatgatgcctgggtagttcagggggtgacagatggccacaaaccagtcataggccatcacagtcaggatcatgtcatccttacatgcaaaaaggacaaagaaagacatctgtgtcaggcagtccccatggtagatgactctgctatgcgattgcatctcctcaatcatcttggggaccgtggccgaggtgaaaccgatgtcaggcaaggacaggttggagaggaagaagtacatgggggtgtcgaggtgggagtcagagccgatggccaggataatgagcaggttccccagcaccgtgaccaggtacatggacaggaagagcccagcgaggatgggctgcagttctggatcctctgagagtcccaggaggaggaattctgagacagctgtgagattctgtggctctgtgtcacttggacaccatgagaagaaaagaggattggaaaattaaaagataaaaaccagcacttaatgctgtgtgtgtattttggatacaagcaattcacaaggaacattttcacacttgaggaccacacaccctcagcaatatttctccgttgtgacaaacccaaaaatctcagaattattacataatttacttttttgctattcaactctttctgtacatacctactttagagaaaagccactgaccaatgttagaagatcaaaatgtaatatataacaaatccatgatctcagtaaaatatggcctattcttttcagaaaaaataaaaataaataaaatgttcttctctctttaagaaaaaaaaactcaatctaattgaaagaaattaagaagcagtgaaacacactttattttattctgacactgtgctacaaattcctttgatgtagaatatttataagcactatacaagagctaggactgcattatctaaaaactaaatcaaaccttacagtttttaatcagaagatctttttacgtgctggttacttttcatatttattatcatccttaggttttctgacatcatttcttcataaaagtaaatgcacggtcaaatatgggagctgtgtttccggattcattaaatgtataactcttggccgggtgcgatggctcacacctgtaatcccagcactttgggaggctgagggtgatggatcatcggaggtcaggagttccagaccagcctggccaacatggtgaaaccccgtctccagtgacaatacaaaattagccaggcatggtggcgggcacctgtaaccccagctactcatgaggctgaaacaggagaatcccttagaacctgggaagcagagttgtacaccctgagatattatttttgatatcctagggagatactgcttctaatatcatagtgggcatacaccctgtgatactatttgtaatatcctagaaagatattgctcctaatatcacagtgggtgtgcaccctgtgatattatttgtaatatcctagggagatattactcctaacattacagtgggtgtataccctctgatattattcataatatcttatggagatacaactcctgatatcactgtgagtgtacaccatgtttttacaccctgtgatgttattcttaataacctagaataatattacttctaatatcagagtgggtatacatcctgtgatattattttaatacactaggtagatattactcctaatatcacagtgggtatacaccatgtgtgtacaccttgtgaaattattcttaataccctaagaagatattactcctgatattacagtgggtgtacactctgtgatataattagtaataatctagagagatatttctcctaatatcacagtgggtgaacaccatctgtgtacgctttgtgatgttactcataatatcctagggagatatttctcctaatatcacagtgggtgtacatcatgtgtgtatacgctgtgctgttattcattatatcctaggtagatattactcctaatatcacagtgggtgcgcaccatgggtgtacattctgtgatgttattcgtaatatcctagggaggtattcctcctcttatcacagtgggtgtaccccctgtgatattattcataatatcctagatattactcctaatatcagagtgggtatacaccctgtgatattatctgtaatattctagggagatattactgtatacgctgtgatattatttgtaacattttagggacatatttctcctaaagtcacagtgggtgtgcaccctgtaatattcttcctaatatcacagagggtgtacaccatgtgtgacattgttcctaatatctagggggggagaagatgatattagttccaatagcacagaaggtgtacaccgcccccactctgtgatattgttcctaatttccagggaaggagatgatgacattattcccaatatcactggggatgtacacccttctgtgatattgttcttaatatccaggggtggaaagaatgatattactcccaatatcgcaggaggtttacaccacccctgtgatattgttggtaatattctggggggtagagaatgatattactaccaatatcgcaggttgtgtaaacatcccctgtgatattgtttctaatgtcccgtgaaagagaaaacattactcccaatattgcagggggtgttcacctttttgtgatattgtttctcatatccagggaaataaaggatgatattactctcaatattgcagagggtggacacccctttcggatattgttcctaatactcaaacggggagaggatgatattactcccaatatgaaggaaatgtaaagcacccttgtgatattgttactaatatccagagaggaaaagaatgatattactcccaacagcctaggaaatgtacactcgcgctgtgatatttttcctagtatccggcggagagaggatcttattacttccaaagtcgcagggtgtgtacaccccctctgtgatcttgttgctaatatccaggttgggggaggatgatattactcccaatatcgcaggggtgtacacctccccaccccgtgatcttgttcgtaattccctggattgagaggatgatattactgccaatatcgcaggggtgtacacccccctgtgatactttttctaatattcagggcgggagtggataatattacccccaatatcgcagaaggtgtacattcctcctgtgatattgttcatagtatccagggaggaagaggatgatgctactccctatatcgcaggaagagtacgtcccttctgtggtattgttcctaatatccaaagggggagcggctgacattactctcaatatagctggtgttttccatccacctccccccgcccccttgatattgttcctaatatccaggtgggcaaagaatgaaaaatgagggtctcatggaagtaaagggtagtattgtggataccagaggctgggaagagtttgtgtggggagcaggggtagagagaggcaggtaaatgggtacaaacgtacagtcagataggaggagtgaattctagtattaaatagtagaatagggaaactacagttaaaaataatttactcactttgggaggccgaggtggctggatcacgacgtcaggagatcgagaccatcctggctaacacggtgaaaccccgtccctactagaaatacaaaaaattagcggggcgtggtggtgggcgcctgtagtcccagctactctggaggctgaggcggagcttgcagtgagccaagattgcgccactgcactccagcctgggtgacagagcgagactccatctcaaaataaataaataaataaataaaataataataataataataatttactgtatgtttctaaatagctagaagagaatgtttgaaatgttctcaacacaaagaaatgataaatatttgaggggatgagtatcttaaatatactgatttgatcattatacattttatgcatgtatcaaaatatcacatgtacttcctaaataattattcatatcaatttaaaaatgcttaaagatttaaaaataaataaaatcgagtttgatgtttgtaacttttcttcttatctctattggcatctttctctgagttcatgttacttggttctcttgggccctactgtttctgtttttcatctggcagtttccaaaaccagaacaggttcagagagactctcaagggcctgaatactgggggagaaagccgtatcattacagtcagccacagagaggtcattttcattcgctctttagtgttttttgtttgtttgtgtcttttcactaacattcacgagatctggcatttcagataattctgacaacattcctcatccataacacatgacttggacatgatgattttataatctgtaaattaaaatctcaatatttatttcatatttgtctgctgtttacaagcgttctgtttcccaacttaataaaccttctattctagtcctcaccaagtctgtgcctcttttttttttcatttctctgtttctcttagcagtgtgttaatgaatctgacatgccctgaaaagaaatttagctaataaattccattttatttatttgttttacaatacatagttaaaataatcatacaaatttaggaggctgagagttttgagcccaattcagaaactcagtgtttttgataaagattttatcaggtttctctcctgcttgcacctcagaatgccttggagttccttaattaatatttatcacctcatgctttactaacaaatatgaggaaaataattttgttaaatggatgacacatcccaagaagtcttctgaagctcagggatattacaagcatatgtgcactgttttacagtaatattaaaataaaaataaaaaaagaaatttataaagataacacacaccggccgggcgcagtggcttacgcctgtaatcccagcactttgggaggtcgaggcgggcggatcacgaggtcaggagatccagaccatcctggctaacacggtgaaaccccgtctctactaaaactatttaaagaaagattagccaggcatggtggcgggcgcctgtcgtcccagctactctggaggctgaggcaagagaatggcgtgaacctgggaggcggagcttgcagtgagccgagatacggccactgcactccagcctggactacagagactccgtcccccgacccaaaccctccgaaaaaaaaatctaacacataccaattacttagccaaagcagaaaattatatctaagtttaataatgaatgaccacttttccgctttctgacacgagaaatttcattacacacaagcactctatgtattttcagtaaagctattaagttatttgaatattcctcttttacagattacatattctcaaaatttacctactttgtatttgaattttcatgtagacacctgaagtgtatcttgaagcatgttgcctatgaattaatccactatttttattttatttgacttatgtaaatttaaatgaattacttcattaatctagatactaacctttaataatttacaaatctttaatttcacatcttaatagaccaatgaaaatcacattgtgcacattagtttttatttaataaactaaatctaaacttggtattacatactaataacacaggatttctattcattttatgccttaatgtaggtctccatctattaatataattttattttgggggttatttggatataggtaatccttgaatcttgattctatcattctttccagcttgtttgcttacttttctaactttgggaccttcacagattttgaaaactagtttccacttggccttatctaattactgatgaagaaattgactcaacatagccaatcgcataattttaacaaataaattattcaaaaaccattaaatgaggcaaaacattggttgatagctgcaaattttgagaatgtggtaacaataaacacctaaatgaaagaaaagactagaaattagaaaagttgggcttggcacagtggctcacacctgtaatcccagcactttgagaggctgaggcaggcagatcacaaggtcaagggtccgagaccagcctggccaatatggtgaaacaccgtctctactaaaaaatacaaaaattatcccggcacggtggcgggagcctatagtcccagctactcaggaggctgaggcaggaattgtttgaaccagggaggcggaggctgcagtgagccgagatcgcgccaaggcactccagcctgggcaacaaagcgagactccatctgaaaagaaaaaagaaagaaagaaagaaaaattggaatgcaatagagatagttgcataacaaagagactaaaatattgtctttataagagagggtttcagaaatattgttagtttctaaagaaagaagatgagaaaatcacattcaatacaataattagcagtttcttaatgcttttacaagttaattttcttttgggttaaataaaataaaaatattaggaactttgttttatacaaatgcattgaacaatatgcaagaaaatataataactaatataaatctgatgaatcaggtaaacaattaaatttacataaaaagtacacattcaaggggtgacggacggcacctggaaaattgggtcactcccacacgaatactgcgcttttctgacgggcttgaaaaacggcgcaccacgagactatatcccgcacctggctccgagggtcctacgcccacggagtctcgctgatt

SEQ ID NO: 1642 - DNA, 942 bp, Homo sapiens
ttagaatatatttctcctctgaattttaatcagagctttcctcagtgcaactttgacatccttgttcctcaaactgtagatgaggggattgagcatgggcaccacattagtgtagaaaacagaagaaacttttccctgctccatagatccagaagaatatttaatatacatgaatgccgctgacccaaaaaacagagacagagcaatgacatgagagctacaagtactgaaggcttttgatcttccttgagtggatttgatatgaagaatgctagtgacaatgaaaacataagaaatgaggatggtacaactgggtaccgtgatattagtacccacaacaatgagaacaaccacctcgttgacataggtgctggtgcaggaaagctggaggagggggagtatgtcacacaagtaatggttgatgatattagcactgcagaaggtgagtctaagcatgcacccggtgtgggccgtggctccagccaatcccattatgtaagcagcaaaagtgagcatagaacagacctgatgggacatggtgaccttatacagcaatggattacagatggccacatagcgatcatatgccattgaagtcaacatgtaacattcagagatgacgaaaaagagaaagaaaaacagccgagtcatgcacccaacattggagataatattcttttttgacacaaagttcattagcattttgggagtgaaaacagaggagtaacagagatcaatgaaggagagattgaagaggaaatagtacattggtgtgtggaggtgagaatttagaccgaaaagagtgatcaagccaaggttgcctaccatggtgacaatgtagatcactagaaacaggaaaaagaggggttgccggaactctggatgatctgttaatccagcaagaataaattcagtcactaaggagttgtttctagccagcat

SEQ ID NO: 1643 - DNA, 11931 bp, Homo sapiens
gaagcgtgttcctcgcggagcgccgtcggggccgtgggcgcctgcgcgggccggcgcgggagcaagcggcatggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggtgcgcgcggggctgtttggggccggggtcgggatgggggtcagggcaggtgttaccgttgggatcgagatcgggaccaggtttaaggttgcgatcgggtcgggatctggggtcgccgtctgctttccccagcggaggagccgctttccggggccgctctgcgcggagggttccgggggcggctgacccttcccgccggcttctgtggccgagctccgtcgcgtcctcgcccttctccccgcccctgcgagtccgccctgggtgccatcgccggagcgcgggccggggcgaggctgaggtggaagccgggcctccttcaggggcgtttgcaggagcgcgcccgcgagctgcgtgcggttattgagcgtttgaaatatggctcgtgtgattcctgaagggaatgcttagtttacgtcaatttaaacttaacgcaagcagggccgggtgcggtagctcaggcctgtaatcccagcgtttgggaggctgaggccggaggatcgcttgagaaatttgaaaccagcctgggcaacatagtgagacccccatctctacaaaaaatacaaaaaaaattggccgagcgaggtggcgcgcgcctgtggtcccagctactcgggaggctgaggtaggaggatcccttgagtccaggggtcccaggctgcacagtgtgagccgagatcccgccacttcactccagcctgagcaacagagcctgtctcaaaggaaaaaaaaaaaaagtagtgcaggtttttaacattagttatgtgttgaaatagtatttttagcatattgaattaaaagtatgatcgaaattcacctgtttctttttaatgttgctattagaaaatgtataatttcacatgttgctggcattctgtttctgtcggccaggactgctctagcggcaaggatggttttcccagtcctaactcctcattatactcagtactttgagaaagggggcacagaattatactactgtggttgcgttaggtactttatattagatttttatcttttgttaaccttatttcctctattattagcatcatacactaagcatggtgtatatatcaaaattaatgagccaaaataatatagattaattatagttattatattagtttataatacattactgttaactaaggttcatgtttcattgagatttcctcagcttttacctgctgttctgttctagggtcccacatgacaagtagtcttcatgcctccgtaggcatgttttggctgtgacaatttctcagacttgttttgatgatcatgagtgtttgaggcgtcctggtcaggggtttggtagaaggtccctcaattgagacttctctgaaggttttctcatgattagactggagttacattctttttccttcttttcttttttctttttccttgagacggagtttcgctcttgttgcccaggctggagtgcaatggtgcaatctcggctcactgcaacctccgcctcccgggttcaagcaattctcctgcctcagcctcccgagtagctgggattacaggcacgcgccattatgcccagctaattttgtatttttagtagagacggggtttctccatgtcggtcaggctggtcttgaactcccaaccttaggtgatcctcccacctcggcctcccaaagtgctgggattacaggcatgagccaccatgcccagcctgttatattcttttttaaaaatcagaattctgaaaaatcagaaattctgaatcaatattctgaatttcttaggtctttttaaggaaacagatttactctgccgttaaagaacttgaagtaggctgggtgcggtggctcacacctgtaatcccagcattttgagaggctgaggtgggcggatcacttgaggtcaggagttcgagaccagcctgaccaacacggtgacactctgtatttactaaaaatacaaaaaaattagccaggcatggtggcatgcacctgtagtcctagctacttgggaggctgaggcaggacaatcacttgagcccaggaggtggaggctgcagtgagcccagatcgtgccactgcactccagcctgggtgatagagtgaaactctgtctcaaaaaagaaaaaaaagaacttgaagtagaaccgggagctgagcccagcctttctcttttaagcaggtgttctgtatttgcttgtcatgtctggggagaagtgaattgggccttgtgggttgggaaagacttatacagacagaaggcatgagcaactacaggaaggtgctagaagacagcatgtttcttcttgagtctcacctgtccacacttgaaagttccagagcctcatctggtgaaatctccagcttcttcctggaggtctcatgcagtttacggcttcctgtctctgtgcctatagctcccaaatattttctctggctcagcctgactcccccatacctgccaatttgagtcttggcctggtttatgacaggcccccaggtcggcgtggcccaaacggagcccttgagtcaccaccgtgcccttccacagcttccttttccgccactgtctcagcgagtaaataccagcaggttcgacttttgctattcccagctctgccgcgttgaactttttttgttgctgttgagacagggtctcgctctgttgcccaggctggagtgcagtgcagtgcagtggcaagatcatggctccctcctaggctcaagcaattctcccacctcagcctcctgagtagccgggactacagctgtggaccaccttgcccggctaattttttaatgtttttgtagagacggggtccccctgtgttgcccaggctagtcttggactcctgggctccagtgatctgcccacctcggcctcccaaagtgctgggatccactctttttcagattccagcagctctggaacagaccttcataatgggaatgttttcttcctcactgagtgtttgtttatttatttattttctgaggcggagtctcactctgtcgcccagactggagtgcagtggcacgatctcggctctctgcaacctccgcctcccaggttcaagcgattctcctgcctcagcctcccaagtagctgggatcacaggcgtgtgccaccaagcccggctaatttttgtattttgagtagaggtgcaatttcaccatgttggccaggctagtgtcgaactcttgacctcagttgatctggccacctcagcctcccaaatgctgggattacacgtgtgagccactgcacccggcctgagggtctaaaatgtgcttagtatgactgaggacatgatgttttaattttatttaattttgcttaaattttgaattgaaacatcctcatagctagtggctgctgttgggcattgcagttctaggctctgctgaagcatcatggtcagggaggcccatcttggccccgtggacactttccgcctgcgccccgatagccgctgtcctctttcctagcctggcgttctccgtaaccacagttgcgtttggggtagtctgtctcctgctgttcactgtctgcctctcattagagaagaagatgcacagggctttgcttgtctgttttgctctccagcgcatcactcagaacagacctggcactagctttgtgggagggagagtggcggtatgctcagagaggcctccccagggctgtgccaagggccttgtcttctctccatgctcttcccaaatagtctgacaatttggaaataacatcttgtcagaaaaactcaaacttgggaacagaggtctcaaggacatatcttgtatttcaacatcaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtatgtggtgggttcagatcctctgtggaccctcgtggttatgtggccaggtgcatatctgctggcgccttggttatgtgactgggtgcaggtcctccgccgacccccttggtcagctttcttgaaagtgcttggggcactgggcctcctggggcccatgtccgagaccatcacccctgaatcacacattattaccagtaactgtcagctgaacttggacagaagacaagcttttcaaaatgtccttaccttggccgggcgcggtggctcacgcctgtaatcccagcactttgggaggccgaggcaggtggattacctgaggtcaggaattcgagaccagcctggccaacccggcaaaaccctgtctctactaaaagtacaaaaattagccaggtgcagtggtgggcgcctgtagtcccagctactcgggaagctgaggcaggagaatggtgtgaaccctggaggcggagcttgcagtgagctgagatcgcaccactgcactccagcctgggcgacagagcgagactccgtctcaaaaaaaaaaaaaatgtccttaccttggccaggcacggtggctcacgcctgtaatcccaacactttgggaggccgaggcaggtggatcacctgaggtcaggagttcgagaccagcctggccaacagggcgaaacctcgtcactactaaaagtacaaaaattagccgggtgcagtggcaggcacctgtaatcccagctactaaggaggctgagacaggagaattgcttgaccctgggaggtggaggttgcagtgagccaagattgcaccactgcactctagcctaggtaacagagtgagactccgtctcaaaaaaaaaaagcccttaacttttagcaaatgttggacagatcttgtttgcatgagaccaaatgcagtgcatatcccagcagtgattttatacctgcttgatgccttggaaagcggcgtggcttgtgccctcggctgctcacctggacctgctgccaaagacgcttctctgcggcctgtggcactcacaggcctgatgcctggcgtctgcttgtttgtttgttttgagacatagtcctgctctgttacccaggctggagtgcagtgacgtgatcttggcccgctgcaacctttgcctcctgggttcaagcaattctcctgcctcaggctcccaagtagctgggactacaggcacacgctgccactcccagctatttttttgtatttttagtagagacggggtttcaccgtgttagccaggatggtctctatctcctgaccttgtgatccacccgcctcggcctcccaaagtactgggattacaggcgtgagccaccacacccagcctaatttttttttttttttgtatttttagtagagatggggtttcaccatattggccaggctggtctcaaactcctgacctcgtaatccgcccgccttggcctcccaaagtgctagggtgacaggtgtgagccaccgcgcccggcctggcctctgcctcttaatgccctgttgaacaggcgggactgagcaacaggatcccgcctgtccccactggcagatgctgcatagacagcgtccaggagggtccttccaccttgtccttgtgtccctgtgcaggtggatctgtagaagaaatgcctgcctagagaaggaaatgcagggtgggctaaggtagagtttacattttgaaaagttcttcgaatgggatagtgcctgttcatgcacatactaaaagttcagatagtaaaaatgtgcagggctgtcctccacagacgccgccccccagtccccagagctgtcctggctgcttgtgcacaaagaaagtggagtgacagatgcaggtgtggctgcatccagtggcttcggccttcctgaggcgttttcacctggatgcaaaagctcacaagagaaaaggcatctgcactggtgtccggcccccacatagcagcttggggtgtttaggtcccgctgtgttggcctccgccatggcgcgtggttgggggcctgtgaggctcaggttttggacacagttgagtgagggtgacaaggggggacccagaaaccacccctgggccccaccaagcgccagccaccatccggtttgcttgctgctccattggtggaatcagatgcatgttttttcctgtatgggggtgaagacagttgagtgccggcccctctggcccaagcctcgggcgggcaggagccatcggctgagcttgctgagcttgctgcctgatcaggggtcgtgtttgcgggcggaggagggggtgtttgcgggcggaggagggggtgtttgagggtggaggagggcgtgtttgcgggcggaggagggggtgtttgagggtggaggagggggtgcaggtgcggcactcaggtgcctttcaccttccaggtcgggagcaggctgaactcactgggctccgcctggcaagcttggggttgaagtttaataaaatcgtccattcgtctatgacgcgcgccatagagaccaccgatatcatcagccggcacctgccaggtgagtgctgcgcgcggggcctccatgcttgcagcagtgggcggctcgtggcagggccccggcctgagctcctggccaccgggaggtcacagcatctccgccggcggggccgcctcacccagcgcttcgctgtgcttctctgcaggcgtctgcaaagtcagcacagatctgctgcgggaaggcgcccccatcgagccagacccgcccgtgtctcattggaagccggaagctgtggtaaaaacctccccggggggcagctgtgtcaccctcgccttccctgggcaaagcggccctgctgggctcaccatccaccacgtgcccggccgtcccacgggcttccccgggcggcgatggggtctgtcctcctgacacccgccctgcccgagcacttccgcactgacggctcctcactctgcccccagcagtattacgaagacggagcccggatcgaggccgccttccggaactacatccaccgcgcagatgccaggcaggaggaggacagttacgagatcttcatctgtcacgccaacgtcatccgctacatcgtgtgcaggtaggcagctgctgggctgggcgtggtctaaaataatttcagacttagagaaaagcatgaggaagaagccgagcgagaccctcctccactgccgatgccaccctagtcaggcctcaccagcccccgggcgtccacttcccgcgagtcctagtcagttacgcggtaggtggcgtgttacttggagcttctcataaggctgttttgggcaagggtggtgcagacagggagggacccctgtggtgtcctgggtggggtgcgtgctgggtggggggtcctgagtggggtgcgtgctgggtgggggtgtcctgggtggggtgtgtgctgggtggggggtcctgggtggggtgcgtgctgggtgggggtgtcctgggtggggtgcgtgctgggtgggggtgtcctgggtggggtgcgtgctgggtgggggtgtcctgggtggggtgcgtgctgggtggggggtcctgggtggggtgcgtgctgggtgggggtgtcctgggtggggtgcgtgctgggtggggggtcctgggtacggtgcatgctgggcgtccgcactgccctggttgttttccctttgtaattgaacgtcctgtttcccctcaaactcgaccaaccaccttctgcctccggctggatcccactggcagcatcccgccgctgttgtccgctggggattttgtgcttctggggtcctgacctctttcacttgctgatctgtgggcgctcccacccgtgtgccagcgtgacggctcggggtgtccgctcccctctgggtcgaggccacagctgagtcacgttgctgctcgggctgctccctcggggggcccttgtccctcaacctgctctggtgccccactctcagcaccacagaatgatccgggttcaggttgcgttttccctgccaccaccctgcaatcagccacttctttaaggagctccagggctgcagccacgttagagggccccttggggggcagggccagctctacggttacatgcctgaaacagtcagaagggttggccaaatctcactaaatgcaaatttgaaacaaatttgcctcttctctggatccattaggaaatgtgtgtgtgggctccgcagctgagggggccctcttgagtgtgacgagtcctgtggtgggaggacaggacggcactggtcagtgatgccgtgtgaggctgggccctggtctctgcccgtctgtcacctgggcctgtcaccagggctggggctgctgggagcaccatggtcaagagcagcagctcccagaaagtcgaggatgtacgggccgagattctcaagcttggctccagaccagatagagcttttctgggggttggagcctccgggtggtgtggcctcaggctaagtgagtacctgtttgctgtgagtcgttcgttgcctcctgtctgtgcttgtgaatgagccatatgggtggcttctatgctgccaccaccaccttgtgtgtccatgacacagtcaccccgaggtgacacaaatgctaaaaatgcacagaaataaccggggcgggagagtggagccgacctgagtccacacagtggtgagggccaggcacgtgcacctggacacgagaatatggctgtgctgttccggccggtgccgccaggcagccctgaggaggctcgggaagcagcgtgagggtggccatgcggcccactgagacagggcggtgggtggctcagaggcgatgaaggcaactccgagcttttccgcaaatgcgaattgtgcctaagaagtgcatgaagatgccacggcgggtagatcccatctccgttctttgctttcccagaaagggacctgttgcactaactggctgctccctgcttttatatgggaaaagcagaaattaaactgtgtttcctcgtaagaagtcagcgttgttctgatctgtgcaaatcttgagttggggttgggcccctgtcctaaagagggcaggtccccaagtgtgatggctccattcatgtcgatcccagtcatcgattcacgtcgatcccagccagatcttccccgagaagccccgactgaagacaggagcggctcggctgatgtgtaccccggccctgaggctgctctgagacttctgaggggctcagcctctgtttgtagaacagagccccctggcacagcctggcccagcctcttttaaggacagagtcccctggctctagcccagcccgtttttttttttttagacagaatctcgctctgtcacccaggctggagtgcagtggcgcgatctcagctcactgcaagctccgcctcccgggttcacgccattcttctgcctcagcctcccaagtagctgggactacaggtgcctgctatcacgcccagctaattttttgtatttttagtagagatggggtttcaccgtgttagctgggatggtctcgatctcctgaccttgtgatccacccgcctggcctcccaaagtgctgggattacaggtgtgagccaccatgcccggcctagctcagcccgttttaaggacagagccccctggctctaacgtgctctttctctctctctctctctccccagagcactgcagtttcctcctgaaggctggctccggctctccctcaataatggcagcatcacccacctggtgatccgacccaacggccgagttgcgctcaggaccctcggggacacggggttcatgcctcccgacaagatcactcgatcctgagggctccggcctctccttccctctgtcctccctgcacaggccgcacacacttaacgttttgttcccaaggagaccggcggaaagtagaaacctgcaatgctgcatctgggaactgacttgtgaccaggctgagaaggggagagttgggatcagacagcctgacttctctgcagggttttatacctgaccatgaacccccaggatggcgtggggtttaaggtgaaagcgtctcacgcacaagtcaggcctgttgtggggacttgaaagaggcctgacccagaccaccatgttcgcacccacagctgacccgtgctgagggtccaggctccattggcaaagccggtcaggcacgagggcgactgaggcacgtggatgaggagggcacccaggttctgttcacaactcacttcacttcatacatccttttaatttcttaaaaccctcttgtcccttaaatatttgtcaattaaagattttctggctgggcacagtggctcacacctgtattcccagctactcaggaggccagggtgggaggatcacttgagctcaggagttcaagaccagcctggacaaggcaacatagcgagaccctgtctctactaaaaatacagaacttagctgggtgtgtcgtgggcatctagagtcccagctacttgggaggctgaggtgggtggatcacttgggcccgggagctggaggctgcagtgagctgtgattgtgtcactgcactccagcctgggcaagcgagggagacttaaagcaattttttcttttgaaacggagtttcactcttgttgcccaggctggagtgcagtggtgcgatctcggctcaccgcaacctctgcctcctgggttcaagtgattctcctgcctcagctcccgagtagctgggattacagtcgcccaccaccatacctggctaattttttgtatttttagtaaagacagggtttcatggagaaaccaatatagaattgttcaggctggtctcgaactcccaacctcaggtgattcacccaccttggcctcccaaagtgctgggattaaaggtgtgagccatcgtgcctggcctaaaaaatttttttttcttcatctgggtttttgctttgaaaacaagtttctccaaatttacagatttcctgatgatgttgggtctgaactcaccaacttgattaggtctttaggggccgagggactagccagctgcacaggtgactggatgggggaggggcaggtgaggtgggtctacagaggtggcttcgcctttgaccttcatgctggtctcggctgaggtgacacgctagtgacagcccaatagggggttacccttattgagtaaaatacttcagattgacagctcaatcttagtttgcctccagttaatcttttatgcttagggattaaatgtgtggttttttttttgtttttttttttttggagacggagtctcgctctgtcacccaggctggagtgcagtggcgcgatctcggctcactgcaacctctgcctcctgggttcaaacgattctcctgcctcagcctcccaagtagctgggattataggcgcccaccaccatgcctggctaattttttatttttagtagagatggggtttcaccgtgttggccaggctggtctcgaactcctgacctcgtgatctacccacctcggcctccccaagtgctgggattacaggcgtgagctagcatgcctggccagggattaaaatattcaaacatgttgtgtgtacccagatatgctgttaatttaggaaaaacagtacaatttctatgaagtggttgtgactattttctgtagtcaatacagttgggatatctgatctatttctctgtctactttggaaatgattgcataataaataaaattttactgtttttttaaaagga

SEQ ID NO: 1644 - DNA, 11931 bp, Homo sapiens; identical to SEQ ID NO: 1643

SEQ ID NO: 1645 - DNA, 8360 bp, Homo sapiens
gaagcgtgttcctcgcggagcgccgtcggggccgtgggcgcctgcgcgggccggcgcgggagcaagcggcatggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggtgcgcgcggggctgtttggggccggggtcgggatgggggtcagggcaggtgttaccgttgggatcgagatcgggaccaggtttaaggttgcgatcgggtcgggatctggggtcgccgtctgctttccccagcggaggagccgctttccggggccgctctgcgcggagggttccgggggcggctgacccttcccgccggcttctgtggccgagctccgtcgcgtcctcgcccttctccccgcccctgcgagtccgccctgggtgccatcgccggagcgcgggccggggcgaggctgaggtggaagccgggcctccttcaggggcgtttgcaggagcgcgcccgcgagctgcgtgcggttattgagcgtttgaaatatggctcgtgtgattcctgaagggaatgcttagtttacgtcaatttaaacttaacgcaagcagggccgggtgcggtagctcaggcctgtaatcccagcgtttgggaggctgaggccggaggatcgcttgagaaatttgaaaccagcctgggcaacatagtgagacccccatctctacaaaaaatacaaaaaaaattggccgagcgaggtggcgcgcgcctgtggtcccagctactcgggaggctgaggtaggaggatcccttgagtccaggggtcccaggctgcacagtgtgagccgagatcccgccacttcactccagcctgagcaacagagcctgtctcaaaggaaaaaaaaaaaaagtagtgcaggtttttaacattagttatgtgttgaaatagtatttttagcatattgaattaaaagtatgatcgaaattcacctgtttctttttaatgttgctattagaaaatgtataatttcacatgttgctggcattctgtttctgtcggccaggactgctctagcggcaaggatggttttcccagtcctaactcctcattatactcagtactttgagaaagggggcacagaattatactactgtggttgcgttaggtactttatattagatttttatcttttgttaaccttatttcctctattattagcatcatacactaagcatggtgtatatatcaaaattaatgagccaaaataatatagattaattatagttattatattagtttataatacattactgttaactaaggttcatgtttcattgagatttcctcagcttttacctgctgttctgttctagggtcccacatgacaagtagtcttcatgcctccgtaggcatgttttggctgtgacaatttctcagacttgttttgatgatcatgagtgtttgaggcgtcctggtcaggggtttggtagaaggtccctcaattgagacttctctgaaggttttctcatgattagactggagttacattctttttccttcttttcttttttctttttccttgagacggagtttcgctcttgttgcccaggctggagtgcaatggtgcaatctcggctcactgcaacctccgcctcccgggttcaagcaattctcctgcctcagcctcccgagtagctgggattacaggcacgcgccattatgcccagctaattttgtatttttagtagagacggggtttctccatgtcggtcaggctggtcttgaactcccaaccttaggtgatcctcccacctcggcctcccaaagtgctgggattacaggcatgagccaccatgcccagcctgttatattcttttttaaaaatcagaattctgaaaaatcagaaattctgaatcaatattctgaatttcttaggtctttttaaggaaacagatttactctgccgttaaagaacttgaagtaggctgggtgcggtggctcacacctgtaatcccagcattttgagaggctgaggtgggcggatcacttgaggtcaggagttcgagaccagcctgaccaacacggtgacactctgtatttactaaaaatacaaaaaaattagccaggcatggtggcatgcacctgtagtcctagctacttgggaggctgaggcaggacaatcacttgagcccaggaggtggaggctgcagtgagcccagatcgtgccactgcactccagcctgggtgatagagtgaaactctgtctcaaaaaagaaaaaaaagaacttgaagtagaaccgggagctgagcccagcctttctcttttaagcaggtgttctgtatttgcttgtcatgtctggggagaagtgaattgggccttgtgggttgggaaagacttatacagacagaaggcatgagcaactacaggaaggtgctagaagacagcatgtttcttcttgagtctcacctgtccacacttgaaagttccagagcctcatctggtgaaatctccagcttcttcctggaggtctcatgcagtttacggcttcctgtctctgtgcctatagctcccaaatattttctctggctcagcctgactcccccatacctgccaatttgagtcttggcctggtttatgacaggcccccaggtcggcgtggcccaaacggagcccttgagtcaccaccgtgcccttccacagcttccttttccgccactgtctcagcgagtaaataccagcaggttcgacttttgctattcccagctctgccgcgttgaactttttttgttgctgttgagacagggtctcgctctgttgcccaggctggagtgcagtgcagtgcagtggcaagatcatggctccctcctaggctcaagcaattctcccacctcagcctcctgagtagccgggactacagctgtggaccaccttgcccggctaattttttaatgtttttgtagagacggggtccccctgtgttgcccaggctagtcttggactcctgggctccagtgatctgcccacctcggcctcccaaagtgctgggatccactctttttcagattccagcagctctggaacagaccttcataatgggaatgttttcttcctcactgagtgtttgtttatttatttattttctgaggcggagtctcactctgtcgcccagactggagtgcagtggcacgatctcggctctctgcaacctccgcctcccaggttcaagcgattctcctgcctcagcctcccaagtagctgggatcacaggcgtgtgccaccaagcccggctaatttttgtattttgagtagaggtgcaatttcaccatgttggccaggctagtgtcgaactcttgacctcagttgatctggccacctcagcctcccaaatgctgggattacacgtgtgagccactgcacccggcctgagggtctaaaatgtgcttagtatgactgaggacatgatgttttaattttatttaattttgcttaaattttgaattgaaacatcctcatagctagtggctgctgttgggcattgcagttctaggctctgctgaagcatcatggtcagggaggcccatcttggccccgtggacactttccgcctgcgccccgatagccgctgtcctctttcctagcctggcgttctccgtaaccacagttgcgtttggggtagtctgtctcctgctgttcactgtctgcctctcattagagaagaagatgcacagggctttgcttgtctgttttgctctccagcgcatcactcagaacagacctggcactagctttgtgggagggagagtggcggtatgctcagagaggcctccccagggctgtgccaagggccttgtcttctctccatgctcttcccaaatagtctgacaatttggaaataacatcttgtcagaaaaactcaaacttgggaacagaggtctcaaggacatatcttgtatttcaacatcaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtatgtggtgggttcagatcctctgtggaccctcgtggttatgtggccaggtgcatatctgctggcgccttggttatgtgactgggtgcaggtcctccgccgacccccttggtcagctttcttgaaagtgcttggggcactgggcctcctggggcccatgtccgagaccatcacccctgaatcacacattattaccagtaactgtcagctgaacttggacagaagacaagcttttcaaaatgtccttaccttggccgggcgcggtggctcacgcctgtaatcccagcactttgggaggccgaggcaggtggattacctgaggtcaggaattcgagaccagcctggccaacccggcaaaaccctgtctctactaaaagtacaaaaattagccaggtgcagtggtgggcgcctgtagtcccagctactcgggaagctgaggcaggagaatggtgtgaaccctggaggcggagcttgcagtgagctgagatcgcaccactgcactccagcctgggcgacagagcgagactccgtctcaaaaaaaaaaaaaatgtccttaccttggccaggcacggtggctcacgcctgtaatcccaacactttgggaggccgaggcaggtggatcacctgaggtcaggagttcgagaccagcctggccaacagggcgaaacctcgtcactactaaaagtacaaaaattagccgggtgcagtggcaggcacctgtaatcccagctactaaggaggctgagacaggagaattgcttgaccctgggaggtggaggttgcagtgagccaagattgcaccactgcactctagcctaggtaacagagtgagactccgtctcaaaaaaaaaaagcccttaacttttagcaaatgttggacagatcttgtttgcatgagaccaaatgcagtgcatatcccagcagtgattttatacctgcttgatgccttggaaagcggcgtggcttgtgccctcggctgctcacctggacctgctgccaaagacgcttctctgcggcctgtggcactcacaggcctgatgcctggcgtctgcttgtttgtttgttttgagacatagtcctgctctgttacccaggctggagtgcagtgacgtgatcttggcccgctgcaacctttgcctcctgggttcaagcaattctcctgcctcaggctcccaagtagctgggactacaggcacacgctgccactcccagctatttttttgtatttttagtagagacggggtttcaccgtgttagccaggatggtctctatctcctgaccttgtgatccacccgcctcggcctcccaaagtactgggattacaggcgtgagccaccacacccagcctaatttttttttttttttgtatttttagtagagatggggtttcaccatattggccaggctggtctcaaactcctgacctcgtaatccgcccgccttggcctcccaaagtgctagggtgacaggtgtgagccaccgcgcccggcctggcctctgcctcttaatgccctgttgaacaggcgggactgagcaacaggatcccgcctgtccccactggcagatgctgcatagacagcgtccaggagggtccttccaccttgtccttgtgtccctgtgcaggtggatctgtagaagaaatgcctgcctagagaaggaaatgcagggtgggctaaggtagagtttacattttgaaaagttcttcgaatgggatagtgcctgttcatgcacatactaaaagttcagatagtaaaaatgtgcagggctgtcctccacagacgccgccccccagtccccagagctgtcctggctgcttgtgcacaaagaaagtggagtgacagatgcaggtgtggctgcatccagtggcttcggccttcctgaggcgttttcacctggatgcaaaagctcacaagagaaaaggcatctgcactggtgtccggcccccacatagcagcttggggtgtttaggtcccgctgtgttggcctccgccatggcgcgtggttgggggcctgtgaggctcaggttttggacacagttgagtgagggtgacaaggggggacccagaaaccacccctgggccccaccaagcgccagccaccatccggtttgcttgctgctccattggtggaatcagatgcatgttttttcctgtatgggggtgaagacagttgagtgccggcccctctggcccaagcctcgggcgggcaggagccatcggctgagcttgctgagcttgctgcctgatcaggggtcgtgtttgcgggcggaggagggggtgtttgcgggcggaggagggggtgtttgagggtggaggagggcgtgtttgcgggcggaggagggggtgtttgagggtggaggagggggtgcaggtgcggcactcaggtgcctttcaccttccaggtcgggagcaggctgaactcactgggctccgcctggcaagcttggggttgaagtttaataaaatcgtccattcgtctatgacgcgcgccatagagaccaccgatatcatcagccggcacctgccaggtgagtgctgcgcgcggggcctccatgcttgcagcagtgggcggctcgtggcagggccccggcctgagctcctggccaccgggaggtcacagcatctccgccggcggggccgcctcacccagcgcttcgctgtgcttctctgcaggcgtctgcaaagtcagcacagatctgctgcgggaaggcgcccccatcgagccagacccgcccgtgtctcattggaagccggaagctgtggtaaaaacctccccggggggcagctgtgtcaccctcgccttccctgggcaaagcggccctgctgggctcaccatccaccacgtgcccggccgtcccacgggcttccccgggcggcgatggggtctgtcctcctgacacccgccctgcccgagcacttccgcactgacggctcctcactctgcccccagcagtattacgaagacggagcccggatcgaggccgccttccggaactacatccaccgcgcagatgccaggcaggaggaggacagttacgagatcttcatctgtcacgccaacgtcatccgctacatcgtgtgcaggtaggcagctgctgggctgggcgtggtctaaaataatttcagacttagagaaaagcatgaggaagaagccgagcgagaccctcctccactgccgatgccaccctagtcaggcctcaccagcccccgggcgtccacttcccgcgagtcctagtcagttacgcggtaggtggcgtgttacttggagcttctcataaggctgttttgggcaagggtggtgcagacagggagggacccctgtggtgtcctgggtggggtgcgtgctgggtggggggtcctgagtggggtgcgtgctgggtgggggtgtcctgggtggggtgtgtgctgggtggggggtcctgggtggggtgcgtgctgggtgggggtgtcctgggtggggtgcgtgctgggtgggggtgtcctgggtggggtgcgtgctgggtgggggtgtcctgggtggggtgcgtgctgggtggggggtcctgggtggggtgcgtgctgggtgggggtgtcctgggtggggtgcgtgctgggtggggggtcctgggtacggtgcatgctgggcgtccgcactgccctggttgttttccctttgtaattgaacgtcctgtttcccctcaaactcgaccaaccaccttctgcctccggctggatcccactggcagcatcccgccgctgttgtccgctggggattttgtgcttctggggtcctgacctctttcacttgctgatctgtgggcgctcccacccgtgtgccagcgtgacggctcggggtgtccgctcccctctgggtcgaggccacagctgagtcacgttgctgctcgggctgctccctcggggggcccttgtccctcaacctgctctggtgccccactctcagcaccacagaatgatccgggttcaggttgcgttttccctgccaccaccctgcaatcagccacttctttaaggagctccagggctgcagccacgttagagggccccttggggggcagggccagctctacggttacatgcctgaaacagtcagaagggttggccaaatctcactaaatgcaaatttgaaacaa

SEQ ID NO: 1646 - DNA, 85945 bp, Homo sapiens
caccctcaggcactacagctagactccgagcttactgggcagtcatctgattcgaccaacatcagttcgcagggcttaagcccagtcccttacggcggcctggggagggaccaggcccaagtatataaagctccctgagggtccgcgttggctttgcgcctgtgagtgtgattcaagaacgtcccagtgcccttggctcctttcggagtgtgaccccgtgcttgcacgggacacgttacccagctcgggtgagaagggtatcttccgggaacctcgcctttaatagcacaacgagcgcagagtccactggatctgcgagaagaaaccgcgctaactagtttgtccctacggccgcctcgtagtcactgccgcggcgccttgagtctccgggccgccttgccatggctgcccgtggtgtcatcgctccagttggcgagagtttgcgctacgctgagtacttgcagccctcggccaaacggccagacgccgacgtcgaccagcagagactggtgagtcctgccagcggcccccacccctctctggctcccttgtagtttctgcttcagccccctctaccgcctcacccttgaacctttgtactcccccgcattcgctcacggtctgtgccctagcgctcacttgttcagtggagagaccgctttgtgctgggctttgacgcctgggcgtggaagacggagcagttctgaggatctgtctcctcaaggagcttccagtcttgtctgggacacaaaccagaaaacaggcaattgcaaatacagtaaaataagtgctgtatgtggattttcctatctcataggaggccctaaaaacgtcttgcaggggacgtggtgggatcagggacgcttcttggagaaagctgtagttaaaaattaagatctgaatgaataaaaacagtccattcagcaaggagaaggggaaaaagtgtttcgggtaccaggactactgtctccaaagtctccggcacagaaacagggcccagttggaaactccaagtggtgtattcaggatgaactgtagagctggaaaaaggaagggtctaacagaaaactgtccaacagaagcatattgtgagccacatacgtatttttacgttttttttttttttttttttttttgagacggagtctcgctctgtcgcccaggctggagtgcagtggcgcgatctcggctcactgcaagctccgcctcccggtttcaggccattctcctgcctcagcctcccaagtagctgggactacaggcgcctgccaccactcccggctaattttttgtatttttagtagagacgggggtttcaccgtgttagccaggatggtctcgatctgcttacctcgtgatccgcccgcctcggcctcccaaagtgctgggattacaggcgtgagccaccgcgtccggcatatttttaagttttttgtagccatattaaacaactgaagagaaacaggtgggtttgattttaaccatgtattttctttaacctgatatatgcacagttgcatggtaattttcaacattcaatatgaaatattgcccaagtggtggtttaggcttgtaatcccagcgctttaggaagcccaggcaggaggatcacttgaggccatgagtttggaggacagcctgggcaacacaggagaccccatctctgctaaaaaaaaaaaaaaaaaattagctgggtgtggtggtgtgagcctgtagtcctagctgcttgggaggctgggtcgggagaatcacttgagcccaggagttgaggttatagtgagctatgatttcgccactgcactccagcctgagagacagagctagaccctgtctccaacaaagaaaaaaaaatgaggcagtagagatttagaaagttttaagtaactggtccaggatcatccctggtaagtggcagatctacgattccaaatgctacactttttcccttatgacttgctgactccttagaaataaggatttctggatatagtattcagtgtatgatacagctgaacaagatcaggcagaagtaatccttttgtggagagtcgtaaaaatccgagtatcaggctttcaaggtagttgggagctgtggtaattggaagatagaactaatattggtgacttttacatgtgtaggtatttttacttggaagaggagagagtttacagaatccagagtaccacataggaagcatctttagtagtccaggtacttgaaggctaaagtgtaggccagtgattctcaaactgtctgtgtcctgtaatatcctgaaatcctgaagtcagattcatagacaataaaatctacctgtaaacataacttttaataatcaatataatgctttaattgagacataaaggtgaaatattttattagacaataacatgtctacaggctgcgagcggtgtctcgctcctataatcccagcaatttgggaggctgaggtgggtggatcacttgagtcaggggttcgagaccagcctggccaacagggcaaaaccgtgtctctactaaaaatacaaaaattagctgggcatggtagcacaagtctgtaattccagctagtagggaggctgaggcagaagaattgcttgaacccagggggcagaggttgcagtgagcggagatcatgccactgcactccagcctgggcgacagagcgagactttgtctcaaaaaaaagaaaataacatgttaacatgtctacaatttaaatatgtaaatacttagacattactacattagaaaacataatgaagtaattattagttgctgtcatattacaccaatttgtagaatcactgtgtatgtgacagctaccaatgcaaattgtttatcaaatgtattatattggcttttcaagtagcagaaggaccattgttctttacaaacttatttctcctaaatggtgaacaatttctggtaaaaacttgaacaaaacagtggaatctccctcaatttacatggcacttgcacttatggaagattcagtctgtactaaaacagtgtaataatgatatatttatatataatgaagttctggactaagattatcataaacttttcacctacttaatcttttaaaattgagggatgcaaacagttttttgttacacaggcttgtctcatatattttaggacttctacgatcaatggtcccccatccaccaaataccctcccttctattcaaattattgtgcaaccaaacagggcctcacgtactttcagaatgtccctaaggggttgttctgcttcttttgggagttgttggtccaggcaatgaccaataatgaggcagaagattgttgataataactttagggaacttggaagtactgaaagcaatgagaagctgacaaaaggtaaatattaggaaagaaaaaaaaatggcctaggtgtagggcatatttggaaatcttatggaaaatagaaaataatgtttgtcaatgagttaaagaaaaactttcacactgtattttaaaaatgtaattcattttaaggtttatgaaatatatcttgttgggctggacatggtggctcatgcctgtaattctagcaatttggaaggtcaggtgggagaattacttgagcccaggggttcaagacccagggtgggcaacatagtgagacccctgtctttctaaaagaaaaatcaaaaagaaataaatatatcttgtcatatttgttaaataactttttcttaggtaagcttctcttttgaaactaagaactaatgttcattagcctgcttaggagattaaaataatttttaaaaataggcaaaatatgtagcatcttgaataaagttagcattttacaattaatggtttaatagaagtcataatcaaactttgcactagcaaagctgtttctcatggaaaagtagaaaagaaactttaagagattattatcaaattttaaagcagtttgaacaaaactcagtttgtatgaaacggtagtcatttagtttccattactttcctgaaaactgtaactcttacttttatttttcttcaatttttattttaagttccggggtacatgtgctagatgtgcaggtttgttacacaggtaaatgtgtgccgtggtggtttgctgcacagattgtctcatcacctaggtattaagcccagcatgcattagctattcttcctgatgctctccctcctcccacccccacaactcttgttattattaggatagtgtaacatgtaaaaaaaactagacacatatatgtttcattataaacaatcctgatacgtgaaaactaaaacctgtcaaactaattttcaggcatttattcatttccaaaaataagacagtacttttactattttgcaatgataacatgatttaaaacatgttttaacaatactttgaagcttacattggtaatcacatggattatgtactgtatacccatatttttaacttttttttttttgagatggagtcttgctctgttgcccaggctggaatgcaatggcgggatctcggctcactgcagcctctgcctcacaggttcacctgagtctcctgcctcagcctcccaagtagctgggaccacaggcgcctgccaccacgcccagctaatttttgtattttcagtagagatagggtttccccatgtcagccaggctggtctcaaactcctgacctcaagcgatccaccctcctcaacctcccgaagtgctgggatttcaggggtgagccaccgcacccggcctaactgattctttcccactgttttttacaccataatgggaggctagaatgttaagtttcatggacagggactttatttgttctctggtatgtatttctagcatttataatggtgcctgatgtgtggtaaacattccaaaaagaaattgttgaatgaatgaatgttattcttgaatgggaagaaatgagaagaacttttctttcagtgaatggagtaagaatttccagatgtctaccagtgagtaccatacacaaaaatagaaaattcagcttatttaaaatgtagctcattatagtcttccctgaacatgctgattctcctcttctttccccctttcttgactagtgccatcatgtgcactttctcctttacctccaccattcagttcatgagtcacttagcctcatctctgtaatttttttcatggtattccttcccttgctattttcttagtctttattgtttctcctctggcctgtagtgatcgcctttaaaaacaagtctctttgcttctggtattgtatcctttctaaacttcacactgccatcagttatttttctacaacacagacttgttaatgacaccatccctttttatgagtttaacatgatctaaacctttcttaggatcttacacaggactcttcatgtactgatccttaaatgacatatccagccacatttcacatcccctacattgcactgtaccctgtactatagttacattaagtttccttcatgaaattttatggttctgtgactttactagagctttctcttctgaaattcttttcctggctaactcctattcattttttttttaaagacacatccagtgtgaagccttccctgaccccagttccctttgcctagtaggagaaaattgttttatactgtgtgtttccttaggaagttgcacaagtttttattatagtttattaagatacatcaaaattatttatatttgtataagcacctatggtgtgaagtcctcagggaagacacttgtatctgtatctgtgattggcattgtaattggcacatgatagccatttaattatttgtctatgaaatagctattaacttctattattattgagcaacttaataaataaacatggatatttgattttaatatcattgacacctgtattttttccttgtagggtcctcttatatgttagcctctaagggagagcaagagtctgtgtctctcttgctcactgctttttccccagaacttagcataagtcctggcacatgccaaataaatgtttatatatttatatggtaaaagttaaataagtatttgttgaatgagtgaatagtctacgtctttcctctctccatcacaactaccacccctcttgtgaggaggaagaatactttttttcttcttcatttccctctggtacaactcttgtttttcttggactgaaatgttcagtctcaaaatagaaattttagcattttataacactttcaggcaacttatatttatctaaaaagttatttactgcctatgttgtttagggagaataaaatgccatagggaatttgtaaacaattttggtgcctttttttttttccccagctgtagcagctatgatggagtgatcttttttcccagttttcagaaattttttgattcatggtagtggaacatttatagtaatttttctgtttttttaattgttgctgttgttattttggtttttttagtggatatttgaaaccaggtagtggtaacagatacctgacatggcccatttgttgatctgctggcattatttaaataatgtttcttctctttgaaatatgcctttttaactaaaattagatattctttatagatggggatgaagttttaagaatactcgttctctcagttcccaacatagtaccaggcacatggttgctctgcctcataaatttttgttgaatcattaaattaacaaatgaatgaaaccaacaggcttggagataagtagattagggaaatgttatagaatgatgaacggacagccttcaggaattaaaaaaagaataagataaatgagactatgcctctttgacttttgtaatagtcaggagaggcctaaaatgtcagtatctaataaatatgtgtataatcagagtacgtataatactctgacttctgatgtgctttttcaagttttgatcattgcttattaatatctccaataacacaggcagtctccaacttagaaataggttctgtttttaaaatttgtcaattaaattcattttaatagatttttgggtaacaccaaatatatggaagctataaactaagtgtgtatagggagggtataaataaaccaagattgccaccctcaagggcagaggatagcaaacttaatttgtaaagggttagatagtaaccatttcaggctctgcagaccatatagcatctggcacacatttacctgtgtaacaaacctgcacatctagctgcaactacactgttgtagactgaacacatagacaataaataaatgtggctatttatgaaaacagttgctctaggaggcaaatttggagcaaatttaaatgcccaattaaagacagtttctctaagtgctatcatatttttgttcatttatttattcatccatttaacactttatttatggagtcgtacattattaggtaaggttctgagtctaagtgctatagtggatacaaagatgaatcaaatacgcattttttcctcaagggacttgaccagaaactaaacctagactctcagactgggaactccccagcagtggagatcctgcctgattcacttttgagaatgacttctagggccaagcacagcacggggtaggttgcagatacttagtaaatgtcttttcaagggtaagggaatgaaagactaaggcataggtgtcataagagaaatatatggataaaatgcttgatttcgtaggaatgagccattgtttcttatttgggaaatcagagaaaactgtgaaaagtgagttgaatgagtagaacattgagaaaagggaagaatgtgagctaagttaaaaagataaaatcttaggcagaggtagcaaattcagatgcttaaagggggcagtcacgtggcacaaatgagtgaggggatgactgggttaaatggtgttgcattatgtgagtgatgattatagcaaaatgagagagcacttgcttttctaaaggaggcagatcattggaataaaccattattaccagatgtttgatttttcgaaagaaaccagaaagagataaataagtttttctaaaatgtgggttatatcaaggaagaaaaatagggaaaggtaggttgggttaacaactgtagatagctccaaatggcgggttaaggaatgtgtggactaaatttgtaggcagttaattttgtaggagttgtgtgatcagtggaggccttcaggagaatcaagcccagagcagtgtttaagaagggtagaaactaaacctagactcctagactgggaactcctcagcagcggagatcctgtagaagaggacaagcctagttgaaaatgcgttacagtgggcagtactttgggagtgtagaggaggagatgatggcagcaataagagtgatgatagctgaactgttttgtgccaggctttatgctaatgttttaaatgcatgaactcatttagtctatataataatcctagcaggtatagatcctgctaatattataaccctctacttgtagatgaataaattgaggcttaaagcactgaaataatttgtgcaaagtcacacatttgagaagtagatgaatcccagaggtactctgctttgttgcctctgtgctcttattcagaatattctctttgtttctctttccccttcaacttcttaaattatgtcacggtctaactaggaaaacatataacttaaataatataaaacaagggaaatgtaattcaaggaattggcttcatagctagtggagttgttgagaaatgaaactaggatggtgaagcaatccagagattgggaacagcaaggaaccactagcactcctagagctgtagggccaaagggaggagttggtgtttttcaaaaccactctacattaattggaaccacggatgtctgttcagggggagctggagccactgctgctgctggagcagttgctaaagacggagaggaaggggcggtaataccgtggtttcttccttgttttcactgtccagtctttcaccattgcatcccattggtctgactctactgggaccagctgacacaagagcctgtaggacttagctcttctaacagaacagagaatagcccaggaattgattggtgaatgcatatgggcctgcgaccaacacattatctgttttcagctgtaatttgaattccactgataataagaaatttgaaagcacagtctcctaaaagcagtgttagaaaacactttttgaaatgctaagtattcccttaatccacagtgtaagggtaacagtattattttgtggaattccatttacactgtcttatgtccttggaatatcatttccatgctattggagataaaataagtactgttgccaagtgtggtggctcacgcttgtaatcctggcactttgggaggccaaggtgagcacatcacttgaggccaggagttcaagactagcctggtcaatatggcgaaaccccacctttactaaaaaatacaaaaattagctgggtgtgatggtgcacacctgtagtcccagctactcgggaggctgaggcaggagaataccttgaacccgggaggtggaggctacagtgaacccagatcacaccactgcactgtagcctgggtgacagagcaagactctgtctcaacaacaacaaaaagaagtaagtactgttagcttataaagaaaagaggtttaattggctcacgattccataggctgtacaggaagcatgatgctggcatctgctcagtgtctggagagaccttgcaaaacttacaatcatggcagaagacagagtgggagccaccacttcacatggccagagcgggaggaagacagagacagggaggtgctgcatacccccagaaaaccagatcttgcaagaactcactatcacaggaatagcaccaaggggatggcgctaaaccacccatgagaaattgccgccatgacccaatcacctcccaccaggccccacctcccacattggggattacaattgaaagtgagatttgctgagggacacagatctgaaccatatcaagacaatatagtgagaccccatttctacagaaaacttaaaaaattagtcacttgtggtggcacatgccagtagtctttgtttcttgtgaggctgaggtggtaggatcagttgagcccaggagttaaaggttacagtgaattacgatcataccactgcactacagcctgggtgacagagtgagaccctactggaaaaaaaaaataaaccaatattgatccattattattaacccaagtcatattttattcagattcccatactttttagctgatgtcctttttctgttccaagatcccaaccaggtaccacattacatttagttttcgtgtctgttttggctgcttgtggctgtgacagtttttcagacttgctttatttttgatgaccttgacaggtttgaggcttactggttaggtattttgtgggatagtctctactggaatttcttaggtgtttttctcatgattatactggggttttaggtttttggaaggaagatcaatcagaaaggtgaagtgccaggctgggtgcagtggctcatgcctgtaatcccagcactttgggaggccaaggtgggtagataacttgaggtctggagtttgagaccagcctggtcaacatggcaaaacccgtctctactaaaaatacaaaaattagccgggcatggtagcaggtgcctataatcccagctacttgggaggctgaggcaggagaattgcttgatcctgggaggcggaggttgcagtgacccgagatcatgttattgcgctccagcctgggcgacaagagtaaaacttcatctcaaaaaaaaaaaaaaaagaaaatgacttgccagtttcatcacatcatatgaagtgtacatactataaacatgtttgttgcaattgatgttgatctaatctgatgcggcagtatttgtgagttttcttaactgtaaactttatttgcatactgcactttttgaaagaaagtcactttgtgcagcccacatttaaggagtagagagttatgctctccactccttaaatgtagagtaatctgtcagattatttggaattcttctgtatgggagatttgtccttttttttttttttttttttttttttttgagacagagtctcgctgtgtcgcccagactggagtgcagtggcgcgatctcggctcacttcaagctctgcctcccgggttcacgccattctcccgcctcagcctcctgagtagctgggactacaggtgcccaccaccgcgcccggctaattttttgaatttttagtagagacggggtttccccgtgttagccaggatggtcttgttctcctgacctagtgatccgcccgcctcggcctcccaaagtgctaggattacaggcgtgagccaccgcacccagccgagattgtccttttactcccatttattacttatttatattagtttggtttcatggatagtaattttatgctttggattataatccactaccacatttattttgttgttcaagctgttttatctttggccattgggatctctttcagttgactcttgtgtacctttgacatacccccaacgttgtgggggtttttttgagcacttccttgctttctggcactacatggtgctctaggctcattttgtgtatttcctgccccagtcccaaaatcaggcatttctccaatgagttctgtgtatataacattttatctcatggggagcttcattctgggtcataacttcagatcctaatccatttttatcctcccaccctcatccatttttatcctcccacccaaatgttccccaattcctttatcttttccctatatagctgatgaggtaagagcaaaagatatccttgtcttggtacacgtggctgctgctttcagtccatcaaggacagtagaatttttccctgaagcttcagtaaagcgcttttgtgtttgtttagtttgggctttatttttgtttttcaatatctggtgttagggactgctaatggagggagggtgctagggattgtgaaaggaattagagagagagaaagagactcattaacctttctgccatttgtcattgtatttcaagtttgttatagaatcttagtacaggtcaagtgaacagtaaagaacctgtctctgggtataaggttaaatattgcatattcattcctctaaaggactgaatatggtcttcaagagaatgattttcacttcttttggaatacctagaatttaacaatcaccaccacactgaaaaaatagtttttgtatagtaggcattagaactgaagagaactaaaccaagggagaaaagaatggtactttaaatagcactttcctccccaaataatgcctagctgcagtgatgttaaagtttaattcaaggacttcattactataagtacttaagagatttctatatttttatgtggtttttgaataatttctgtattgatttgtaagtaacttttttcaaagtaccaatttattttttaattttaatattttatttcttttgagacaggatcttgctctgtctcccaggctggtgtacagtggcgtgatcatagctcactgcagtctcaatttcccaggctgaagtgatcctcccacttcagcttcccaaggagctgggaccacaggagtgtgccatcatgcctggctaaatttttatttttatatttggtagagatgggggtcttgctatgttgccgaggctggtcttgaactcctgggctcaagggattctcccacctctgcttctcaaagtgctgggattacatgtgtaagccactgtgcccagtccaaagtaccaatttaattttacattttaaaaattggattctaaaagtctgccttcttatctgaacactatttttcagattccattttattttgttacttttttaaattgtgattggacaaaatgtttttcagtttctgtctttttttttttttttttttgagacagggtctcactgtcatccaggctggagtgcagtgatgcaatctcagctcactgcaccttccaccttccaggctcaagcagtcctccgacctcagcttcccaagtagctgggactacgggtcgcaccaccacacccagtgcagccctcaacagagaggagactggagtgggtagctcctatctgcaggcaggtcatcctgataagggtgtctggctaagtctgcaggtttttatgtgctcagaatggaggaagtgcatgttgattggttgatgggtggctggccatgggcaggcctggaaaaagcaccatccaattggccgattggtcatcaatgaacttcatactcctgttggtggacttcatccagaactggcagcctggcccctaggcttcaggccagtcctagcttgaaggaggggttctgccagggacccaccctttcctgcccaggaaactttcaacctcttgctgccaccaacatgacctccacagcaccctggctctagaggctgcggggagcccacaggcccatgccaagctactaccctcagccccttggctggacctccctcctgggcttgtgcccaaagtctagagggggctgaagtggcagggggctggcatgtcatcaccgctcttagtgcatgcacacccggctgggttgagacagtgcctcagcttagccacaactttgccccaccctggagtggatgccgtgagtcgggagaggccaggcagtgggagcaggcatttctaagcctgtaggggcaggggacttcctgggcccctgagagtgcggttgggcggctgcagctgctcctgggagcactggctcctaccctgccaagctgataggtggctggcctcctgcctgttcccagctcccggcagctctgctgaatgtccagcccccatggtgcctcccgctctgcagccaacatccttgtgggggccgctccagacgggccgtagcagccactgccttaaagtaaaatcggttgctgtaagggagtaaaagtagctttcattaaaggggatgatttcccaagcaagaagaaataagcaaaactacaaaatgttgcagataaggtgtacatcagatataagccgaaaaagagagtttgaggggttcttgctggagacttcaaagtcagtatgataaaagcttggagtacttgataggaaggaggccaactagagatgcagtgggatcatttttatgatcagggtgcagatttaagtgcaaggataaaaagggagacaccgaagatcaatgtagttattcttgaagaatgtaaggaagaattcatttttaaagtttattttaaagtagacaggtcagagggttttctgccttctgatgttaaaacatgttaaacccatctcaccaggtgagatcttcctttttctttttttaataacctttatttttacctcctgattttaaaaagacgattatgtaatgttatatagtaattgtaatagctaccatttgttgaatgtttatcccatgttaaatatactagtttatatatatgaatgccctaacttaaaaaaattcttatcaacccaaggaattaggtgcagtcatcatcctcattttacagatgaaggaacacatggaggtcatgtaacttgggcaggtcatggagctgacaagtaaggagccaaaactcaaaccatatttctttgattctaaagtctaatgatcccaagactacgttttaatgaaaatattcttttttatagcctgcttttattctgtacttaacatgtggttgctaaacattcctcaataatatatttaattgttgatccatattttacatgtgccttaatttatttaatgattcccccattgttgggtagtcagattgtttccatttttttgtattacaaataaaacacagtgatgaattttctcttaaatgtttttatggatttttctgattattttcttcggataaattttttgaatcttagttactaagcctaaagacattagtatatttaaggttgttgattcctgtgatgaaagtaacctcaagacacattgtcccaatttgcattcctagcatcagccatcagttcaggagattgttcattgaaccattcttttgacaatttgtaagactttgatttgttggccaaaatgtatacctctcatgattaacaggctgcgtactggaggtatgacagattgtcacatggccccatccagaggaaaagctgaaagagggactagtaatgccagtttcatacttatcaaacgattccatttttgtattaaacataggagtattaaaaatacgactggggaggccaggtgcggtggctcatgcctgtaatcccagcactttgggaggccaaggcgggcagatcacgaggtcaggagatcgagaccatcctggctaacacagtgaaactctgtctctactaaaaatacaaaaaattagccaggcttggtggctggctcctgtagtaccagctactcgggaagctgaggcaggagaatggcatgaacccgggaggcagagcttgcagtgagctgagattgcagcactgcactccagcatgggcgacaaagcgagactctgtctcaaaaaataggaaaaaaaaaaaaaaaaaaggaaaataccactgggggaagggagaccaaagaaaatttcatgaaataaagaattaaggacaccaaggactggtgctaggatctagcttgatgttagataataaaaatgacactgtattctctagaaaatttaaaaacctacctagtaataagttgtagaagactttatatgttttttgtgaatgggcagataggggtgttttgttgagtgtgagctcacactggaaaaaatcttgagtaatttttataatccattaaaggtaatgtgagagtgacttcagattgttgcttgaaggcataagctctggtctggaattaggatacctgggctctagtccagtgtagaattgttgctgcaatttgcaagtcatgtaacttctcgggccctcagtgtcttcctcataaaatgtgggttttggctaatgttctctgtcatttttttcaactctatgattccgtgacattgacttaatttattattacagtcagaaatgtcaacaaaacattcgtggaaactattgaaaatggaacagaaacatctttttgtataaaattatagtgtttctatagaagtctgtgtgtgcctttgcatgtacctttccatgcaatcaaacagaaatgaaaagtttccagaaaaggtcaacaagtaaatttactgaggggagaagtgtgtgattgagtgtctaggagtctcagggggtggagacaccaagggaaggctaatttgaagacataggcaaaatagttcagaacttaattcaggactttagaaattcattggccaaaaaattctaataaaatttcagtacaataataaaatgataaaagctgttggttgggtgaaaaaggccctttccttcaaatgttagaaaacaaaactaaggatactatttaaacttgaaagagataaatttggctgggcatggtggctcatgcctgtaatcccagcactttgggaggctgaggcagggggatcacctgaagtcaggagttcaaaatgaccagcctggccaatatggtggaacctcatctctactaaaaatacaaaagttagccaggcgtggtggcgtgtacctgtagtcccatttactcgggaagctgagacaggagaattggttgtacacgggaagtggaggttgcaatgagctgaggtcacaccactgcgctccatcctgggcaaaagagtgagactctgtctcaaaagagagagagagaaaaagaaatatatacatttaggactagtgaattaaatagcagggatgagcaagttaaagaatctcactcctagacccaaatgaaccttgagctgcctagaagactgaacctttgagagcagctgtatctgaagcttcaggccaaagaacagttctcagaagttgcattactagacttgacatgtgccagccatcaagacccacaaagcaaagatatagagcctgctgtagttctttcttcctaacaaattcgtttcaaatgctgaaggttttaaaatattttttctggcttaattttctaactagaatttggttttggctttgaaatttttgtctctttttgacttacctgtttatctgtgggggtaataatctgttacctggttatcatcttgaagtgaccccataatgttaagtagatggaagttgactttacattttacaagttgtctggtctaatctgtgtttaaaatattctgcaggcctagtctgtttttaacatattctatatgaaggggtggtttgcccctccacacctgtgggcgtttctcgttaggtggaacaagagacttggaaaagaaagagacacagagacaaagtatagagaaggaaaaaagggggcccaggggaccagcgttcagcatacggaggatctcgccggcctctgagttcccttagtatttattggtcattcttgggtgtttctcggagagggggatgtggcagggtcataggataatgagagaaagtcagcagataagcacgtgaacaaaggtctctgcatcatagacaaggtaaagaattaagtgctgtgctttagatatgcatacacataaacatctcaatgccttaaagagcagtattgctgcccgcctgtcccacctccagccctaaggcagttttccccatctcagtagatggaacatacaatctggttttatactgagacattccattgcccagagatgggcaggagacagatgccttcctcatgtctcaactgcaaagaggcgttccttcctcttttactaatcctcctcagcacagaccctttacaggtgtcgggctgggggacggtcaggtctttcccttcccacgaggccatatttcagactatcacatggggagaaaccttggacgatacctggctttcctaggcagaggtctctgcagggttttgtgtccctgggtacttgagattagggagtggtgatgactcttaaccactgctgccttcaagcatttgccttcaagcatttgtttaacaaagcacatcttgcacagcccttaatccatttaaccctgagttgacacagcacatgtttcagggagcacagggttgggggtaaggttacagattaacagcatctcaaggcagaagaatttctcttagtacagaacaaaatggagtctcttgtgtctacttctttctacacagacacagtaacaatctgatctctctttcttttccccacactatagatatttaacatgtcttgtagatgatccctgcctcccaacacacacattgactagattgcagtaacagtgaggtgagggcagaatctcagtcagaattcaacatctaacctttgttctctccctgtatcctcacatttccctccttggcctaaccttgaccctatgcttcagttttagttctacttttctaagaagcaatctatgattcagaagtagagtactcagccagctggccagctgtctgttttactgtctctccatgcatatacatacatccatgcagtcaattaactgctaacttttatttagcctatgctatataccgggaatacaaaggtgaatgaagcctacctcttgccttctagaggttcatagcatggtgagggagggaagttttgaagtgtggcctgggatcacaatggaggagtaagctgggaagtagtcaggtggtgatatttaaataggtaagaccataacactgacattgatttctttaatggttggatgtttacttaatcctgctgcctatctatagtgtagtaggccccctcttatctgtgggttctgtgttccaagaccaccagtggatgcctgaaaccatggaaagtactgaaccctacagatacagtattgttttcctatagtactggtcccttcatacacaatgttttttcctatatatacataattatgataaagtttaatttataaattaggtacagtaagacattaacaacaaacaatgcaatggaacaataataactatagttgtaataaaacttatgtgagtatggtctctctttctctggaaatatattattataaccatggaaagcaaaactgtaagagaggactactatagttttgtttcttcctccttcttagtagctgagaagcaatatagagcaggcactctcctgtgttagggacagggatcaatcataacatctttacatgaagggtggtgaaacagaagggcaggagtgcattaagagtcaactaggatggggggatatgactcaagtgctccagctcccaaactgaaagccagcagattcaaaagagggagagcttatcttgagaaaaaatgtcatggtgccacataaggtagggaccagctgtggtggtgtagctggcaagtctaaaatttgtagggcaggcccacagtctgagagctttcagataggatgagattcttgaggcagtatttcttcttcttcagagaaacttcaattttgttcttaaatccttgcaaatgattggtccatatagattggcccacatagattatcaaagataaactccataggtgttagccacatctccaaaatactttcatggcaaccccaaaatcagtgtttgactaactgggtaagcatagtgtagccaggttgacacataaaattaactgtcaccatgttcctgggttcaagaacttaaagccaaatatgcaacctggtttggcaagcctgtgatgagttcaggggctgcaagtgctctccaggctgtcaggaaggacatggttgatgacaggagcaagattttctgaccagtcacatttattcacattttggtttaaaaaagctgctttttaaatttgtttatttttatttttttgaaaggctctgtcactcaggccggagtccagtggtatgatcttggctcactgcaaacctccgtctcccgggttcaagcgagtctcccccctcagcctccccagtagctgggactacaggcgtgtgccaccactcccagctaatttttgtatttttagtagagacggggtttcaccatgttggccagactggtctcgaactcctgactctcagttgatctacccgccttggtctcccaaagtgctgggattacaggcatgagctgccatgcctgacctcaaaagcttcttatattatgagaaagtagagccatgactcacactgttattttgagtaaatgcaaaacagtacttaaaagatcattcttgttattatttatttacttattctagaccttttctgacagtgtgaaaaagattattcttaaaaaatcattatctatagtgaagatttaactttgaggagtttttaattatgctggagagtggagtaacattcatttggggtaagcctaagagttttgtttcctaacatgtttggcctctgattttgttgtttcgcccttttatttattcactagtcttgctgtagatactaatgcttgcctgtggtttaagagaaattaagcaacttaaaaacagagcaaatagaaatgtagttagctttgcctttcttttttgcttaatgtaagggtttcgtgggaattggtgttttgggagaagttcaaatgtatttgcttttggcaatggaacaataatggtaaaggtagggtgtcttaatgtagattggttcaatttagatatgaaagtctgaaatttatattggcttgaagattttagggcaggataattttataaattctcgttattgtcattttattgtgtctgacactttttcttgaatgtaaattctcctcccctccttattctaatctgcatgtataatacctcttttacccaaattatattgatttgccagcagtctttcttgtttcctctctttttttctcctttccacttgctgttgtttaaattcaaagagttttctttgtggagactgaacctaatagtaagacagcataaaacactgagttcagcagaaagtgatttgcttgtgattaacccttgagaattaactcactgcaagataacaaagaatgaatgttttccaaacatctggctcattcttcttttccattagtagatgagacctctccatttaccctctaggtgttaggaattctcatactgtttcacttaggctttatcatactcgtcacggcatattgttagaaagtaagtccaaaagagagttcatgacataccctttctctgccacagacctctcacagtccttgcagcaaaaggcagttagtgtcattcttttagttgttcaagacaataaccttgactcttctcttttccttttagttgctcaagacaactaaaaggtccttttagttccttttggttgcaaagactttattttctttgtcttccgagagacttttggatatatttacctggtccagggtattttgaagcatgaccatatgttagattcttaattacgtttaactagcattgtccattatattttctcatttcaaaaccttgactccatatccagtgtctcagcaaatcctattggccttacctccgaactctatctagtatctcaccactttcctcatttccatcattaatcgctgtagcccaagtgaccattatctctttcatggattattttaatagacttacaactcatccccatgcctctgcttttcatcctctacaatctattctcaacatgacaagtagaatgatccttagaattttaattgaaataatcttaggcctctgctcaaaacaatgatgtactgtatcactcggagaaaagctagtctttatgttgaccatataaggcccagcatgatctgctccccttgtgacctgttcgaccttgttgcctatttttttctctttctcttcctgctgtatgcacactggccttctggctattcgttaggcacactgggcacacctgtgctttagggactttacacttgttcccattgctagtccaaaatctaaggaatcctttttcttgctttaatttttttccaaaagtcatttttttcagtgaagcttgccctactcactttaaatttgttgctcttgtagcaggacaagccgcaggcaaaacctctcagacatcgagttgtagaaggaagggctttattcagctgggagcatcggcaagctactgtcttaaaatccaagctccccgagtgcacaatttccgtcccttttacgggcacacaacactaaagattttatatgaaagggttgtgattgattgagcaatctaggggatatgtgacggggtttcatgcactggtagtcagagtgaaacagaacagagcagggagtttcacaatgttcttccatacaatgcctgaaatctatgggtaacatcgggttctaagtcatgagttgatttttaactactaggtttaggccatgcaggctcgggcgtggttttgggcctggggccaggctgcctgtctttgatttcacttccttgtttttttcttaaaacaggtactgagtataaaatataaaacaatgtgagagggtctctctcttccctcactctcaccatacaaacacatacctacttctttatctgcttaatttttttccatagcacaaatcactgcgtaaaataattatatatttttcctgttaaaattgtttgttgtctgtctctcttgctaaaatgtaccttcatgaggatagggattttgtctgatatatccctagggcttaaaatcatgactggcacatagtaaatactgagtatttattgaattaattaatgaaccagtcagagatgggaaatagccttcaagtgcctgtttgctaaattacctaacctttttattgggagtttattttccttaatgtttgtttaacaaattagttattctttcatgttttccacataacctgtggattatcttcatttttttttttttgtaaggaaatttaccagacataaggtcctaactttattttctttgtcttccgtgagacttttgaatatatttacctggtccaggatattttgaagcatgaccatatgttagatttttaattaagtttaactagcattgtccattatattttcccatttcaaaacataatttcggtcaccagtatggtacacataaaatatgagctacaagagacatctcggtggtggtgagagacaggactagttggacttcctaggccgactaagaattcctaagcctaactggggaaggtgaccgcacctacctttaaacacagggcttgtaactcagctcacgcccaaccaatcaggtagtaaagagggctcactaaaatacaaattaagctaaaagcaggaggtaaagaaatagtcaaatcatatatcgcctgagagcacagggggaggggcagtgattgggatataaacccaggcattggagcagagagtgggcaaccccctttgggtcctctcacattgtacgggagctctgttttcattctattaaatcttgcaactgcacactcttctggtccgtgtttgttacggttcgagctgagcttttgctcgctgtccaccgctgctgtttgctgccgtcgcagacctgccgctgacttacacccctctggatccagcagggtgtccactgcgtttctgatccagtgaggtgcacattgccgcacctgatcaggctaaaggctcgcctttgttactgcacggctaagtgccctaatcgagctgaacactggttgctgggttccaccgttctcttccatgacccacagcttctaatagctataatactcaccacatggcccaaggttcaatttcttggaatctgtgaggccaagaaccccaggtcagagaacaaaaggcttgccgtcattttgggagcggcccaccccatgttgggagctctaagaccaaagacccgcccgtaacagtggtaaagtttcttaagatcattttcatgtcattatacaaacttttagaaaatgacgctttgctagattttggaaatccaaagaaataaaacacagtccctacctccggaagcctacatgttggaagggatttgaaataggtaaatgagtattaactaatgtaatatatattacagtagaaagatctcctgagtactatggagtactgaagagttttgtttgggtgagaggtgagtgaagaaagcttttttgagaagatgagcttgaagttgattgctgagtaagatttcccaggagtaaagcagagaggaacaaaaggagtaagagtaaataatatgagaatgaaaaaaggaccaacatggaatgtctgtgacgttcacataggtgctggttatttttcataaccttgtttgaatcattacgagcatgttaggatacaggtatttgtatcttaattttatagatgaggaaatgggcccaaagagaatagcttaggatcacagaatgttgaattggagcccaggcctgattaacttgaagcccatggactttccatagcagccccatacatagcattcaggtgtgaaggagtagaaagtataaggggctcatgcttgctgcatggatgaaaaacttgaaggcttatttagaaagtaaaagtttagtacgagccatgaggaatgggaaagggtactaattaatgatgaggaagatgatggtacagagtaggcttgaagggccagcgggcatcagaaaccataactgtgtaatgatgctatttagtgagaacataagatttttctttagctagacctagcagtctaggatgaggattctctgtggtaactctgccaccattttgaaaccattcgatttcactgacaatttgccatctgttgctttctgcagtgctattatgcatatgcctggaagtttttaaatccaaaatattcatgcattgtatatggtcagagagaatgcagtgaaagctatgctttttgtaatttttgacaagtgtactctaaagtaatgaattttaaaaacttaggccgggtgcattggcttacgcctattatcccagcactttgggaggccaaggcaggtggatcacctgaggtcaggagttcaagaccagcctgaccaaaatggagaaacctcgtctctactaaaaatacaaaaaaaaaaaaaaaaattacccgggtatggtggctcatgcctgtaatcccagctactggggaggctgaggcaggagaatcgtttgaacccgggaggcggaggttgtggtgagccgagattgcgccattgcgctctggcttgggcaacaagagcaaaactctgtctcaaaaataaacaaaaaacaaaaagcttaaatacccttgtcccatatcacataaatttgttttttgaatatatatcatctttttttcccccatggtgaccatgacagattattaaaaactaaatttctaaatttgatgtaagtagaatgttaggtttttggtttttcttacatagagaccactgttcccaaacattatgctggaccagttgtaaaagaatttttttggtggcatttgtaactgatttcatttttaagtatatatgtgcatatatttatagaaagatcagcttgttctataagtagaagtatgtggtaccctaattttgtgtaacaacaacaaaaatatatccaataattagattttctgcaggcctagaaaatgttagctacttttttaagccataaacgtctgaatcgtcagataaaatgtttcaaaactaaaacttgcccaaggcagccttgtgaatttttttttaaagaattaaaaaaaaagcctcatatggcatccatattcatcatctactgctacatatgtgtgacacttacggcagttttagcctatactagggtacaggaatatacttacttttttaaatcatacttcctgatttcttttattttcatatcccaatttttcctaagtcaaagaaacagcaacatttctgtttctgcagaatttaacctggttattgcctagttggtagaaaatgactgtagttgtggtaccaacactatgcctgattcaccattttactattatattgtcttttcaatgtcattttttctcattctgttactggcagtttagttttaaagcatcattgtttaaaaaacattcaaaataaaagtcgaaatacatcttcatgtttacaactggatcagatatggtgttgtgcatataaaagaaacaaaatacagatcctcttagcccaaggatatgatactgaagtttagtaaacgagaaatagcatagtgatgaaagcatgctaattgtttttcaacaatagtaaaatagagaacatgttaatggaattatctgatatttacacagttatgccaagtaaaccataggttattcagaaaccccagtgtgttttagatgttattttatttttaaaattaaagccaaagaaaggtatggtcaggagttctgtgttgagttacttacttagacttagattgactccctttctcttatacttctgttttctacatttgaaactagtttctttttcctgtttgagtcattcatatatgtggaagtttgaggagaattgttactgttttacagctcacaaaatctgtgtctgaaaagaaataccaatggctttttagcaaataaaaaaatgttaggtagtagataaatttttttctaggaaacaattcatattattctgggccagttaaagttttgtttgtttgtttgttttattttatttgtttgagacagagtcttgctctgtggcccaggctggagtgcaatggcatgataatcggcacactgcaacttccacttcccaggttcaagcagttctcctgcctcagccttttgagtagctggggctacaggcacctgccaacacacctggctaattttttgtatttttagtagagacggggttttgtcatgttggccaggctggtctcgaattcctgacctcaggtgatccacctgcctcagcctcccaaagtgctgggattacaggcatgagccactctgcccggccagttttaattgcttgtaaatctaacagccttactatttccacaggaaactttataagtacttttattctttcctttaaaattttaaaaaattttttagtttttttgagacagggtctcactctgtcaccaagctgaagtacagtggcataatcacagctcactgtggcctcaatctcctgggctcaagcaatccttccacttcaggctcccaagcagccaggactacaggcacacccaactaacttttctttagtagagacagggtcttcttgtgttgccgaggctggtctcactcctgggctaaatcagttctcccatctcagcctcccaaaatgaagacttttattcttacttcagattacaaaatatgattgtataggatacatgattaaaaaaaaatttcaagttgatttcaacttctaaatatgtttttgtttgtttactgtcaattgttcatgctcaaaaagttttattttaatatcaaattaaaatacaaagagaggtaatttagattaaaccctttcaatagagaatttttaagatttaaaaaatttttttagccttgatttgaaattgaataaggaattttaattccagtaaataaatgggtttttgattagctgtgctgtattttatcgttttagtgtggataagtaagatttgattgctcaattttggttatttactgaacatccttttttactctagtgatctacctaatttgggtttctttttgttgtttttgtttcttggtattttatttatttttttgagactaagtctcactgttgccgcccaggctggagtgcaatggcgcaatctcagctcactgcaacctccgcctcccaggttcaagggattctcctgtctcagcctcccgagtagctgggattacaggtgcctgccaccacacccagctaatttttttatttttagtataagcgatggggtttcaccatgttagcaaggctggtctcgaactcctgacctcagacgatccacccatctcagcctcccaaggtgctgggattacaggcgtgagccactgtgcccagctattttattttttatttcaataagttttgggggaacaggtggtgtttggttacatggataagttctttagtggtgacatctgagattttagtgtactcatcacctgaacactgtacccagtgtgtagtcttttatccctcgctcccacccattacctgccctgtgagtccccacaatccgttgtatcaattcttatgccttgcatcctcataccttagctcctagttataaatgagaacatacaatatttggttttccgttcctgagttacttcgcttagaataatggtctccaactccatccaggttgctgcaaatgccgttatttgttcatttttatggctgagtagtacttcatggtgtgtgtgtgtgtgtgtgtgtgtgtgtatatatatcacattttctttatccgctctttgatgagcatttgggctggttccatatttttgcaattgtgaattgtgctgccataaacatgcatgtgcagtatctttttcatatgattgcttattttcctctggttggatacccaagagtgggattgctggatcaaacagcagttctacttttagttctttaaggaatcttcatactgtttttcataggggttgtactagtttaccttcctaccagcagtgtaaaagtgttccctttcaccatatccatgccaacatctattattttttgattattattattatttttttgagatggagttttgctctgttgcccaggctggagtgcagtggcgtgatctcggctcactgcaacctctggctgcttggttcaagcgattctcctgcctcagcctgccgagtagctgggattacaggcatgctccaccacagccagctaatttttgtatttttagtagagacagggtttcaccatattggccaggatggtctcgatctcctgaccttgtgatacacctgtctcagcctcccaaagtgctgggattacaggtgtgagccaccacgcccagcctattttttgatttttaaattatggccattcttgctggagtaaggtggtatggcattatgggtttgatttgcatttccctgataattagtgatgttgagccatatgttttttggctatttgtgtatcttcttttgagaattgtctgttcatgtcttagcccacttttttttttgagacagagtctcactcttgtcactcaggctggagtgcagtggtgtgatctcagctcactacaacctccacctcctgggttcaagcgattctcctgcctcaacctcccaagtagctggattacaggtgcctgccactacacctggctaatttttgtattttagtagagacagggtttcaccatgttggccaggctggtctcgaactccctgacctcaggtgatccacctgccttggcctcccaaaagtgctggattacaggcatgagacactgtgctcggccattagcataatttttgatggcattatttgtttttttcttgctgattagtttgagtttcttgtagatagtgtgtattagtcctgtgttggatacatagtttgcaaagattttcccctactctgtgggttgtttattctgctgattatttcttttgctgtgcagaagctttttagtttaattagttcccatctatttatattagtttttgttgcatttgcttttggctttttgatcattcaggagcaggttatttaatgaaatctttgcctaaaccaatgtttggaagggtttttctgatgttatcttctataatttttatgcttttaggtcttagatttatccatcttgacttgatttttgtataaggtgagagatgaggatccagtttcattcttccacatgtggcttgccagttatctcagcaccatttgttgaatagggtgtcctttccccactttatgtttttatttgctttgtggaagatcagttgactgttaagtatttggctttatttctgggttctctattctgttctattggcctatatgcctgtttttgtaccagtaccatgctgttttggtgactatggctttatagtatagtttgaagtcaggtaatgtgatgcctccagatttgttctttttccttagttttgctttggctgcatgggctgtttttttggtgccgtatgaattttaggattgttttttctagctctgtaaatgatgatgctcgtattttgatgggaattgcattgagtttgtagattgcttttggcagtacagtcattttcacaatattgattctatccatccatgggcatgtgatgtgtttccatttgtgttgtgtgtgatttctttcagcagtcttttgtatgatagttttccttgtagaggttttttacctccatggttaggtatattcctttgtaattttttgtttgttttttctttgcagctattgtaaaaggggttgagttcttgatttgattctcaggttggtcactgttagtgtatagcagagctactgatttgtgtacattaattttgtatcctgaaactttgctgaattcattgatcaattctaggagatgtttgaaggagtcttcagggttttctggtatacaatcatatcttcagcaaatagtgacagtttgacctcctctttaccgatttggatgccctttatttccctctcttgtttgattgctctggctaggacttctagtactatgttgaatagaagtggtgtaagtgggcatccttgtcttgttgcagttcccagaaggaatgctttcaacttttctccactcagtattatgttggctgtgggtttgtcttttattaccctaaggtatgttccttctatcctgattttgctgagagttttaatcatgatggaatgctggattttgtcaaatgctttttctgtgcctgttgagatgatcgggtgattgttgtttccacttctgtttagtatatcacatttattcacttgtgtgtgttaaactatctctgcatccctggtatgaaaccctcttgatcatagtggattattgttttgatatgctgttgggtttgattagttagtattttgctgaggttttttgcatctatgttcatcagggattttggtctataggtgttcattttgttgttgttatgtcatttcctggttttggtattagggtgataactggcttcatagaatgatttagggaggattccctgtttatcttttggaatattttcaataggattggtactagttctgttttgaatgtctgacaaaattcagctgtaaatccatctggtcctggacttttttttgttgacagtttttttgattaccatttcagtctcacttattgttattggtatgttctgagtttctagttctaccttgtttaatcttggagggttgtatatttcctggaatttatccatctcctctaggttttctagtttctctgtgtaagggtgttcatagtactcttgaatgatctttttatttctgtggtattggttgtaatattgttataggaaatagaaataaagtatttgggtagacggggagaagagagtccctggcagaaaactttccttctaacataaagtagctcagaaatagctcccttctaacctcatgcagttcaaagaaatcacttctctaactaaacaagcagcctgaaagatcaggctgtaaatcacagataaacccctggagcacagaaggagggcggggagtctcctgggtaatcaccaaacttcacaatgggccccagtaaaaacagtgggccttaataagcacattcctttccctttaggacatcaagatagagaagctaaaagtggacttggggaggtgggggtggagacgtcgtgggggaggggtgttggggggatgcctgcagctgcaagaagatgtctgggaacagacacagaaactctccctctcagataagcaaaagaaggcatcacagactaagtctgcccatgtgatccaggaataaagtgagagctgataaaaaaaaaaactctgctctataaagatagcacacctggtcccaactaaatcgtcaggccctaggaggataagacatcccctcctcactggcaccacccccgccacctgccactaactccctcctcactagcccatttataaaaaccctgacatttttactaagcaactcactcgggacccatctcttcaagggagagctgttctttctttttgcctattcaactttgctccaaactcaagtctgtgtgtgtagtgtgtgttcgcgacctccgtctccttgactgttcgaccaagagccttggtatttaccccagacaacgaggctgcttcagtatctcccgtttcatttctaatttagcgtatttggatcttctctcttcttttcttggttaatctaagggtctaccaattttacttatcttttcaaagaactgaaccagtttttgtttcacttttgttttgttgttgttgctgtttcaatttcctttagttcttctctgatccttctttctattctcttgctgggtttgggtttggtttgttcttgtttctctttttccttgaggtgtgaccttacattgtctatttgtgctccttcagaatttttgatgtattacatacattttgatttaatattatgaactttcctcttagcactgcttttgttttatcccagaggttttggtaggttgtgtcactaatgtcagttcagttcaaatacttttttatttttcatcttgatttcattgttgacccaaagatcattcaggagcaggttatttaatttctatgtatttgcatggttttgagggttccttttggagttgattttcagttttattccactgtggtccgagagagtacttgatataattttgattttcttaaatttattgagacttgttttttaattttttttttttttttagaaggagtttcgctcttgttgcctaggctgaagtgcaatagtgcaatctcagctcactgcaacctccacctcctgggttcaagcaagcctcccaagtagctgggactacaggcatgcaccaccacgcctggctaattttgtatttttagtagagacatggtttcaccatgttggtcaggctgattttgaactcctgacctcaggtgatccacctgcctcagcttcccaaagtgctggggttacagtgtgaaccactgtgcccagctgagactcattttgtggtctatcttggagaatgttctatgatgaatagaatgtatattcttgcagttgttgggtagaatgttctataaatatctgttaattccatttgttctagggtatagtttaagtccactgtttctttgttgactttctgtcttgataacctgtctagtgctgtcagtgaagtagtgaagtcccccactgttattgtgttgccatctatctcatttcttaggtctaatagtaaatttgggagctccagtgttaggtacatatatatctgggattgtggtattttcctgttggactgatctttttattatataatgtccctctttgtgttttttaactgttgttgctttgaagtctgttttgtctgttgtaagaacagccactcctgctggcttttggtgtccattgtcatggaataccttttgctacccctttatcttattatgtgaatgtgaaaattgttttgtttaaggaggctaaatataggacccagattccttcttgatcgtagggtttctgctgagaaatctactgttaatctctgataggttttcctttatagattacctgatatttttgcctcacaacacttaagattctttccttcatcttgactttagataacctgtgtttgtgcctacatgatttttttgcaatgaattttccaggtgttcttagagcttcttatatttggatgtctaggtctctagcaaggccagggaggttttcctcaactagtctctcaaatacattttctaaacttttagatttcccttctttgtcggggacaccagttattcttaggttatgtcatttaacgtaatcccaaacttcttggaggctttgttcctttttttaaattcttttttgtctttgtcagtttgggtcagtttgaaagccttgtctttgagctatgaagttcttttttctacttgttcgattctgttgtaactttccagtgtattttgcatttcctaagtgtgtctttcatttccagaagttgtgattgttttttctttatggtatctatttctctggatatttttatccatatactgtattatattttaaatttctttaagttggttttcacttttctttggtgcctccttgagtaacataataatcgaccttctgaaatctttatctgacaatttagagatttcttcttggtttggatccattgctggtgagctagtgtggtcttttggagatgttaaagaaccttgctttgtcatactaccagaattgtttttctggttctttctcgtttgggtagactacgtcagaggaaagatctggggctcaaaggctgctgttcagatccttttgtcccatggggtgatcctttgatgtggtgcactcccccttcctctagggattgggcttccggagagccagactgcagtgattgttactgctcttctgggtctagccacccagcagagctactgggctctgggctagtactggggagtgtctgcaaagagtcaaacacagatgtgatctgtgtttgagtctctcagctgtagataccagcacctgctccagtggaggtagcatgggagtgaagtggactctttgtagttttgtttagtgagttggttttcttgaatactgggtactagtagtacagttgttacatggacagactcaggacctctggttagccaggatgctacaggcagtggaaatagctgttttcttttttcttagagtgtggttgttcttttatgagttgctataatggcttgagtttgttggcttctagccaggaggtagagctttcaagagagcatcagctgcagcagtatgggggatacaagcttgccctaagatcacctggataagtatttggttttctcagctgatgggtggggacatagagctcccaagagattatgtcctttgtttttggctgtggggtgggttggtgtgggtggtggaaggcggcagtgtgtagagaaggatcaccaggttggggaagggtgaggcttgtctgactcagattgtccttgggcagggcttgctgtggccactgtggggtatgggggtgtggttctcagcactgggaatttgccccaggctataagcctcccactgagaaagcaagcatggctttcaggctccctgcatgctgcatcttctgtgttcatatctgcacttcctgtttgaacctctcccaccccttcctccattcctcccaggaaaattcatgctcaattgaaattatcacaaagttcatctggaactttccttctacctgtggtccttccctaattccagtggcaaccctcccgaaggacccctgtgagataaagtcagaaatggcttccctggggaccaggagtgcttatagggctcttcctgctgttgcttctacttttaattttcgctcagctctcttcagctctaggtaaggttaaatcctactgtttcctggattttcaggttccccagtgaggatgcatgttcagaggcagactccccctctcacactttgggcacttaacggtttttctgctgtctcatggagtctgcaatggcaagctgctgctttcaaagggtctgtgaattcttttggttttcctgatatgtttctggagtagttcttggagcaaaagttcacggtgtgagtctccacatgctgtttctgcacgtccgagtgggagctggaagttagtccagcttcctctccaccgtttttttctttttgttgtttttaaaggttacaaggcctttgtttttccttctgtaaaataagtctttagaagtagtctattaattttattattaaaaactcaagtttttattacattattattgaatgaaaaagtaaaatatatgtgacagaacttctgatgtgctctaggagttgaagattgaatgagatatccttcagtgagctcatatatttatatttcttcttctctttctttttttggagacggagttttgctcttgttgcccaggctggagtgcaacggcgcaatctcggctcaccgcttcccgggttcaagcgattctcctgtctcaacctcccgagtagctgggattacgggcgtgcgccaccatgcctggctaattttgtacttttagtagagccaccacacccaggatctttctttttaaagaaagattcttctgttggagcttgtgagctgaaggacttcaggaaaacccacggaatcccctcaaattgtatacagatttttgtgatgtttgtgtctcacgtgtccgtgtgaagagaccaccaaacaggctttgtgtgagcaacatggctgtttatttcacctgggtgcaggcgggctgagtccgaaaagagagtcagcaaagggtggtggattatcattagttcttacaggttttgggataggcggtgcagttaggagcaatgtttcgcgggcatggggtggatctcacaaagtgcattctgcagggtggggagaatcacaaagaaccttgttaagggtgggagagattacaaagtacactgatcagttagggtggggcagaaacaaatcacaatggaatgtcatcagttaaggctattttcacttcttttgaggatcttcagttgcttcgggctatctggatgtatacgtgcaggtcacaagggatatgatggcttagcttgggctcagggacctgacattcctgtcttcttatattaataagaaaagcaaaacaaaatagtgaagtgttggagcggcgaaaaattttgggggtggtatggagagataatgggcgatgtttctcagggctattcgagcgggattaggggcggcgtgggaacctacagttggagagattcaactggagaaagattttggggtaaggggtaatattgtggggttgttagaaggagcatttgtcatatagaattattggtgatggcctggatgtggttttgtatgaactgagaaagtaaacgaaagacacaaggtccgaataaaagaaggaggaaaataggtattaaaggactaagaattgggagtatccaggacatccaatcagagagtgtccaagggggttcaacgttattgtttgcttggttggcgagtttttgggctctatccttgagttttttatgttgtcatataccaggccagattgatttaggtaaaaacaacactcttcattaaaaaatatacagagtcctctttaacagtaagtcgaggccttggtgattttggaggaaagagaaatgcaaagccagcaactgtttgttgaagaaggattagaaacgtttgaggtaaaaccaggagccactaaataccaagagcctgagaaacagcttgggtgatttgactaataaaggccggtctgttattggactgtatagaggtgggaaggccaaactgaggaattatgtctgacagaagggaagaaatgactgcggtggtcttctcagatcctgtgggaaaggcctctacccacccagtgaaagtgtctacccagaccaagaggtattttagtttcctgacatgtgagtaaagtcaatttgccagtcctgggcaggggcaaatccctgagcttgttgtgtagggaagggatggggcctgagaaattcctgaggagtagcagaatagcagatggaatgctgagaagtgatttccttgaggatagatttccacgatggaaaggaaatgagaggttctaagaggcgggctagtggcttgtaacttaacatggaagaggttatgaaatgacgacagaatagaatgggcctgtgaggctggaaggggatattttccttggtccaagaactatttgccttgtgtgggaagagattgataggtggaagtttcagtgggggagtgggtgggagtggtcagatgagaaggagaaaagggatagaagtttgaacgctagctgcttttttagttaccttatcagcataagcattgtcctgagcgatgggatctgatgccttttgatggctgcttttttagctaccttgtcagcataagcgttgtcctgagcgatgggatctgatgccttttgatggtctttgcagtgaatgactccagcttcctttggaagtaaagcagctttgagaagagtttttattaaagaggcattgatgatggaggacccttgcatagtgaggaaacctctttctgcccatataacatcatggtggtacaggatatgtgaagtgggagcaggcatttcaaatggcggaaagcagtacaagagagggagagtgtggtgggaggtgccacatacttttcaatgaccaaatctcatttgtattcagagcgagaactcacttatcaccaagggaatggcccaagccgttcattagggatttgcccccatgatctacgcagctcctgccaagccccacctcattacatttccacatgagatgtgagtgtggacaaatgtttaaactataaggataaaaagcaagatctttaggagataagcatagagatttaggagattagcctacctgtcatgttcaagtttctatgtaggactcatatgatatagacccttgggccaactttaccctgttgcatgccccgtctctcacatgcaatacagtgactggtatgtagtgatgattttatcagtgaggatcctggtagtaataggtggattttttttttctttttgaagatagtttattgaagggactgttttcagaggtgtgaccatggtttaagataaccaagaaaggatgatgaatcacttagggactagcagcacttggaaactgttattcatccaggtgacagggcaagggtagaaatcatgttccagaactcagtgagagttgtaggcatgaaagaggagccttctcaacaggagctgtggccaaaaaagaaacaaggcaggtaagaaatggggaataaattatgccattatttctctttccttccactctttctttttctgctgatgcttcctctcactggtgaaacccaaccagaagctaaatggcaagtgaatccctagaaataaggcaaggcagagatgcagagcaaggcagataaaactagaaaatgggtctagggggagacaaatggaaataatcaacagagtgctcaatacttatttgttgaattaaactgaatttttattgttaaagtggaaaacaagcaaatgcctgatggtttaatgttttcttatatacaaaacttgaaataaaaatctctttgaaattttggaggcaactatttcatcttttgaatggttgaaatagtaaaaatgttgcaatacttaatctataaaaaattaaatactttatatttttcttttttcttttcttttttttgagacagagttttgctcttgttgcccaggctggagtgcaatggtgcagtcttggctcactgcaccctccgcctcctgggttcaagtgattctcctgcctcagccccctgagtagctgggattacaggagcccaccaccatgcccggctaattttcatatttttagtagatacggggtttcaccatgttggccaggctggtcgcaaactcctgacctcaggtaatccatctacctcggcttcccaaagtgctgggattacaggcatgagccaccacacccagcctttattttttgagagagtctctcatctgtcgcccaggctggagtgcagtggcacaatctcagctcactgcgacctccaccttccaggttcaagtgactctcatgcctcagcctcctgagtagctgggattacaggcacacgctcccatgcccagctaatttttgtatttttaatagagacggggtttcaccatgttggcaaggctggtcttgaaattctgacctcaggtgatctgcccgtcttggcctcccaaagtgttgggattacaggcgtgagccaccgcgtccagcttttattgatagtattaaaagcagttcacatttactgattgtttgacatgtcccaggtcactgtgctaaatcttttacgtgtattcttatattttatcctcacataaccctgtaacgtgtcaatactgttgctatactgttgggatgcatcactgtacaaaacaagttccacaaaggccacagatctttataatctgatattaatatttctataccattctgttgttattgttagtattctctggttactcttgaaattgagcgccttttcatatgttttagccatttaattttgtgtgtgtgttttgtgaaatcactgacttagtcttttgcccgttttctatttggttgtctttttattattaatttggaggaagcctgtgtatatttggatatgtgctattagctatgtgttgcaaatgacttctgccatctgggagattcaagctgaggtattaagagcaggtaggatttgggtaggcaaagatgagtgtttctagtgagatgaaagaataaacaaaattataagggaagaagatataattcacatattaaatagttgaatagtttgattggactaacaccagaaagctcaaaatatgtagcaccagggaagcgctagaaaatggcaaaaatatacctcagcagaacatttgctttaaatcaatacgtcttctattcaggaataacctatttcaggcaggctagacaacctgaaaggaaccccaaagatagtttgcctctctggtaggcagctctaggctttcgctcctctgccagggaatgaatcttcttttactgaaatggccttgctgtcattgccttgtgaaaaggtgtgacttaaaactggaactgatgaggggagaagcctagaggaaagtccttcctcttgtcctccggctctagatttctcagagtttttgcatattaaagttagaacaccttcatgcggctgcccttgctgacctgatgtttctcattatagagtcattccttgaaggttgggactttgatttcctatgacttggtgtatatttccctacagaacttgaatgccaatggctgaatggctttttggttttagcctccctttagtctcagcctccatcttactatgtctgcaccaatgaagaagtctattcattctgttccctagggagattatgctagtgttttaaaagtctctgccgactcttcaggatttgcctctcccaccatttatcagacaaaaatgtttctgtggtttcacttcttaattttgtatccattagaatttgttttggctccaagtgcctaaaacccaaaaatatagtggcttaggaagatggaacttttatttttatcccatgtattaataaataaaggcaattcagggatgggaaggcagctctgtgatcatctggaaccaatgtcttttcatctcattgttcttcctactttatccaagagggttgctccagcagcaatgtatgcattccagccagcaggaaggagaaatggagaaggacatctccttacccctctgtaggacttctcagaagttgcatacactactctggttgtatcttacgtgccaacgcttagttagcatagccatacctaaatctaagggaggcttggaaaaatatatctagctaaaaacaggaattcctgatcatattgaaaaaaaaaaaaaaagagaatggatattgaggattaccattgatccttgccacataaatcttttgttattgtgacactaatagtttcctgagatgtttaaggagaaaagctcagaatattgtgggtatatagccaatttaaaataaattatcatcagaattagcttatatctgacattctgaattttggacccttattttaaaatttttacactggtctagaaggtagaccttaacttttgaattttttatcatttttgataagtttggaagcttgacttctttcctaaacattgatgtaaggtttcatgaaatttttaagtatagcaaatgctgttgaacattgcaaatgtaaaatatggaggaggaaatatgtgctttttatctttatagaagataaatatattaaaccccctattaaaaatcgtctatagaaaaaattatagcaataggtagtataaaagctctgggttagagtggattcaaatatatggaaattaaatgaaaatctagaatcagttcactgagaattagctgatacagtgagcagcagatataatcccatagacactgcatatttttttaagtcctgatcttcacagtagagcttaaagaaagtgtagtattgtaatgtaattattctcattattaaaaatgatttacttttaaaacccagcatgttacatcataagtaatattcattttttcttccataggtaagaagtttgatagctgtaggactgggtgttgcagctcttgcatttgcaggtaagataaagaatacataccaataaattgcaggagaaatctttccaaatagcatctacagtgattcatgagtagacccttagtattctgaggttttggttttcagacataatacattctcattctttccaccatttgtagttactgaacatttgtcattgtagcaaaatctagataaactttatagggaagaaaattagtgataaaaagccagaaaaactagctccaataatagtttattcctggcattttttttcagtttgaagtatagtatactataaaaagaaattttaatattatgcaatgtaagtggcatggagtgcctttattctcccatatttattttttcttgcagacaggtttatacattttaagctgtcagttctttctcatgagcatagttgttccgtgtagtttattgatttgtctctaaacatattggtataattaccttgataaaccctggggaatttttttcactgctaaaattacgtttttcgaaagaatagttcttttttttttcttttttttggaatgggcaagactgtgccccttccagaggctctggggagaagccctttccttacccttcctggcctacagagtttgccttcatccttggctcatggacccttcctccattttcaaagccaacagcttagcatcttccaacctctgtctgactgtcactctcctccttctctcttaaaaagattttgtgattacactgggcccacctggataatcaaggatcatctccccatctcaagatcctgaacctaatcacatctgcaaagtcagttttattacataagggtaacatattctcaggttccaaggattaggacatggacatctttgaaggccattattcagcacagcacaatgctagtttttcttttttttgagacggagtcttgctctgcccaggctggagtgcagtggggcgatctctgctcacttcaagctccgcctcccgggttcatgccattctcctgcctcagcctcccgagtagctgggactacaggcgccagccaccatgcccagctaatgttttttgtatttttagtataaaaatacaaaatttagccaggatggtttcgatcgcctgacctcgtgatccacccacctcggcctcctaaagggctgggattacaggcgtgagccaccgtgcccggcccattcgaaagaatagttctgaagatctaaagtaaatttgctgagtctgtcattaacttacagcagttttaaattacatagctatatcctaattaaatgttaatttgagaatatgtccttattgataaagatttacttttttgttctagcatttgtgtttgtaagttctatcggtttgatcttgttaattggctcttttaggcagagctgcattccattttggctatatagagtttagtaagatctgatagaaaaatgagaaataagagggtcttgttttgtatggtatttattttctcacaattatcatttaaaacactattttaaccttttgtcttggaaatgatgaaacacttcaacaatcagaactttaaaatctagatcagtggttcagattctcttgatgtttttgtcatcaaggtcttatgtctcagttatataacttatacttaatgaatttctgaggttttatgagaagaatatcatgtctcaaacagaattctgacaaacttgcccctaaacataaaggaattttagtattaattagagtaggcatagttatgaattcaaatgtaaggttttgatttgaaattagataaagatgtattttttccagggtcgtctttgtaaaatgacaagaattggtgtgtgtattctttatagaccacaccattcccaaactcgtattactgactagaatattatattaaataacaacaagatctcttccagagccaaatacaaccaaataatagaatttaggagaaagtacacttagatgtgttagaactaggtcttctagttagagtaaacctccaggtgtcacttcttgaagcatttaactgctttttaactgagattagaagtcagtcactgtggttttgaagaattttgaggtaatataaaagctacatttcatactattataaaatcaaatggaagatgacatctatgtgataagagatacaggcaagttagggaatcagcctcatttaatttcactttatttaatgttctcctttatctcaagacctttttatcttcacattttcccatttctggcatcctgtctttcactgtaacatgtttgcacagaataacagtatacataggcaggtaaatttttctaaaacagtatacataggtagttgaatttttgcagtagaactcttgatttgcaaataggcttatggttagaagttgaattaaagcctgtagtgtcatatactggttttctagcaagactcttggagaaagagatactagtagaagacacaatctgattggggtgcaaaagataaagtagctagataatattttactcttatttgatgccctcaaaataatttagaacctgttttactattgactcttagttgttaaaactcaggggagttttgattattgggattcccaactagggaaagaactaaaaataagttttcagagagagtagccatcctcagtgagaaaaattgataattaacatccttggtaagtatttcatatgtaattgcttttttactttagagataattgattaaaaccatttctgtgtagtatagatcataaatataatttgttttctatatatttcaaagtgattatcataaaaagcaatacaattaaccattttagtattataagtatcttttatatgtaataggactttacagtttgttgtataaagaatactaggatgttattttttttgtgacctataccataatataaatgtaagatattacacataaacattgaaaatttctagttttatgatcataaactagaacttgataaatttaatggctatgataatggtattaacatgaaattttgccctccaataaattaaaaatttgaaaaaattgaccatctttctggtaagttttgaaatacttattgcaataacatatataaactatcaataaatactgttgcaagcactttgaaggtgttgattgattttgattatagaaaatacatttgcttttattccctttactatttaggtcgctacgcatttcggatctggaaacctctagaacaagttatcacagaaactgcaaagaagatttcaactcctgtaagttaaacgtggctttagttagaagactcattttgatttttgttcatatgacatatttcaattaacttagaaaatgtcttggattttccaatgtttgtagaagtttgtttccttcactatatcattggtgagtttgtctaatttactggctcagtttcttttaagttattggtcacattatttttatatctaactttattcctggttttgacatctaattattataatctgtttagtagtattacatcaaatttgatgtaacttactttacccgtttagttactgttcatttattcaataaacatttagtgagtcccccatccctgtgccaggagcttggaatagctgatgaacaaagaagacatggttcttgtcctgatgaagcttatccaagagttgatgccatcttgtaatttgaaactagtccccttataccatcatgcctggccatctcaaacataaaattatgagatttcaaccatgaaatcctgtagaacttattatacatttttgtaccagcattatagctactctggggagctgaatgtaagtgaaaaaatgaatgagagtatgtatccgtaaaagcaacagtatggattgtagtttgtaaccactgaagacaatataaagaaaagtcagtgaggccctgcagcgtaaacattggcttcagggaaacagaagcagatctgggatagatcaacttggttgagacttgagattgtcaaattgctgcaaaccaagttgatcatccgctattctgctattctgagttcctggcacagggatggggactcactaaatgtttattaaataaatgaacagtaattaaacagggaaagtaagttatgtcaaagttgatataatactactaaatgtaaaactactaaactacctactttatatatgttatttcaataaatatttcaaaacttaccagaaagactgtcattttttccaaatttataatttattggaggacagaatgtcatgttaataccattatcacagctattaaatttatcaagttctagttcatgatcataaaaccagaaattttcaatgtttatgtatagtatctttatattatggtataggtcacaaaaaatgaattgcttcttttagcaaagacattacaggcttgtgaggcttagttagccatgaataatgacagcaccaaaggatgacatactgacaaataattaaacttagattcaaaaaaacagcaagtgattttacagtcctataaatgcatgtctgtgattagagggaacataggtgtattttctgttttcctatttatattttatttggctaaaatattggtaggtattcagtaaatattctttgagcacctactacatactacattaccatagacagtgggatatagttatggaccaaagacattgccgtctaggagcttacatgttagtggagagacacagtgtaaaaaaaaaaaaatgaagtaagatatataatacctaaaagtgtcgagtgcttttgagaaaaccaaatcagggtaagaggttaaagagtaacagcaatgaggaatctttaccttagataggccaggtaaggtttctccaagaagataagggagcaggccatacaagcctctggtgtaagagcttcctaggtggtgggatcactgcaaaggtcctgaggtgcaaatgagtctagcagcaagagtaactccaaaggagtatatgaagggaatagtggtagcttgggcccagatcccttagggcctaatagacaatgaaaaaaaacttcaaattttaccttaagcgtgaaagaaagcccttggaagggtttgagcatggaggcaatgtgatttgtattttaagttatcactctgcttgctaccttagagccagagtagaagctgtgaaaccagtaagcgggtattgagatagtccgggtgatagatgatggtggcttgaaatagagtagtagcaatggacacagtaacatagttctttaaatgaattctatttatatatttccatatgtttataaataataaatggaaagaatttcagaaatcgtttcttttctgttacggtgatcttcaatatagtgtaaatagaaaattaccaagctgtgcaaaactacattatttaacattgtaaaggaagagagagcaagaaaatgagaaaatcttcagtagttggtagaggcttacagataaggccgggtaattcaagagattataagggatatactcatgtaaactctttattcagtggctcatatgacctgctccctcatctcagaggagccttacttaagagtctgagcctggtacctgcgtttcttaaagggaaatgatgtgtgtacccccttttccctctttgtggggctcaaggtaagaaacttcgccttcaataaatctggcttctttttcacaaagtgctactcttaagagtttgcagtaaaacatcttagaatatctttatcattgtcataatcataattatatttttacctcaggaaagatgcaagtacttttaaacaattttaaaactagtaatcatttccagggaaactgagaaatgaaatatgtgcatactttctgttggtactaatgaatcccagtgtcacacctcataaacacagtatacacagtgttttgattttgtaaatattattaattattgaaccaaatagggttactaaaaagacaggaactgtaattgtgggtcactaaatctctgtcattcaaaaaagattgtccaaggctcaagtttcaacggggggtctcttttccttgtttctttaaactttatttgctttctctaagctttaacatgttgtttttcaatcttatctctttttcatacttttttttcatcttgctgaaatagtgccttggataagtcttttatatggaatgcatggatggtaaatgtattttctgctttgttaaacagtttgtttcttttgttctcactgttaattatcagctgctagctccttgaaatctggtgaagccaacattagagaagtatagaaatctctgctgagactaagccttagtgcctgaactcccgcattcctgcatactcacagctagattttttggtggtcttattattcttattccattgtagacaacctattgttttggttttcttttgttgtttgggttttggggttttacattttggtggtggtggcttttatttttagctctgaaagtttgtaggattttctctttcttactgatgttctggaatttcacaagaattcttagtgagccctaacttatttgaaaatggtctttagttctgtaagattttcttacagttttttcttttattatttcttcctttcattgtctctcttttctgcttctggaactctgaacagagagatgagaaagatgttggacctgataaaaagatgtctgtcctctatgtctcttaccattttatctcttattttccatctccttatctttctttgctcttcattctacagtattttcacagcttattttccagatcaccaggttggcctttagcaatgtctattctgtttttcatctatccaccgaattcttcacatcagcattttttttttttttttggagacagagcctagtagtgcggttgcgcaatctcggctcactgcaacttctgcctcctgagtttaagtgattttcctacctcagcttcctaagtagttgggattgcaggcactcgtcactattcccagctaatttttgtatttttagtggagatggagtttcaccatgttggccaggctggtcttgagcttctgacctcaagtgatccacccacctcaacctcccaaattgctgggattataggcgtgagccactgcgcccggccaacgttagtaattttctaacttccaaggattctttcttgtttcttttttctggcaacccattttttaattaatgtggtatccttttgaatatttctaaagccattaattagcatttggccaaattctcttctgcttcctaatttatctccttttcctaaagtcagttgttatgtgttcatattggttctttttttcccctccatgataattgggtttgctcaaatgtccagtgatccttggttgttgattcatatttatgatgactaaattgactaatagaagtaatgttcttgacttttcttcagcagtttggtagggttgcttcaacagcttaattgaatgacagtgttgacagtgggctgtaaataacataggtgggtttgttaacaggcatgtctttcagagcaaggagactagaaggcagcattggtacctggagagtccaggagaggttgagcaccgtgtatattttactccttggcatagcttctcacctccctaggcttctgggttctgaaatgggatctgctggtatgcctctttggttctcttagtacctaccacccaaaataagatgcgtatcagaaaaagaggcatatggttctctttctcagcctgagggcatgacaggtacctggcctcttatgctctatatgagtagagtaggaatgatctgtttatattgttctggtttaataagtttcgctgatttttttattgttgttgactctgaatttagtgttcttgttttcctgaaaagggtttctttttttctctgatgtttgaagctgctgggatttttctgtacatgcaaattttacctaggatttctttaaactttctggtttgctatttatcccatttcttgttttctaggcctattaagggtgttttaaaatttacagtgtctttactcatttcaaaggcacttcggaaagcaaaagatctttatgattcagtctgctcttttgaacaagtgcccttttgcttgtttttttgttttttttttaaattaatgtattaatgtatattattgactcagccaatgtctaattacccttaaatttttttctgggggagaaaacccatccttcttcttttttttttgaggctttgaattttctatttgtgaatctgtccttttatttgaatataattttttaaattgcatttattttgttttatgatcaagtgaaatttatggaaaaatatactaattaaatcatcctttgttagctttaaatcaaatagattattgtacataataaagtttatagtttatgataaatgtattcttttaaaactatgggatgatccagttcttctctagttgtctggaggacttttgtgtttcaggctattgagtgaatgaattagctaatgaatactttggtttaacttagcaaaggagacacaaaataatctaacatggcactatagcatttattgctaattttagaaggaaaatgattttgatttctgtcatttatatatacaatattttatgaatgggatagtacaaaataatcatttgtaaggtccaggatgtgtttctgttttcagaaaaaaaggaccatttactccatctatttgatggtatacttgttccttacagtaatctcattttttggatctaaacattttctttgacctaccacagtgttgtcagaaaatggttctgcagtggcttatacctgtaagtcctaatataatgcaatgtgggtatattattttcaagcttaaaaggacctttcagttttattagtggggaggagtacagagttacaattttgtgctttctcatgacatagatattaattcaaacataataatggattaaaatactgtgataacagttttgttctatttaaagttatataagacctaaattttctagaagtttaggaagcatgattttctctgaagaaatgtgtaaatacagttgacccttgaacaacctgggtttgaactgcacaggtccacttaatcatgattttaaaaaataaactcaatgagccctccatgtctgcaatgaaatgtagatcaaaaatgtagtattcatgggatgcaaaactcacctatgctgaggccaactttttgtatctgtggtttctgtagggctgaccgtggtgcctgagtgcagattttagtatgagtggtcctggaaccagtcacccacagatactgagggttgaatgtattttagtagtgtgtaacatagcaattttttgttttctctttgtatacttttctgcacccagccccacatgttaagtctctattctcaaaatggtctagatctttttggaagggttgtgttgattatatgtatatacagattgacttactcgtaataaaatcagtgttcatatgaacttcttcccgacactagatttttggcagccttttctgaaactctatgtctacctgggcaaaactgaaagtgaaaaaattgctcagataccaatacctgcttttaagattaatgagcttggtgactatagtgggaatgacagtttatgaaacatgataaatttatcttttttattatgctggctccaaattttagagctccctaaggtaaataaagactcattgaaatatttttttcctgaataaagaattattctatgtagtagttcaggcatgatttaaaaacaaaagtaggagcaaatatttggtgatacttctgttttgttatgactaaatcaactaattacctttaatttagggagtaacgtatgcatctagtaaaaattttggtttcctgaaagaaaccttaaaaccagcccctattcctctaagtccctcgttttttgagacagtctgtctccattgcccaggctggagtgcagctgtgcactcacagctcactgcaacctccacctcccagggtcaagtgattctcctgcctcagcctccagagtagctgggattacaggcatgcaccactacacccagctaagtttttgtatctttagtagagacggggtttcactgtgttggccaggctggtctctaactgacctgaggtgatccgcccgcctcagcctcgcaaagtgctgggattacaggcgtgaggcaccacagtcggcccccttacttctttccatttgtatctgtatctgtatttctctctctatctctctttatatatgtgcatactctctatgtatgtttagaaagatataaaatttgttcaggttagtatgtgtgcttaacccaatttgattatccttcctctcctcaaaacttgtgtcaggggtgggggactatttgtttttttactggattataaattacttgaaacttggagagtatattatattctcacagtattgattcattgatagattagcatctgtgtgatgaaggacagtccttgatctctcatttgaaaagtgcctggtacacagcaattgctgaagtgtttattgaatgaattaattgccaggaattatttattaccaagtagaaatttataataagctgttcaaagagtatagcttatataaatggccagatctgactccctagaacccattttttaagctctagtcatttccttagtttcttttagtattcttctttctttaattgtataaatagcctgtgctcattgttgaaaatttagaagttaaaaacaaagaaaaaattataatcccaccagctaaaaataactttaaagttatatgctttcagattttatttcatgtaagcatacctatttttccctacttttgtaaggaaatggtttcatgcttagaaacgtttaatgcctgtaatcatatatgtgtatgtttcctcctaaaagctaagtttatacatcctgtttctctgtttagagctactgaaaatagtgtctttacttgctgtctccattcctttctttccattctgtcttaaatacactctaatcatacgctcacctcactttctgcagctcttctcagtttttgatgtcctctttgctaaatccagaggtcagtttgtggctctcattttactttacctattagaaactttgaaaccatttttcatttcctcactcttgacttgtagttaccatcctcctttactgctaggccttgtcagcctccttgactgattcctctccatttctataccacaaagtgttgcagtctttagggaagactccttggacttctaatttttaaaccatcttacttcagtctcatggctttaaatgctatctgtacactaatgactctcaaatgtaaagtctgatgttaagtcagacattctccacttggatatttaagacattttaaacttagtatatccgaaatcattctcctcatgtctgttattcacaacaaataaacagctgctcctttcctcagtcattaaatggcaatttggcagtttaggccagaaaccttgaagtcatttgcacagcttgggttctctggaaagcagagtgagataaagattagcaagctatacttttattaaagagtgctcttagcataaacaactccagaaagaaagggaaggacaagttaggcttcagtgcattcctacaaaagcctcagccaatctcacaataacctctaagcaaggatggctcattgtagttatcccaagttggggcaaggggtcataggattaaatgacattacccaggaagtgagcatatatataagaagtccaaggactgaaccctagagaaatacaatgtttctatcccatgtcaaccagtcagtagatacaggctgccctgcaaagtgggataagcttgacttcctttaggcaaggcaattcctaaagtgtctgacagctgggagctatcagccagccacagccccagtgtctggggagtaagtccttcacgcctgatggggatctgatgagcacataacagtgtcctcaacatcattcttaatttttctttttctcatatcccaaattcaatccatcaaggaaatgttagttctgttttaaatatacatccagaatctaaccacttttatcacctcctctgctaccgccttagttcataccatcatcatctgttgtctggattattgttatgttttctgaactggtctgctacttctactcttgcacctttctattctctacatggcagttagattaaatcgaagttagattgttattccagtgctctggcttctcctcccacttaaaattctaaattccttccattgtttacaaggccatccacagtctggttcccattatatctcgagtcctccttttctccttgttcacgcctctccagcagcattgaaaccttttaatccagcttcccagcctctcttggcttgcctgtctgctagtgtgacatactcccctcttcattagttcctccccattctctgttggctagtgtggtaggctaaacgatgtctgccatatcaacattaaatgacttcatcaaggttatccaatgagaaaagtactacagagcttagaaaaagttcaagcattttgcttctaccagtctgttttgttctttctgttgtatcttggtgtagaaaaattaatctgttttaaagtgaaaaaaagttagtattttttaagacttcatattggtcaaaatttcttgaaaagtttcattgtttggtgcttccccccgccccataattttgagttgacttctagtaaaatgcattactctcactgcagctacatgatgagattgaggtcatgccacctcatacgtggaactaatgatttcttgctctttctttcctatacagagcttttcatcctactataaaggaggatttgaacagaaaatgagtaggcgagaagctggtcttattttaggtgtaaggtaggtgtgcagcataagtattgttttgttgtgtggccaagcttgtctttaaaaaagagaaaacgttacaataaggttatacttagacttaaaattatgagtaggtggcagaggagaaaatatcaaatttttatattttaaagcctcaaatctaaaagtatcccactcccctaaaaaaacaaaacaaaacaaaacaaaaaaacaggcaaagttgtgaagtacctttattctttaacaaggatctataatatttgaatactgatgtttcagttaaccaaaatatccttttttgtgacattctctctagactcagttttataatttgatatcatattgttaattataatccaggatatgtttcatagttcttttctgcttctgcagtgtgacatcaagcatatttattgtgcttgtttcaccttagtatccttttattgtctaactttggacaatatgagagaaaattaatgatattatataattgctgtgtgatatcatttaacatttaatgttaagaatattttcccctatgataatcatttgtttaccatatgttcccttagagcctactctcaagtttttgtgggaattggttacagtatgtcatgtacaacaaatcttctgatgatataatcaacacaattaagcaaattagataataaagtcctgtattgacaaaaatgttttgatatcttgtaaattttttaaaatttaaagattttttaaaaagccaaaacattttattatttcttatgacctagcagaaaaaacaagagttgggaggaggagcccagtttagtttggtgctttatttaagagatctcatctcttcttagatgagatctctccttaccagacaatagaaaataggaaatgattttaagcatgagggtcagattaggaagtttgctatactgccaactatttcttgcttaatatcattcagaatggcattgttatttttcctgaacttttattggcctcccaaaataccctgttgattatcttgaaatctgagtataaaacattataaaaccaagtacaaaggtttttgaggatatcctttaatattatgcagggcacttacgttgttaggacagacaggagttgactgtatttttacattctcttaagatatatatttataaagttttatcccatagaactgaaagctgtataaaattcacttggaaaattcagtgattaagagcacagactctggtatcaagtatatatgcgtacaaataccagtttaacacctattaaatgggtgaccccagtttaatcatctgtaaaatagagataatagattagttttaactgcataaagttgccgtgaagattaaattatataatatatgtgaatttctttttttggaagtttttttcttttttaaacttttaggttcagggttacacgtgcaggtttattataaagataaacttgtgtcacaggggtttgttgtatagattattttgtcacccaagtactaagcctagtacccaatagttattttttctgctcctctcttacctcctaccctccaccctcaggtaggcctcagtgtctgtttttcccctcttactatttagctcccacatgtaagtgagaacatgtgatatttggttttctgtttctgcattagtttgctgaggataatggcttccagttcatccatgtttctgcaaagcccacgatctcattactttttgtggctgcgtagtattccatggtgtttatgtaccacattttctttatcctgtctaccactgatgggcatttaggttgattccatatgtttgctgttgtaaatattgccacagtgaacatatgtctgcaacacatggtacttactaactactcaataaatagcagccaagcaaagcagattattgccctgagtctgtcgcttaggcgctgccctgtatgatcttggtcaagcttttttgttttgttttgtttttagcttttctatactttggcttcttcatttttgaattgagagtaataatattctgccttgttggaataatataagaatgatatgatgatacctttttacataatacctaccaaatatcaggtgctgaaaaaaatttggctcctgtttctttccatgtctgtcacgaacgcagaagctagatatttgtcctaacacattaagtggaaaggtaaatgaaacttatctgctttcctctagccctttcttttcagtcaggcaatgttgattatgacaagataattttaagatgtgagtatattcattgaatctcagctgtgtagactatataacaggtaggtgaaggcaaaatggagccgatccttttgataacctattttaaaaatactgtatgtgttctagatgatactatacattctgacatattgcatatgagaattgtttattgaaatgtgtatttgagtctttgccttatgtttttccttgcaagagaatagtgtcctgcaatatgactcatgtctgtaacaaaaagcctgaattattttacaaagctgcccaggaaaattgtttttatacctggtatagtaagtcctcacttaatatcacccatgggttcttgtaaactgtgactttaaacaaaatgactataatgaaaccaattttttaaatcaatgaaaggatgttgaaggaaatgacattattcagggacctgccatacatcattttgcttaaaatcacagtttttaagaacctatcaacagtattgtgtattatatgaaatgatgcacatttatgatttttttttttgagacagagtcttgctctgttgcccaggctggagtacagtggcacgatctcccctcactgcaagctgcgcctcccaggttcacgccattctcctgcctcagcctcccaagtagctgggactacaggcgcccaccaccacgcctggctaattttttgtatttttagtagagacggggtttcaccgtgttagcaggatggtctcgatctcctgactttgtgatccgcctgcctcagcctctcaaagtgctgggattacaagcagaagccaccatgcctggcacatttatgatttttaagctttctaaaaacttttgtagaattctgtttataaactatattagtccattctcaagctgctatgaagaaatacccaagactgggtaatttataaggaaaaagaggtttaatggactcacagttccacatagctggggaggcctcaataatggcagaaggcaaaggaggagcaaaggcacatcttacatagtggcagcaggcaagagagcatgtgtaggggaattgccctttataaaaccatcagatctcatgagacttagtcactatcatgagaacagcacaggaaaacccgcccccatcattcagttacctcccaccggttcccctcccatgacatgaggggattatgggagctataattcaagataagatttgggtggagacagagccaaaccatatcactatatgttactcaaaagctcagtagtagaaaaaaaaaaagatgaaaccaaaactgctccatttgccagaaggtccaagaacaccactccacatacccccactgccagccagatgcattctagggaggtgtttgaaatctctggtctaggtaccatcatatttaaagttatactggaggtatatcatcatagctacatttagtttttatactaagcttaaaaactaggcttctctcatgttgtttaatctttacagcaacaaacatgtattaatattaaaatgtattaaggtccaagagacttaatataataataactaaaaggaaataaacactgccagcaaagcagaataggtctcatttccagagctcaccattaggagtctgatcattattatcttaaaggcagagtgttttgaatgccatacttgtgcatatgaactttccttccttgtgtttactttagttcagtggttggtggacctcagtatgcataatgcgttgtggagttttatgtacaaaactatgtggaactgattttcagagcattgtaattaattatcaaggaaattttgacggagtaattttcagattttgtattatgtgctcaactaaaacttaatatctagaataaaatggaccttgccatatatcttctaaaaaaatacaatggttcagcagaacattcacctatatatatatatatacacacatatatgtgcgtatgcgtatatgtgtgtatatatatgtgtgtgtgtgtatatatatatgaaatttggattttactgaacttatctcattatttagagggccacatggtgatgaaatttatgaaataggtttttaaagctcccccttttttactttaaaattatttgcatagtaatcctttataatattagtatttactaatatggagtatttgttattttaaggagtttacctttttacagtcatttttggagggtgatgtaaaatgcattaagcacttgtacgatatataatcctaatttcttttttttgtttttttttgagacggagtcttgctctgtcacccaggctggagtgcagtggcgctatcttggctcactgcaagctccgcctcctgggttcatgccattttcctgcctcagcctcccgagtagctgggaccacaggcgcccgccaccacgcctggctaattttttgtagttttagtagagacagggtttcaccatgttagccaggatggtctcgatctcctgaccttgtgatctgcccgcctcagcctcccaaagtgctgggattacaggcgtgagctactgcccccggcctacaatcctaatttctattttaagatacaaatcatagtttcagccctaaagttatttagaatctacctaacacaacatgccaaatacatacagaacagctagaaaacataagtaataaaggcaagatgtgccacagagcacctgtgtagcaaaaaaaggagttgataaatgtagattagccacagaaatcgaaatcattgagctgtaatttttcagtgtaattttttttgtttcttaataggcagttaaacagtatagtgttcatacctctggtatgatgtttaacagttattttctcaaaattcagtagtcttttaaccagacaatgtttaattgtttatctgggaggtacctacaagccaaaaagtaagtttagaatgctgcttcaaagacataggtaaacagccaagaggaatactcttaagtccttataggaaaatatttaattcattttactcatggaagactattttatgtgcctactcagcaattaatagtgcattttaatgtgcttggtgatctatcacttacccacagatcagaggtagcaagtaactagcaaggaactgccaaagactagaacaatagcagaatcaaggattgacagctgatagcataggggaggcactgttcaaaatagaacttaaatgaataacattctaggtccatttagtaggaggacaagcaaacatctgcagaccttgagagtttaattggtaataatgacaatgctgtgagccatccaagaaatgttaagttaggttatttacactttattttcaaaatgcaggagatatctaatacagtctcataagcatcctttactttcatgtgtgctaggttatgttaatctttttacttatattatctaatttttctttaaaataaacctgggggtaggttttattacgtgtatgctacgtatgagaaaattgcaactgagtttaagcaagacatactttcacagctaataagtagtggaatcaagaatttgaacctgtttctgactaactgtaaaagcacatgcttttagctattatgttgtggttcatccatgcaaattaaattattttgagctttacaataattacactgtgctttaagtcaactattattatccccatttgagactcagaaaagttaagtagcttaaacaagatagtatagctattaagtagcagtagtaggattttgttgttgttagtgttaatttttttcccttgcctagaaaatgtactaataagcaacatttccaatactggatacattgggttttacccaaataattttaggattatttaattatctactttaatttttgtttacagcataggctttaacagccaagcttttcccatgggtttttttcacaaagctaaataactatgagacataaagagttttgagatcctctgtaaaggtaaaagataactataatgaagcacttgctacattccaggtactgttctaacatttcgtaggcattaactcatttaatccttacagttgctctagccctgttttacagtgaggaaactgaagcaccaagaggataaaaatttgatcaagcttacacaatcttaagtggcaatactggcattaaaatccagcagtgtgccaggcgtggaggcttacacctgtaatcctagcattttgggaggccaaggtgggtggatcacgaggtcaggagttcgagaccagcctggacaacatgatgaaaccctgtctctactaaaatacaaaaattagccgggtgtggtggcgcgcgtctgtaatcccagctgcttgggaggctgaggcaggagaatcacttgaacctgggaggtggaggttgcagtgagctgagatcatgccactgcactccaacctgggcaacagagcaagactcctccttcttggggggtggggggggaaagtccagcagtatgcctctggaatccaaatacttgtctgctacaccgtatataccgccttccccccaaataacttagaagcataagttttcaaacttacagtattgtctgcagaagctgactcccctaacctatatgttgttttgttttttaaattgattgagaataaggattggcattacaaaggactgaagaaaaacacatgtaacattgaatcaatgatttattttgatggttagtggaattaagtggaaagctgtagtttcatatttgtccacaagatggtgaaattctcattaggtataattttttgaaacccatataaacccttaatttataatctgcatttgatgctatttattataagcactgtaatttctttttacagcccatctgctggcaaggctaagattagaacagctcataggagagtcatgattttgaatcacccagataaaggtaggtagaattcctatttttcataatatgtatatcaaaatatgctgtgaattcctttcagattaaagtcatatatgatatatagttgagatggaagtttgtgcgccacatgtattgtgatttttttctcataaatgagcatttaggttggagttcagtgattcacacaagtagtggatttatattatctgctttcaagaacttagttgctggtttttatatatgacttcctgaaccatctgatgcgcctaccatttttatcaagaaaaatcgaaaacacgagttatggactctttggttgtataaactgatttgggcatcacgaattgtatttatgtaaccttcaatgtaaaagcacaagagttagaggatttcctccaaatctgtgaatgtaatatgtcatagatgattctgaatttctgaattttattctggaaggctctgaggctgagccatttgtttttaactggccaggtttttaatgtaaatttatcttacagaaagacaattattataactttaactacactacagctgcttgagagggaaagcccatatgttcattgctgtttctgctttaaaataacagatggtagaaagttacactgtatttcagaagtcaaaggggggtgggggaggaaagtgaagggtttcttggattcttatttacagactttcagtttcctaattatttcaaaaaaattaaaaacaaattttggattcctctccatcctaaccagtaccaaaataaggcattctttttcagctttctcacttaattacttactataaaagtttttttcgctaagcatcatctctgttggtttttgcacttattattctttagtgtgaataaacatgagaataaactttcaaaagaggttttgctaaagatttctaaacagtttcaacagttactgaaagattcactcagctaatttactttgcattgtgggctatcttatgagcaagtagtgtttaaagaattacgatttattttgagatggtatatttatttgaggtgggattgttgactatagtgggcttactaacatcctttagtctcaccctgtgtggggtagctgggtgtgaaagaatggacttcggagcaagggatcagcatttttctttggcttctaccttccagtcagcattgtggccttgaaaactcccttaactccaaatatgagttttattatttgcaaaatgacaggatttatttctaaagtcctttttgtttgcatgatttaataaccttttatgcctattcaattaatgtagaggctgtaccctatgtttctgttcagatcagatttttaacttaagaaagatgcttttaatgtttttggattattgttccctctgagaatatattgacaactgtggactttttttccatataactgctcattcacccaaaatttataaacatttggagtttcagaaagttcatgcacttcctaaaacccatccatatactcacagttaagaactcctgctctagtaaaagtgtagtgataggaatgttggaacttctctctttgatggagttgagagatgatagctcataaatctaaagattatcctttgagaaggaagattgttttgttttcaatgggaagctaacagattttaaacaaaaatgcctcattgcctttggtaagcgaaatccaagagtatttggggaagtatgagaatgggcagcttttaattttgtttcttcttcttggaatccttcaacatatttactttagccaggtcaccactgggtattataggtagttggaaatacttaaatctcatttccagtgcttccgaattcatgaatatgtttccccacccacccccaaggaacttttctgttggttttgctaccagctgatagaacaagtttggaatttcaaatgtgtgaccaactataatttgttacacatttcattatcagctgtgcaaagaaagtgacaccagaaaattaggtgtgggaaatggctgaaaataaatttttgtaattagttttaaataagcattcagacgtattttggtaaaaaggaaatttttctttttcaatgtagtgagataaaaaaataatgcagtaaaaacatttcgtgtccttgatctaatgctttcaaggctaatatcttttagattactgcttttcttaaattgatgaagaaagaggttggtggttatgaaatgagtagttttacagtaatgcatagtgaatatagaaggggagaggacagattgcttagagatgtcttacaggctgtctaatgcagtcttaatcaatgtgtattttgcctattcttaccagtccagtttgtgcaagttaaaaacagaaaccaaaagtaaacatttagaaagcttataatatcgccacgatacccaaatgtgtgatacttttgtgctatgtaaaagtattggtccactaaagattggaaatgtttaaaatatttaaaaagtacacctttgccgtagcttgagaggcactgatctaatcaatgctgcctcctaaatctgggctttctgctctgtcccggggaaaatgtcctattagctctccttcaagacttttagtgattaagagcttcctgtttcacaaggcagcttgctttactggtggacagctctaactactagaaagttctttcttgcatttagatgaaatctgcctgcctgcagtggggagattctcaaccttttcccacttacacacctttcagtaaacacgcagtattctcacacttccttattagagtgtttaagtcaaaattaaatattgggatcaaaaacaagtcaaagtaattatactgttgaatggattttctctaattattctcattgtaaagtaagctaatttttatctgaagtcctgataataatatattgtaatttcttacagtatattacatttaaaaatgtgttctaaatatttagaaagagataatctccaagagtcagcatggattcactaagaaaaggtgatgcctaattaacttggtttttttttttttttgatagatttactggactgtttgttttggagggttcatctttcttttcccttcatttcagcattttagatttaaggctttgtgttaactaatttttttggtaaagagaaaattttgttttatgcattgattttccttgataaatgctgagatccttaaaagtgaagaacgtggcttactcttctttataacttatatggctgacacatcataaactctaaattcgtaagtttttttggtgagtaaatgaataaacaaatggataaaaacaaggcaaacacttggtaggtaaaacagaattggtagtgataactaatacattaaataatttcttagattagattgataggaaacaacctgacactaatcttccatttattcaaaaattatttatttagcacctactatgtgccaggcattgtgctaaatcttaagacaacttcaacaagacaattagatctctgtccccgtgggatcatgcattctaatggaggagcagacaaaaaataagtaaacctatttcaagttgtagcaaggcgataaagggtataatgagccaagatataaaacacaggagagaggcaactttacataggatgactgggaaaacctctgtgaggagatgtacaggatgagaaggagctagctgtgtgaaaagtggtaaacaaagtaaaggggctaatgtgcaaagcctctgagggagtgtgcttaaggacctgaaggaaaactagtgtgataggaatgtaataggcaaatggaaagatagcatgagataaagtggtacccagatttttaaaactaggtatgtattatgataatgaaatactgtaggttctatataagattttaactttgttccaaatgcaaagggaagttactgttaacttttaaacagtagagtgatataattcagtacaccttttaagaagtcatttttctttcatcgtcaatctctatttttgatttttaagtatactttaattgaagtgtaatttatgggcagaaaagtgcacaaatcataactatattcctttttcactttgccagcctttgcactgatggtgtaaaaatattggtgggtaaaactggtggtgtcttaacattagtcaaggcagtgacaccagtctatccatatatatgcatatgggaaaaatgaatcatgtgatgccatatgcaaaattaattcttaatggattataacctgttaaaagaaaaacttcagacaaatttagcagagtttatttgagcaatgaatgattcatgaattgggcagcactcagaaccagaagaggttcagagggcccccttaacagcataagcagcaagcttttataggccagataaagaagcaaagtagataaattacctgattggcttcagctaggcatctgccttgttttgcatgggcatggtatgatgaaacatttaccttgtttgagcatggtgtgatgagttggctgcttgtgatcagctgaaactatctgtttgttatacttctaagttgggtttcagtttgtgtaagtactaagttaggttgtagttcattacgtaggaactaagtacagagacagccccaggctaatggcatcctgcttatttaatttaacaaacctaaatatgaaaggtaaaactaacttccatattaaaaaaaacatagacttaggcaaagatttcctatacatggcataaattaaaggggaaaattttgcctctattcatgaaaaaaactaactggttattttgcctttttttgaaagttgacagatattgttatcaaggcgctctggcctcttaaaagaaattgggcagcattctttactttctgaacgtttgtgtaagattagtcttctttctttcttttttttttttttttgagatagagtcttgctccgttgcccaggctggagtgcagtgttgcgatcttggctcactgcaaactgcgcctcctgggttcacaccattctcctgcctcagcctcctgagtagctggaactacaggcgcccaccaccacacctggctaatttttttgtatttttagtagagatggggtttcactgtgttagccaggatggtctcctgacatcgtgatccacccaccttggcctcccaaagtgagattagtcttatttctaggtatttgtaagagttcacaaatgaagccatctgggcttggagacttctttgtgggaaggtttaaaattacagattcaatttattttattttttttatttctttattttttatttttgagacagaatctcactctgtcacctaggctggagtgcagtggcacgatctctgctcactgcaacctccacctcccgagttcaagtgattctcctgcctcagcctcccgagtagctgggactacaggtgtgtgccaccacgcctggctaatttttgtagattacttagtagagatggtgtttcaccatgttggccaggctggtcacgaactcctgacgtcaggtgttctgcctgccttggcctcccaaagtgctgggattacaggcgtgagccactgcgcctggccaattcaggttatttaaaagatacacatctctttcacatttttcatttctccttaatatcatttttggttagtttttttcttaggaatttgttcatttcacctaaaatttcaggtctattgttacaaatgggttcataatatcttcttattaccttggtaatgtttgtaattgcattgttaagccacatttttattcccaatattagtactttatttgtatcatctcttattaatctgtttataaaataattttttgcatcattgttatttcattccttccactatctttgagtttatttgctgttctttttctaattttttgaaatgaatagtcagatcactggtttcagctgtcattcagttcaaaatactgtaattttcattatgattttttttctttgacctgtgtgttatttgacatgcattccctcattttttaacaatagagggttttgtagttatctctatagtattgattgctagcttaattccatttgggaagagaacatactctgatttcaataatctagcatatggtcaattttgggaaaaatttgtgatcacttgaacagaatgtatattctgcagttactctatgcaatgttctagatatgtgagtaaagtttgttgactgtattgttcagatcttctgcattcttactatttcttgtctgcctactccattatctgttaagataggggtaaaacctcctacagtgattgtggatttgtctgtttcttcatttagatttttttgcttatggtgaaaaggattttggggacaaatgatttaggattgttaaatcttacatatggatttctcccttgttttaaatatctctcatgatttatagtactgctttttgccataaagcctaccttatcgaaaatatgtatagctgtaccacctttcctttggttagtgtttacatggtatatcttttttccatctttttattttcagcctttttgtatctctcttgttggtttgtctcttccaagcagaatgcagtcattttaagtgtgacaattttagacttttaatgtaactattcagtccttttacatttaatgtagtttactggtatttgaatatatacatatacacacacacatgtgtgtgtgtatatatatatataaatgttactttttgttttctatttgactcacctatattcctttttctgaccctttacttttagctggttctgttttttaaaaattttatacttttttctttagtaacttgatagatacatttttttaaaagaccatttattttgggaggcctgggcaggaggattgcttgggctcaggaattcaagaccagcctgggcaacatagcaagaccctttctccagtaaaaatttaaaaaaattagctggacatggtggcacatgccagttgttccagctacttgtgaagctgaggtgggaggattgcttaagcctgggagatggaggctacggtgagctatgatcatgctactgtactccaacataggtgacagagtgagaccctgtctcaaagaaaacaaaactgtttctttagtgactgtccaaagaatacagaatactttcttgacttactacagtctgaaataaaatattactttggccactcctaaagtaatactgggactattaattttttccagttcattgttctttcttctacactgtctaatttcctcttaaactatctattaagctcttaatgtcatttctaaaatttccagttgattcttttttatgaaatccaattctctgtaaaattctctgtaattttacgtatcttttccatcttccctctgttttcttaaatatattacttatagttatttggttttcaggccttctgtttgtatgcaaagtaatttttttgaatgccatacattttgtatgaaagcaacagttttcaaacttttttgtctcagaccgaaaaagactttatatggattctatctgtgagtatttacaataatagaaattaacactgaaaaattgttttctttttatttttctttttctttgttttcattgagacagggtcttgttccattgcccaggctagagtgcagtggtgtgatcacagctcacttcagcctcggcctctcagactcaagcagtcctcttaccctagcctctcaagtacttgggacaataggtgtgtgccaacatacccagctaattttttatttttatctttgtagaaatggactctcactatgttgtccagtctggtccctaactcctggactcaagccgtcctgccaccttggcctctcaaagtgctgggattacaggcatgagccactgtgctggcctaaaactgagaaagtttaaatatatttacctattaattcattttaaaatattaaacttcttatatattagtatagataacataatctttataaaaatatatcttttccacaataaaatttttgaagactaatgagtaaagtgacattgttttacatttttgcacatctcttttaatgtctggcttaacagaaaataccctgatataaatatcaacctctacattcattctgttgtgatatgttgttttgtttaaatgtatgaagaaaatacgacttcacacaaataggtagttgggaaaggaaagagtattttattcatcttttcaaataattgcagatattcttccttgctattaaaccagaactcaacaagtggtagcttcttaaagattagttgcattttggaacctgaaaccatgccaatgaactttcaaggtctattatattaaaatctattggtctatcttttactttgaatttttttttcccatctgtgattttgtaacgtcattcattggtcaaatactgcttcactgagagttacaaatcatccaaatgttgatgtatttcattttatcagtatttctaaagatgtggtccccacactgtcagcagcttcccctgggcaattgttagacatgcagactcttaggttccaccctagacctacttaatcagaaaacctggggttggggcccagcattttgtgtgttacgaagccctccagttgattctaatgtacactaatgtttgagaatcaccgctctaagggttccagctgggtttctggggtgttcagtggggtccctatgcgtggcaggttctgatctctaatcgcagtctccttagcattttgaaacttccaaaaactttactatgcttttcagaagcttcttgcttttttcagaaactttctactttgcttctaccctgtacaagttcagaatttggtatatacttagagggaaaaatcagctgtgtatcaggctctattttcaaacttgcctttttcagttgagttctaaatctttgagtctacaatttttgtcttagcagcttgtgagactgcaagaagccttgcctgcccccagcagcagccttcttgtgtccattgcccatacttctaatttcttgcgttccaccaagaatcatcaaataatctaagggaaaaagcaatttcagaatgtcattttacctctaaatttcctccccttccggaatctttggaccctcaagccatagttttcttagaagtttccctgtaacactaattcaacaggtggggttttttagtggttgtttcatttttgtagtgagttttgactggctttttttagttgcttttagtgtgagcatctaacacactactccatcataaccaaaagcaaaagtacagaaagttacttttgagacagtatgacaaattaattggctagccagtcatccaggaggctggtacagtaatatgagtgagaaataatgatgacctagcttaggagggagacaagaaagtgaatttgagatatgttttagaaacagaagcaacagttactgctgcttgatttgatacaggaaatttagtatttccccttgatttctgagtcaaaaaattaggtagatggtggagctatttactgaaatggggatgatctagagtggacaggtgattgtaaacaggtttaggagaaaagaaatactgtgttgatgttaaatgaattagtcagtagattgtccaagtggaaatagagaataggaattgaataaatgactctagagttcagagaagcagactggacttaagaatcatcaatataagatggtgttgaaaccaaccttaagaggtcatggaaagtgaaagtatggataagaaataggaggaaaaaaccccgaggatccaggtctaaggaaccaaacacttatagatcaagttagaaaaggggaaatcatcaaaggagacagaaggaaaaaaatgtaaggagaaaatgataccatagaagctaagaaaggaatatatttaagggaaccaagtgatcaactgggctgaatgctgctatgagaaccattaaaataaggatagagaggagggtccagagtattttttccacactggaagactttgatgaccttaaaaaacagttttaattggtgcagggctaaggaatgaaaagatgcggaagttgagttagcttatatacacaactattttgagaagttttgtgaggaagaggaggagagaaatggaatattgtctgcaacagagggatgagtcattaagggaaaaatgctgttttttgttttattttgctttttacttttttttttaattataaaagcttgttgagtaatttttagcaggtttgtttgtcagtggaaatgatcgagagaaggtgatttagaagagattaaattttgggggaaataaatgtaatgttttaagtctcaaaagtcaattgtataactgtgggacagagatttggcagtgtttcacatggaaaagagccatgggacatgtatttgatctcaaggcctgtaagattcaacagcataaaagctgctaaaaattttatgcagtcctaagctgcataaaggacacatagtatctttattaaagaccaaatattactgcaatcctctatttatttgttatgcattcattcaattaatatttatccagctgtactgagctaggcatttagatcttatctagaattttgtgtctgtttctggatcccagattttttatggatactgacaaaccaaatagtattcagaggaaattgaacaggatcatgaggtgtctggaaacaatgtcatatgagcaattattcattcaacaaaatttactgagtacttaatgtaagccagataatgcactagatactgaagaagataaccaaagaccttgctgttaggaatcttatattccactgtgagagacaatagtagataggtaattggtagtttaaaaatggccacagattcttcatagctcctcccatcaagaggtggtctgatttttcaccctttgtattcaggttggcctttgtcatttgttttgaccaatagaatatagcaaaaaatgacatgtgatttctgaacctaggcctcaagaagcattgcagcttcagctcttaccttcttagatccttgagtccaccaagtgaagaagactaagctctcctcctgacggaagaaacaccaagtagagagaggcctagctatcccagcttaggccctagtgaggccatcctggactacccagctcagaataaccaccctaccaatccacagaaaagtgagaaataaaaagaacattgttgcttttcgccactaagttttggggtggtttgttatgcagaaaaggctgatataaaaaatgcccatgatgtcatggatcataagtgctttgaagaaaaagcagagcatgaggtagagaatggcagctggaggggaggcggatgctgatttacttatagccttcttagaaattctctctaaggagataatatttgagcagagacctaaggcagtaagtcatgcaaaatgaagaaagaatatttcaggctgaagaaacaccaagtgcataggtcctgaaacgagaacatatggtttgtttctggaattataagcagatcagctggagcataggaagcaaaagggagagtggtaggaaatacaattggagaggaagcccaaggctaaatgatagagtggcttgcaagccatactacaaacttcaggttttactgttgggcattatgggaatgctattacctgttatgcagtattaggaagactattttggcagctatgaagcaaatagggagtcaagagtggaagcaaggcagtcactagagaaaactgtagtaatccaagagaatgatactgttttggatgagggttgttgtagtagaggaggtaaaggggaaaaaaaaaggtctaggcccggtacggtggctcattcctgtaatcccagcactttgggaggctgaggcggggagatcacctgaggtcgggagttcgagaccagcctgaccaacatggagaaaccccatctctattaaaaatacaaaattagccgggcgtggtggcacatgcctgtaatcccagctactcaggaggctgaggcaggagaatcacttgaacccgggaggcagaggttgcggtgagccaagatctagccattgcactctagcctgggcaacaagagcaaaactccatctcaaaaaaagaaaggtctaattcaaaatatattttgaaggaacacccaacaaagcttatgaatcaggggtaagaaaaaatgaggaaagatcactcctgggtttttggccaaagcagtggttagagaaaaagaaaatttgctatactgagaaacttagaggggatctatgcaatatcaaatacttaaaatgtggcatgtatatgtgaagtccctcttgtatgcctctatgaggacagaattatgttcactgagaagaaactctaagcagtgaaaatttgacccctataaggaagacttttcttctagctggaacgtaagacatcagtcagctagtaattattgaggctttctggaagttggtagaacagggtactttctaggcactgaagctacagcagtggaaaaagtgatgtgcagatagaggcagcaaaggtaatttgattgaaaactactagagagcaacttattagggatgtcatagaaggaatatatttattgggtaagaggtagaacctcttcagacccttccaactctgggtttctgtgattctctaatgatctgataaaccgaatcagactcaaatatttttcttcagatccccttgtctctacattatttaatgctatattgagataccataccatacaattcaattcatccatttaaggtatacagttcagtagttctggtatattctcagacatgtgcaaacatcgcactcaattttggaacattttgatcacctcaggaagaaacccctttagctattgtcccctcatcttcctgttctcagttcagtttcattgatcagtctgtctgtccttgtcctagtaccacactgtcttgattactgttgctttgtagtaagttttaatattgtgaaatgtgagtcctcctactttattcttattttgtagaattgttttggctattatggtccttccataataattccatatgaattttagaaccagcttgtcaatttctacaaggaaatcagctgagatttttgataaggattgcattaaatctgtaaattagaatggggaattttgccattttaacagtgttaagtcttctgatccacagagacatgatgtttttctatttatttagatcttccttaatttctttcaacagtgttttgtagtttacaagtctgagttttggacttcttttgttaagtttattcctattttattctttttaatgctattgtgaatggaattattttataattttattttcaggttgtttattataaatgtatagaaatacaattaagttgtatattgatcttttatcccacaaccttgctgaacttatttattaggtctaatagttattggtggattctttaggattttcagtatacaagatcatgtcacctatgaatagtgatagtcttacttcttgctttccaatctggatgtctttttcttttttaacctcattagactggcttgaacctccattacaatgttgactaggtttattaagaacagacatccttgtcttgcttctgatcttagggaaaagcatccagtcttcgctcattcaatctgtgggttttttgtagatgctttttatctacaaacatactaacacttagagaacgtctgtctattcctagtttgctaggtgcttttttcctgaaagtgtgttgaatcttgtcaaatgctttttctccatgtattgagatcattatgtgaatttttttttcttttgatgagactcgatatatttattttttggtggttaaaccaaacttgcatccctgtgttaaatcccacagggatttgcaaggtttataattcctgcatcccttggttggttgtggtttataattctttttatatgtttatatattctttttatatgttgctgggtttggtttgctagtattgtgttttagtatctttgcatccacacttataagatatattgatcagtagctttcttatgatatctttgtctggttttggtgtgaagataatataatgtaggctttataaaataaattaggaaatgttctctttctctcttctataagccatcaggggctgggcttttctttgtgggtagttttttgtttactgattcagtctcttgttgcaggaatattcaagttgtctcttcttgagtcagtatcagtagtttgtatcttttaggagcttgtccattttctctaaattatctaatttattgacatacagttgtttctcttctttttccattgtcttaggttgaaggttaagttattgaagtcttttttttttttttttttttgaaacagggtctcactctgtcacccagactggagtgcagtggcacagtcatagctcactgcagccttgacctcctgggcttaagtgatccttccaccttagcctcctgagtagctgggactataggcacatgccaccttgctcagctaatttttttattttttgtagagatagggttttgccctgtttctgaggctggtggtctcaaattcctgagattaagtgatccgtgcccccctcaccctcccaaagtgctgggattacaagtgtgacccactgtgcccagccgtcttcttttttaacatagacatttatagcaataaatttctctgcactgctatcgctgtgtcccataagctgtgggtggtgttattcatgtttaatacattctattattgtcggagaatacagtgtattatttctgtccttttcaacttattaaggtttgttttgtggcctattatatgctctgtcctggagaatgtcctctgtgcatttgagaaaaattgcgtattccattattgggtagtgttctgtaaatatgtgttagttcttgttagtttatagtattaagtcttctgtttccttgttggtcttttgtgtggttgttctgttattgaaagtggggtattagctggtatttattcttcatttcttagtttctgtttttgttttggttggtttttgcttcatatattttggtgctctattgttaggtgcacatatgtttacagttgtcccatcttccaggttgattggcccgtttttcattatggaatgcccctttttgtctctaataacatttttggtttcaaagtttactttgtctcattagccactctagcttttcagtgatttgctgctgtcaggatatgtctttttccatccttttacttttcagtatttttgtcttcaaatctaaagtgtgtctcctgtagagaacatatagttggctcatgcttgtttgcttttcttcaatttttaatagaaacagggtcttgctatattgctcaggctagcctcaaactcctgggctcaagtgatcctcctgccccagcctcccagagtgctgggattataggcattgagccactgtacctggctgggtcatgttgtaatttaatccggtgcgacagcctttgccttttgattggattgtttaatcctttctcatttagtgttatgatttattatttacttttatttcagtagttttgggggaacaagtggtgtttggttgcatggaaaagcttttttgtggtgatttctgagattttggtgcactcatcacccaagcagtgtacactgtacctaatgtgtagtctttcgtccctcatctcccttttctttcttccccctaagtctccaaagtccattatatcattcttatgcccttgtgtcctccaaagtccattatatcattcttatgccctttcacttataagtgagaatatacaatgattggttttccattccggagttactttgcatagaataatggtctccaattccatccagatagttgcaaatgccattattttatttctttttatggctgagtagtattccattatagatatgtaccatgttttctttatcctcatgttggttgatgggcatttaagctggttccatatttttacaattgtgaattgtgctgctataaacatgtgtgcaagtgtctttttcacataatgacttcttttcctgtggaaagatacctagtagtgggattgctgaatcaaatggcaggtcttttagttctttaaggaatctacatactattttccgtagtggttatactagttatactcacaccagcagtgtatcagtgttcccttttcaccacatccatgccaacatttataattttttttgattttttaattatggccatttttggaggagtaagatggtatggcattctggttttgatttgcatttccctgataattagtgatattgagcatttttttaatgtttgttggccatttgtgtatcttcttttgagaattgtcttttcatgtccttagcccactttttgatgggattatttatttttttcttgctgattggtttgagtttcttgtagattctgtatattagccctttgtcagatacacagtttgtgagattttctcctactctgtgggttgtctgtttattctgctgattatttcttttgctatgcagaagcttgactgaaagcttttattatgaatgtgtgttgaattttctgaacttattgacatgattatgtatttattttggctgggcgtggtgattcacgcctgtaatcccagcactttggggggaggaggctgcagtgagccaagatctagccattgcactgcagcctgggcaacaagagagaaactccgtctcaaaaaataaattaataaatatatatttattttttattaatgtggtaaattacatcgattaatttttgaatgtgtaagccagtcttgcattcctgagataaacctaacttggtcatcatatctagtctgatttgataagtgagtattttgtttgttttgcacctgtgctcatgagagatctgggtctgtggtttccttgtgacattttcattagggtttgttatcaaagatatgccagcctcataaaaagagtttaaagtgttttctttctcttctgtttttcggaaaaattcaacaaaatcatggccaggatttttatttatgggaaggtttttaattacatatttagtttcttaaatattcttttgattttccatttcttcttatattaattttgaaatgttttctttttcttggaatttatcttttacatttttatgtgctctgacatgaagttgattagttttttagagaactaatctttccctgtgttgattctctctcgaatgctaatttctattgtgatatcttccttgacgcatgagttatttaggagtatattgattaatattctaacattgggatcttctatatgtgtttaattctactatggtcagctaacagactccgtttcaatgtttctgaaactctgtgttggaggactttgtttttttctctcaatctctggtgaactgacagcttttgtaaaatacaatgaaaatgaaattatgagaaaattgaagaaaaaagtatgtatataagatccaggttttacaggggtacactgttatttcaaacaggtatattttctaaacacttaatctcaatttccaaacctatctatggtctaatagcagttgtaagtcaacattcatccatggaacacactttaaatagcaccgtttattgttattttaatctttgaagtttgtcgagacttgcttttagcctagcacatgatcagttacagtaaatgttccatgtgcagtttaaaagaagatatgttctgcacttgcagggtggaatcttgtatgtgtgtcagttaaatcaagtttgttgatgttatttaacttcagtgttcttactctttcattttgtctacttgttttatgcattattgagaagaggcatcactcactaaaattgtagatttgtgggtttttccttttggttctctccttttttcctttgtatattttgaggctatcttattaggtatattcagatttacaattgctttctcttaccagtagactgacccttgtaacactgtgaaattggctgttttatttttgcattttaccttaaaatgtactttatctaataattagtataacaatgtcagcgttatttttgatagtgtatatttttttctatttcttaaaagtatagtctcttataacaatatataacctgctggatttttattaatcaactttattgagatataatttatatagaataaaatgcacccatttaaacgcacaatttgacaagttctggcaaatatatatgtgcatgtaatcactaacagtcaagacatacaccatttccataagctccaaaggttcctttttgccccttcccattgccaatccctccccacagcctgggcaatcaccattcttctttctgccacagactatagattaaacatgtcttttctagagtttcatatatatctggaatagtattatatactcttctgtgtctggcttctttgaaggaaaaaagcagtgcagaatgttgggctcatcatagtgcatttccgttatctccaggatcttggccctcaagacctgactgacttggtagccctccagtgcttttatactgatgtgtttatattttatttagctcttctagttgggtgtcagtgggagagttggccttaaacatgatggttcacaatagccagaagcagaagacttctggccatatttagtggtagaagtacaaagatacagaaatactaagggtgaaggtgagtgttctaattaaatggaacccactgaattcccctagaaaactgagaggggttgaagagtgttattttttttgttctttttcttttcttttcttttctttttttttttttggagatagggccccaccctgtcgtccaggctggagtgcagtggtgcgatcaagactcactgcagcctcaacctcctgggctcaagtgatcctccacctcagcctctccagtagttcagactacaggtgtgcaccaccacacccaactaattttttaattttttgtagagacagagtcttattatgttgcccaggctggtctcagactcctgggctcaagtgatcctctcacctcaccctcccaaagtgctgggattacaggcgtgagccactgtgtccagccaagagtattttgttttcattaaatttagggtatgcatcctatcctatgttatcagtcaggattcactgccagcaactagatattataaccaggagagcatttagtacaggttacatattgttggaagatctgaaggagcaagttctacacttggcctacaagaatcattcctaaacaattacagagctactctgtcagggaagctgctgcctcacaggctgccactagaactgtgggagaagcacagttgctgccaccactataccacactcttgcttactagtagtaataatgataaagaggtgcagcaagaaagcctttctctcatttcagccttccaagtcccacaagaatggctctaattaatggaacctaatgtgaatcaaacactacttgaagagactataagaattgtagttttggactgaggaacttttccaactatttagaggtagaatgagggtcaaaagaaccagtccaaaatgtctaccatgtacataaattaaaagccctctaacttagagtgagtggtagagaattcaacgttattctgaataaattgtcatgtcatttttttcctctaacattgctatcaataagtataatatttaataagactctctatcatctgtgcctttgattttttccaactgctgagtgagcatagtatggcctatgatttaaatatccataatgcatatcaattaaaggttatgtttaagttcagttaatattttaatatttgctgaggatatccaagacatcgaggacatcaccctgataactctaagaatttaaacagcttaccacattgacattacctaattcctgattgctagattgtcttcaaagataatcatgaaatcaacatatttcataaccaagtgctttaaacttttatcagctttctttgtaactcttatagcatattcagggacatactatgatatattccataagtgtttatagcaattcagatcttgatatgaaaatgtcagttgtatcctcaagggcaaagaggtaaatatagctttctccagcattaccccttctaccacaacaccatgtttgttgatctattttctttgctttcttttcccttcataagctgggtggtatggtatcaataaaaggccagaaaaaagtcagaacaatttacaccaatactagctagatgctttttggtttgttgtaagctactgagaccttatgatattttcagcagctatagatggtttgcacttaaggggagaatacaaaataaaaaacacaaagagactggtgagctgtaatatgattgttagtctaagcattaaacaatgacagtattgaggactagaagttagaaggtatatgatgtttagctttcatgtgacagtttggtgctagtatttttgtatgtaggttctgtttgtgatttacaatgattctgcatttgaaattcacctcaattttcctcttgctgtttgcattagaaagaattcattgcaaagaactctaaaaaagaactgacttaattttattttttgcactgtaaatccaaaactacactctgtaaatattcgaatagaatcatttcagagaacaaaaaaaattttttgacattatttttatctctcatttattaagattagatcatttatctctattaagtaaataggtttttggcactgggtagtatatagttgcctttttaaacatacattttatttttgtgacattataagacttgattaatactttaaaagaccccttggattgatttaccttcttcaaaaagatacccgttttcacagatgaatgtgtctttaaaaaaaaaaaaacagtcatggaaaagactgttattttacttgcctaaccatccacttaattttagaaaattctctggtcaaatacttgaaaggtgaatgtctgaccagtgcagtagttgaatgttgttcaagttattcctgattataactttctttcatcatttttctcagaggtttttttttattgttgggtagttgtaggacttcactaatcaagtttaatttatactgttttgatttctagttagcttataaaataatttgtcagaggattaatgtgtgagacaatattcaaaaaagagtatttttatattttggggactttaaagtatgtcaatgatgaaatgtattttaattcatttttctttgttctctcaggtggatctccttacgtagcagccaaaataaatgaagcaaaagacttgctagaaacaaccaccaaacattgatgcttaaggaccacactgaaggaaaaaaaaagaggggacttcgaaaaaaaaaaaagccctgcaaaatattctaaaacatggtcttcttaattttctatatggattgaccacagtcttatcttccaccattaagctgtataacaataaaatgttaatagtcttgctttttattatcttttaaagatctccttaaattctataactgatcttttttcttattttgtttgtgacattcatacatttttaagatttttgttatgttctgaattcccccctacacacacacacacacacacacacacacacacgtgcaaaaaatatgatcaagaatgcaattgggatttgtgagcaatgagtagacctcttattgtttatatttgtaccctcattgtcaatttttttttagggaatttgggactctgcctatataaggtgttttaaatgtcttgagaacaagcactggctgatacctcttggagatatgatctgaaatgtaatggaatttattaaatggtgtttagtaaagtaggggttaaggacttgttaaagaaccccactatctctgagaccctatagccaaagcatgaggacttggagagctactaaaatgattcaggtttacaaaatgagccctgtgaggaaaggttgagagaagtctgaggagtttgtatttaattatagtcttccagtactgtatattcattcattactcattctacaaatatttattgaccccttttgatgtgcaaggcactatcgtgcgtcccctgagagttgcaagtatgaagcagtcatggatcatgaaccaaaggaacttatatgtagaggaaggataaatcacaaatagtgaatactgttagatacagatgatatattttaaaagttcaaaggaagaaaagaatgtgttaaacactgcatgagaggaggaataagtggcatagagctaggctttagaaaagaaaaatattccgataccatatgattggtgaggtaagtgttattctgagatgagaattagcagaaatagatatatcaatcggagtgattagagtgcagggtttctggaaagcaaggtttggacagagtggtcatcaaaggccagccctgtgacttacactgcattaaattaatttcttagaacatagtccctgatcattatcactttactattccaaaggtgagagaacagattcagatagagtgccagcattgtttcccagtattcctttacaaatcttgggttcattccaggtaaactgaactactgcattgtttctatcttaaaatactttttagatatcctagatgcatctttcaacttctaacattctgtagtttaggagttctcaaccttggcattattgacatgttaggccaaataattttttttgtgggaggtctcttgtgcgttttagatgattagcaataatccctgacctgttatctactaaagactagtcgtttctcatcagttgtgacaacaaaaatggttccagatattgccaaatgccctttagaggacagtaatcgcccccagttgagaaccatttcagtaaaactttaattactattttttcttttggtttataaaataatgatcctgaattaaattgatggaaccttgaagtcgataaaatatatttcttgctttaaagtccccatacgtgtcctactaattttctcatgctttagtgttttcacttttctcctgttatccttgtacctaagaatgccatcccaatccccagatgtccacctgcccaaagtctaggcatagctgaaggccaagctaaaatgtatccctctttttctggtacatgcagcaaaagtaatatgaattatcagctttctgagagcaggcattgtatctgtcttgtttggtgttacattggcacccaataaatatttgttgagtgaatgaa

SEQ ID NO: 1647 - DNA, 415914 bp, Homo sapiens
ttttactaaaacagaaagactttcaggaaaatgtcatttaatgatttcagctatacattacatatacaactctgtagcctagcaacaatcattgctacaccatcattaactttaaatattttgcttggtgagctattctcaaatgtagcacattttaagattttgccatcattatgactgtggaatcattgtttggttttcataggaaacagatctgtcacagtatgaagctttgtttattttaagaaactggtacacaattacatttccacttacaagagaacgccacagatataactaaaggcaggcttcgatggctccacaaaggttgcgtgctggaccaaccccacacctcctgcttccccgtcgcaccgccctggccaggttcacatggtttcatttccagagatgctttgctcttcgcagttaggtagttttaattccttcaaaggcacacagcttccatcttttttccagcgtggctcccacacccgtgaattcctgtttgaacatgcgtggcagcctcatcaaaagcatttctatttcatttgcagatatctgttagaaaggaaggaaagtcactttggggaaaggaactcatcttaaaggaggaatggattggggaaggatgagctttcccagtgatatgaacagcatttagttttctactgggctgtcagggggatgtccttatagaaggaacattcagaagtactgaatgtgattatcccacctcccgagcagctggcggggtggggcgtgggttggctgggcggaaagtgccaagttcacccttcatatggatggctaccttactggcagcaccattcctgaacagccctcccctgatataaaaggagatggggagggaatttaagagggctcccagcaaatccatcaccactcctggaaagctactagtggcttcatcctcatctatgaaggacagcaattttctttaatgctgccaggagcagaagacattcgggtggatttcttgccacccaaatttctttctcttccttaattttcacatagaccagagaccataaagcttttggaatggaatctaaactccaaaacctacaacaatacaagtcttgatatctagtcataaaattcaggtatattttttaatgcaacttttttcttctccatatttttatttgatgaatttttacaccaataattcattttaaagaacaaatcagccataatccctctgctctagcacagtgattgcttttgttgtcctgtgttagcatgccaatccatgtgtatgcatgtggattttatacagcagggcggccaatttggggtctgatattctgtttgaatatccccaaaatttggggtctgatactctgtttgaatcctgtatcttcattctcacaagttaaatgacccttacagagataattagtctctttaagcctcagcaaatggaaataacatttaataaggatagcatgaaaattactggcttaccacagatatgggcacatagaaatgttcattgaatcagagctattacactttttcatggtgtaatcactgtagagatatcattttagagtctacactttccatttaacaatattaggattcatttaaaagagacaccaaatagaccaagaagtcaaatcaactgtttatttaatattctcatggaaaagacttcatatgacacattcaatattcctgggcctataatacaaaactttagttaaatagaggcagttctgaaaattgaaatacattgtattctaaaatttttgggaattgttttgaaatctgaatgcattttctgatacacaccatattagatggatggttaaattcccaggtcaaccgacaaaagcctatgagacagattatgtgaaggttcataataactttgagaagtaagttttctttcagtcaccaccagtgttctcatttcattctcacagcactctggtgagattcgtgagcagatattaagatgcatctccattttatagttcagaaaacggtgtgagctacagagggttaagtgttttatcaaagacacaacttgggaaagaacccaagggttctttcatgggttggggcctgggccttgattggtgtgccttaagcacttcccatgattgtcaacagccaggggtgaacaaccaggggtgctgggaggtctttctcagtagcggtcacctggaggcacttgttaaaaaaatcagatcccccagccagcctcttctctggagatccggattcagctggtcttgggtgtagcccacataatctatttttaacaaccatcccagatcattcttatagtcaggcatatttgggttaagaatggggacttaggccgggcgttgtagctcatgcctgtaatcccagcatttggggaggccgaggtgggtggatcatgaggtcaggagatcgaggccatcttggctaacatggtaaaaccctgtctctactaaaaatacaaaaaattagccgggtgtggtggcgcgtgcctgtaatcccagctactcaggaggccaagaggcagaagaatcgcttgaacctgggaggcggaggttgcagtaagccgagatggcaccaccgcactccatcctgggggacagagagagactccgtctcaaaaaaaaatggggacttaagccagacaagcttggattttactctggctaggcctcaagctgtgtgactttgggaagattacttaacatttgtaattctcagtttcttcaggtgtgtaatagaagtcatatctctcagggtattgtaaggattatatgtaaaatgtaacacagtgcctggcacaagttctctctccttatgtagacatgtatatgtgtgtgtgtatggaatattgatagaaaatgacactattatctaaccttttgtagtacggagtggtatgtggtcaaaactagtttttcataggtccaggaggcagctttttttaagcctcatgagaccaagttatcttctcaaagagttcccttctttcttttggaggaggacagcacagatcatctatggtgggctctagtctccagtcaaattcaagtgccacccctggcatgtccttccccagatcaaggagaggccatagcggaacacacaggccgaggtgcctgccagcccaccagcaccttgtttacagtgtaaccgccacctcccttggaaatgtagggaagaaggtttgtgccattcattagggaggggataaaaagctaagtttttgagggtaaaataaatatctgatttaaatataacgtgtaggaggccagctggggtcagaaggggcagtgccacccagcagccctgcagctggctgtaaaaagtgtgacaacttacaatcaccaggaaacttttccttgccaaactcttctgaaaacactatttaattctcaccacactctcataagatagggaataatttaccaataagaaaactgaggccctgagagactcagtaaatcccacagggtaacacaggcagtaagtgtggaccagacctcctggctgtggtgccttgttcttaaccacccctgcccacctccaccagggagaggaccatggagtaaggacaggaaataatcctcttggtcactgcctctctggccctgggtgggtgtggatgccatggcaggcatctgtgtacaggagggcagggctcctctgtgatgaatactattagagtgatagcaacatcaacagcaaaaaactgaaaattcccaactcacctggctcacacacgttcatattgctgatgctcgggcacccccacattaaccatccatcaaaacggtaagcaaatcatgggaagtcttggctagcatgtactgaaatgtggcaacatcttgttttccatggtgtcttttgacctgagcctagactttaaccacaaaggaagcaggacaaggcttgcagcgggacagaggtagctaccatttaccgagtcttcactgtggggcagggaagagtaaattcttcaccagcattatctcatcagaaagctcattaaacaagcaagtgcccccctcacttgctggagtaaagaaaaggagacacaaaagatttggatcacagtgatagaacaatcagtaacctcttccagtttagtagttaagtaaccagtcacttaacttctttgggcctgtcttctcatttccaagacaagggaattggaaagaaacacagggaatgccctgaggacttggtttgtgtgctggcctctccatatcctagctctagccttaggacaagccattcaaaatttatctgtcaattaggttgtggcaaagatcttaaaatgagaggatgtgataggtcttttgcgcaccttaaagcacaaaacaaatgacggtccccactttagtagcacttattgtgtgccaggtactgttctggaatgcttttcatctactaagtcatttaatatcaaggataaccccccaaaaaccactttacagatggtggaacttaggcacagagatgttaaataagctgtccaaggtcaaacagctaagaagtgatgaaactgggatttgaaatcctcgtaattacttaatacatacttcagattttgagaaagccagaaattagtgtaatgggaattaatctcaaatgtattagctgtagtttctgttggtagtgtaagatataacagctgggttctgccacaaagatgcaaataatacagagttgtgtcataattatggaacagaccacttcaaataaaaatctatctaaaatatccatttaataaggctctcagcagctgggcatggtggctcacacttataatcccagcactttgggaggctaaggtgagaggatcacttgagcccaggagtttgagaccagcctgggcaacatagagagacccaatctctacaaaacatacaaaaattagccgatatggtggcatgtccctgtggtcccagctactcaggagactgaggcaagaggattccttgagcacaggggttggagcctgcagtgagctgtgattgctccactgcactccagcttgggtgacagagtgagaccctgacacaagaaaaaaagggatctcagctaattctagaagaattccttaaagttgtttaaagatatttatatctcatgacagaagaaagatcagggagaaagctgtatcaggtaagttagttttatgattttcaaacttttcccctaccctgacaaaataacctttatgatattttatcttttgggatttttaagacaaattcaagagaaaattcaatttgtcctttgttttctccctatggccaaagaatttttactttataaatacttccacttacttcagttctgttctcttcctaataatttgtcagctattatcatcttgccatcacaatatcctttgccttcccaccagtacattctttgtctagagaattgagactctggagtcattacttaaaccaagcacccagacctcactggctgagctctgagtgaagtttacccctttcctcatctcctgcacgattttcttccctgaatcacttctgagaccagggattctctctaagctcctacttctgttcacacatggagccctgggttcctgggaagagctgttgcttgcccagcaggtaagtgaaggggtagaacttggagcaaggattatgaatccagcccggctttcagagtgacgcattccctcactcccaagcatattatgaggagatgattgcaatacacgtggttaagggagcactgtgtagcactgtgatatagattagagatagatgccatgactatgaaatcttttccccatacaccatgtatttggtgctctagcaagtggagaggatagtcataaccctgaagttttgattaccctcttacccaggtggcttttgttccaagaaatttgtggcctatatattttcaatctttgatattgtcagtggattcttctacctgttttgtttgaaactttcttaaatttattcttttaggaaggatttatttgctacaaatacaaaaaagaaagaaagcaaacatcagaaggaaacaggctgtgtgtaactaaggagcttgtgtgctgttgataccgcagaggtcatttataaaatctgcttgatttattttttaatttgctcactctaggccaagcctactgcctccttgcccggcctctaatcacatgtacaaatggacacaagcagatgcaaatcaatttgttctcatcatggttggctccataccccgtatcatcaggcaagggaagcctggtgaagaggggctcctgtttgggctactgaaaagacgccggcagaggccggagcgtcagggaagccagttgaaaaccagacttccttccatgggcaaaactgacttctagcctttaaatgcacatttaaatcttgttcattcttcacatcctgggcagggcacagtgttagcacacacagacacctcacaacaaatgttcacagagagaaatacaaaatgtagatggggcaaagggaggggaggaaggaagggagaaagaaggaaaagaggaaagaagacaagaagtcaggaattcgaaggagtgaagcaagaaactggtagaggaagggaaggaggcagaaaaaatgtgatgaaagaaggtaaacaggagagaattaaaaggagaaaagaatatggaaggaaaatgagggcaggaaggagagaagaaagggtgggtagaaagaggagaaaggaaagaaatgtggcaatgttggctaaagcatcccagagggaagccaccagaagaagcatggactcgagggtaccttgctgttaatcatgactcacagatttcacccttctctaactcctagttcagagagtatcttccctacccaatttagcacttcattagttcatgtctgagtctcaaatcatttcataactaggctacaagcttgttgagaatagggttctatcttaggtttcttttgtgccttggtcatctcctgttcttctctggtccctaagacagtgctgggtacatgaaaagcagtgaattatcccagcattcattaggtccctggtaaccttaccaacttctctcactgtggtgcacagccttttttttgttctttatgtagtcaagtggggagtattgttatctctgctgtcatatgctttccagaagtgctgtaatatctaaaaaacccattcattatagtctgtctaaaggatcactcattgatattactgtgacaggctgctcttaaggagaaccccagaatatgcatactattaaggatcattcaggtgggcaatctcataaacactactgagagcatttccccaccctcatcacctggttatagtctgggaaagaatgctatccaattaattaaacaggatctgaatctcctttccatagccaagacatttaaattttgtgtttgcagaggtatgctattagtacagaagtgcgaatgattctcccctctgtgggaaatgtaacacatgcccatgacctctcaagctggtcacagtggtgtcgtgccaaaatagcaggtccttctatatcctccagcctctgtggccacattacgctgagtctggttttcagaaccaaatcttccacaccatgggccttgggaagaggctgcaggtgtgtagagggggcaaccagacacgcttggaaaactgagccttcatctcctaaaggatatataaacagggaagagcagacgaaccctcctcttgactgtaagaagtattcatctgctaatgctcaagtcaaatgtttcttctgggctgcttcggagagacaagaggttgggcttgatgggccctggggctgacatgggagattctatgtactgatagaaaccattttcatcatagtgctgcctattttaaagagtttgcctgctgtgctctgggcatgatttttgactcagcaaagcttcagaagccatggctgcccccaacccggaccctgttttcctctgaatgaatcttcctttttcaagtgtttctgatacaagagaaccgggtgaatgagagtgggtaatttagaaaaggccaagaagagaaaaatatgcaaatatgcaaatatcaacagcaggaataatatttaactggaaaatagcttattattgggctacatggttttaggaagccatgtgcaatgtacatgcccggcataatttaaattaattccttccattcctagtcattcttacacccatatgtagcctttggggaaatcctgaccacaacagtgacattacaggactgggtggagcctgctttccctgttctcatcagtacagggtgggcactggattttgctctctggattaaaaagtctaaatatcctctcagcctcactggaatagaaagcatgtggtctgatccctggtgcccagcagttttagagtactttttcaatatactttctaccccaggcatgagaaggaacctgacagctctgtgggcgtttcattcagaagatggagagctatctgggagtaggcaggggacacctcgtgtgtttcctctgtgagggaaatactttcttcatcactctaaaataaaagtaccagtctgcgatgagatacaattcctttgactgaatcccatccagaaaggcccatcatctaatggccagggacaaggcatgtgaattctctctcctcagagactggtaagggaacgtcacaaatcttacctgagccctgaggataagaatagaacaagagcttctacccgccaccccctccccgccagccaaaacaaatcaattcattacttatcaatccctgcccattcccaggagatgattttacacacacacacacacacacacacgcaggcacacacacttcactggtgatcatcatagattctcagcctgcgatgatggagtggaggaaacaaagtgtcctgaaattctttgataaacgacaagtggattgttggccattttagctcctactaaaacaacagctgcttctcaacaaaggcttctcacttgggacttgcagaaagggagaacagaaatgtcaacagtacaagggaaggatggtagcaacaataggaatcatttcttgaggggttattctttgccaaacacattggtgcaagcagtgttttgtttaatcctccaggcaaaggtggtggtgatattaaggaacaataataccagtaaaggggaaacaacagcagagaaatccttcaaatctatatgacaacaaaggaacattgtgcagcaagtccttcttatttcatctgagtttaacatgaatgctttctctttcttacctgtgcatgtgaggggaaaccacaatgaaaaaaatagatgattctgaacctctagaattttaaaattctctaactcctttcaccctgttttgttctaccctgtcatgaaaggcatgaaatctgtatgactgaaaagattcctctcaaaggggaagtgttagatccatttaagaggttaaacagttttgggatcatgtattgggaagattatttgaatcaaaataagaacacatgatagtcatttgatgcatgctagccattgaaaatttagcatgatttagctgtgtctgttcagggacacagcactgcagtctgctggtctggtcgtaccaatcccatgcgttttgctgtgctctatggaggaccttcttacttatttccattttccttcatgaccagaaatttgacaggcaactcgctggcttctctagcttctctgttttgcttctgtgtccaccccgctcctgggcttccctagtgttggttaatgatgttgttttattttgtcagggccccttccattgttcacatgaatttgacacataaatcacattctttttgtctcttctctatgggtacacaaatactgcggtggggtaggagtacagctaatttgtggatgggaaaaaccgagcttcagggaggtgaggaatgatgtctggctctggatgtgagcctggaggggcacagctgagaagaattttgcagccacttttttctacttagagaacaacgctggaaaacagccattaatacagctttcttgagtcatatcagatctttatattatttgggatgatttttcctcaattgtgtgaagtccagaacatggaatcctataagaatatggtctgaggataatgccctattagccacactcacctgatttcacccttattttgggaactttcaggtgaacctatatttttaaatctctcataagctttccaaattaacttggcatctgctaaaagtcattgtcattttagataactgctcttctttttacaaagacaaaagcaagcaaaaagaggagaacaagctgccaaaaactgaggtccttgcaaaagagaagggctgatcaacccccataggctgctacagccctagttcagttcatgcagagtccacctgcaggcagcaatcaacatgctaaatttgagcaacgaaagttcactcgagcaaaataatttaccttggagtccagctgctgcatgtatgaccaaagatattctatgttggctccaaaaggatggacgtgaagaaacgttgatatgatacctgaattaaaaaggcaaacattggaaattattcaaaggcatatgagagtctctggttaaataatgctgtctaatcccagtgactattttgtcaggctgagttatggtcttgccatttctagcagcactcaacaagcattcaataatagcacattctgaaggcagtaagagtaacatggcaaacagaacactttatctcctggaatgatagtagttagcaaagctagactctgagataatatacagctgaataaagatatttcaaaacaaagactcctggaagcatttcaactaccaattttatgcttgatttaccaatataaaattatagttattggaaggataaaattatcttttctttccctcagtggactttgcagtatgaaaatggctcatacaactgtgtcagaaatcacactgcctcagattttcctgataattacaattgctagatatgaaaagtatttaatctatatttcccccaactgccattgaaggaagcccaaattcttcctgaaacatttgctgttctctctggttgtcgctcttgtttaaaaggagccagctcattctccccttcttgctgctgtaatttacaagatcattttaaaaggtctgggaatggatggtttggctgcagtttgattataaattataaggctcttccatcgtgcaaatcagctgtcaacattgtactgacaaatgaaaagctggacgttgaagtcaggaatgaagtaaaaagcattaccttcctcttctccctgctcctggatccaaaatcaaaatagtgaacatgaggaagtcaactccaaaaactgtagactgctttttgttaagaagttgtgcacttgttattcacgatagcaaaaacatggaatcagctcaggtgcccatcagtggtggattgcataaagaaaacgtggtatgaaccatggaatactatgtagccataaaaaagaaggaaatgatgccctttgcagcaacattgatgcacctggaggccattatcctaagtgaactaatgcagaaataaaaccaaatattgcatgttcttataagtgggagcttaacagtgggtactcatggacataagaaggagaacagtagacactggggactgctagaggcgggagagagggatgagggaaagggctgagaatctccctattagggattatgcccattaccagggggatgggttcagtcataccccaaacctcagagtcatgcaataggcctctgtaacaatcctgcacgtgtacccctggattctaaaataaacgttgaaaaagaaacaaaagaaaagttgtcctcagactgatagttttagctttctgttaaaaaagtttcaagatgaattaaatctgagggtaagccttcatgttctgttttttgtgagccttcatgcttgggagccagggaagaccctcacctgtatgaaatgccatctgggtgggcacaggtgcacacagcattcttgtactaggtcatcctataggtgaccttggattgatctgccatagggtttcatggctccctgatgctatgggatgagtgtcaagtttttaaagaaaagttcccagttcatcctcaggctgagaacagaaaaccaaagggactctccaagacctatcctcagaatgttgctttcccagggcttctagaggatgacagtgagatggggaggtagaaacaattcccacatttccctgtaaaggtagaatctcagtttttaaagactgacctgttcttcctgagatacaaagaactaccacttcattctgaggttatattcttccttttttcttgtcaaaatgtccttttttgaaataatggcaatggtagaaggcaatgatgatactttaaaaatatctttaagtggaaaaatagccacttttaatgtactcagggagcattgtgttgtcccctccccttatttatttacttatattttaattttagagacctgacagctacttccctgtaactgaaattctcaattctggtgaagtggcattctaagtaattctattactaataagagttaaaatataaaagctcaggagtgatttctttaaaaaaattagaatatagtagaactatttaaaaatgattattttcatttgcatttccttttttgttttacaaagttttaaattgatatataatatttgtacatattttttgggtacctggcatattttgatacctgtatacaatgtgtaatgataagaatcagggtaatttgcatggccatcacctcagacgtttatcatttctttgtgttgagaacatcccaaatcttttcttctagctattctgaagtatacagtaaattactgttaactataatttccctactgtactatcaaatactggaacttagtccttctatttgttgaatgagagagtaagggctgaatcacagttcgtgtagagggaatcccctgtttcacgatggtgagtggggctttcactgaccatcccaggtactatggccactgctttccacagagagcctcccacaagtgatgggcaggagaaggacaggggagggagaaggaagagtcagctttggctttgtgagcaggtgagggggtgctcctagtcggaagctttttttctcctcctcccctgcagggttctcccagggaggtgagggctgctgcaaggtggggagcagcattcctcgggtggacatctgcttacgcagcagggctgagacagggagtggcagcagcactgcagactttggggtgacaagggtgtataagtctcccatggagaaagagggcataagacttgagcagtcttaagtaaactaccccaggcaaataaataacaatatttttcatatttaatattccccctggccagagagccttcaacatctcctgcataacctacagccttttgtaaatgtccataggtgtatggttatcaacataaatgtctttaataggatgaatagaacaagtcagaggaggatggggtgggttgggggagaggttgataacccttagcctaggagacgaagtgttgacatgggtcatttagggacaccagaaatgggaggacctagagtgcctctgtgaagttggcaccctctgtgaacatggatttgctcctccactgtctactacctttcaaccctaatcctgggtctgcaccccaaggagctgtgctcttagtctttgtgtgttctggttccatatccagaacatagtacacattcataagaggtatatgttgaacgtatttatttgccagaactggaaatctccagtatacttgtttaaaaattctattagtctattattgataaatgggaataaataagaaccttaaacatttctacaagtagtaacagatctttcaaaaaccaggtaactttgagatattattcactgaaaattcttactcttaacccgtcctgtcatggatttagaaggatggagtaacttggatgttttgagcaaggaaaattttcattgaaactattttgctcataactaaggggaaaatcagattctaaaatcagattagaagtcctgacgtggacttgagtgttcttttaggagggtattcagaaccatctctgtggtagctgatattaagaagccattagcttttccttataagagttcagcaattgccactagatatatgtagggccaaggcaggcagtcacaaataggcttcccaagcttttcctgtggatgacaacccaattatccagtgttgctagagacacagccgaaaggaaagcatgagtcatcatcctccccggtaccttgcctctcctcagcccacctcccactcctgcatctgtccatccctgtagcaccacagaagcatcagtcatgccacttgagaaaatgtttctaggccctgtgattttggatcaggttcatttgagggaatctttctaaataaacaagtaaagcctctttgcagcttttttttttttttttttttttttttaaaggaactgggacattccctggggatggaaaaaggatggctgtaactcaaaagttaatgaaaaatgccacaaacctggaatatggagactattttatggtcctctggaatagacctaaaggcttggtaaaatgaacactaggaatggagggtggtggatttagctgttactgaactggtggatctccaaggggatggctcaacaattggacttgcttgtttccatggagatgtagaaggcctccatattggagaatgggtttccaaaagtggaaaaaaaattttaagtgcctaatttaaaaaaattttaaaagaacaaaggaggttcagtaccattgggctttttgcacatctcagaatcttaaaaactactttagaaagagtaactagctctagaggcctgtgccaaacctcgttaggaaggtccatttaaattggctacccaaaagcactctgagcttctcccatcaaaaccatctagtttatttacattattgggtctcactaagactaaggatgcagtatttaaattaaccaaatagtgccagatttgtactgcttcatcacttattttaatacttgaaacacttagcagccaggaggtggcaaggtgctagaggcacagcattgtataagataggcaaggggctggtcctgtggaacttttattccaggtgagcaacacagataataaacacaaagatgaaaaataaaaatttttagatagtgcttagcacaatgaagaaaacacatcagggaagaggacagaagagacagcaacctgcagtttgctggaacgctaccttacacaaagcgattgatgtggtttggctatgtccccccaacaaatctcattgaattatagctcccataattcccacatgttgtgggagggacccagtgggagataactgaatcataggggcagtttccccatactgttctcatgctagtgaataagtctcgtgagatctgatggttttataaggggaaacttctttcacttggttcttctctcttgtttgctgccatgtaagacatgccttttgccttccaccttctgccatgattgtgaggcctccccagccctgtggaactgtaagtccattaaacctctttttctttataaaacacccagttttggatatgtctttatcagcagcatgggaatggactaatacagcgattacgtgaagccctctccctgagaaagcagaccttctcaagtgtgagatgagaaggagtcagccatggaaagcccgggggagaccattccaggtacaggccacatacagtgcaaaggccctgaggtggaagtgagctggcagaacacactgggctggagagtggcacatgtgtttagaggtaggtgggggccagatcacgcaggaccttgtgtgccaggggaaagagtttggattagatttaaattctaaatgtggcaggaaaccaaaagagtggttctaagcaggtgcttgacatgatctgaattatgttttaaaaacttccctcaagctgctgtatggagggtagagcagagggggaactgggaggccagttggaagtgtttgcatgagactggagtggtgagtcatgatctggactgcaaagggagaagcggactccaaagggagagccagggggctggtgtgagcagtgaggctggggaagaatgaaagatgagtaaacagtttttcacttgagcaactgggtgggactattttctcagatgagaatattggggaaggagcacattagggcaggaaaaaggggaatcgggagttctgttttgtcctcattaaatttgagatgtgcattagcatctaagtgaagaatattaaatggcagctggagatggtatacatttgcaatggcaacaaaaagggatttgaagccaaagtattcattgagattacctaggtagagaagaggcctcaagactgaaggctggagaagcccaaaatttagaggtaagctgaggaaaactcatcagaggactctgagagggtttaatcaataagaaagtgtggcatcatgatggcggagagaagtatttccagatgtgagtagtcaaccacgtaaagtagctgccaggtagagggagttgagaaattggtgacataaaattctctggtgatgtggaaaagaatggttttggtgtgaggatgcaagtcagactggaggaggctggagagagaggggaggagggaatggtgactgtgagcatagtgcgttggaggaatcctgctttggacaggggcaggaaatggactgttgctggaaaggggtcatggtgtcaagacagattttccttctcgtttgttgcaaaggtacaagatagtagagttcatgtttatatattgatgcacatgatgctccacttacatacaagatcactaaggggtaatgcagctttcataatagtcctcatacattacagagaattgagttgaaaaggaccatctaatcaaacttcctaattttatgcagtatgagggcttacacacttaccacagtggtttggataagtgatttgccttagattacccggtggatgaaatgcctcaatccacaaatatttaggaccactccccctcccccaccgctcagggctgcttagagatcattaggtattatggtttctcctttgcatccttatacaaaagatgggagtgggatgggttagccctgttatagtttaattatattggttacccgatgagaataaactatcactttgtgcattcagtttggtcagcacattattctctttgagtggaatgagaaatggaatattgccagaatatactccccactacccccaggctgcttggagttttcattccaaactctctgtgtcaggttctaaagttctggctgagatttgctttctctacacctacactggttgatagtctcctaggaagcttcaaaagaccctggggcccatcagctcactgggatagaggagcaccttggggctttccagagaccttggctctgcagatgaacagctgtgtctctagacacagtcacatcttgctgggaattaccagaggcctgaccataaaccagcctgaaatagtcttgtttcatgttgacacccatataaatggtccacggatgttggagaatcagcaggaaaaaaagccatgcaaaatctgggtctcctagtaagccctgaggggacagttgtctgtgggcagctgcagagtgatgaagcgtatatgggaagtggagagaaactgtaggaaaccgatcaaacacttgtggtttgggctgatgcttctcagtgccttgggattccaaaaagctttaattttccaaaaaagtttattccgcttacttggtgagtacaaaacctaatcttgtatggttggttagttagttttgtgttgtaatatttgtctgtcttattttttcgattaaacccctcagactgtatttgaacctcttagtagtaaattgttcctggtacctgaaatgcccttaacaacttctttatccatccagtgaaaacctcttcatcctttaggactagctcagctgtcctttcttctgacaaggcatctgtagcataagtagctccttctctgtgtctctgattttactacgaaccacagttcattgtaattaactgcattctttctcattatctatgaacttcttgaggggagatcatctttccaccatcagttaatgcatgggatagcataaatcaggccagcgtttctcaaaacatagtaccagatatgcctgctttagcatcctctcagatattagtattgcaatgaacaggatcactttcttttttttcttttttgacagggtctcactctatcacccaggcagttgtgcagtggtgctgctcacagctcactgcagcctgatgctcgtgggctcaagagatccttccacctcagccccccaagtagttgggactacaggtgcatgccaccatgcccagctaacttttttttttttttttttttgtagagatgggagtctcactatattgcctaggctggtcttgaactcctgagctcaagtgatcctcctgccttggcctcccaaggtgctaggattataggcgtgagccaccacacctgtgtgtggggctaaagattctgccttataaataggctgcctagataattcttttccacaatgaagacggattattcttatcgtaggctcttgataaatgtttgttgatttattgatatggacatttgtgccttggaaacaagatttaggtcaatgactcattctttatggtcagtagttttcagagaggaacatactcccaagattacttttctcaggtacagcctaaatatagcctcaactttattcactgaaatcaccaaaaattattgcttaaccttctttaaaaatatttttccatattctactcagctgtttctttatacccacattaggaggagccttctgcttctggtatagtctggttttgtgcacgtgtgagatggtgactgtgatggaaatgatgtgtatgtcctgatctgcagaggactcaggatatgtaagaaagtttgcccaatcattgtcaacctgaggacagttctcaggggaccagggaggttttagagaaaagctgctttgttacagttaaaagttgtggagaagtttttgactacatctggatagtatttacaatgactagcatcaacagggcgtcaatcagagctgctgggattgaaatctattgtgttggaattattataaaaagcaagagaatatagagtgatacggacccagagagttatactctcagctctctgcagaactattagcttgtcaataaaaaaaatttgatccatttttcctttataacaatatccagccaaacacagctcccaaactttggccccaaatcaaaagtaatgactcattctatcccaaacaacttcagtgtatgccaatccaacatgcaggccatatgtgaaataaactagttctggcatagacattgagcaatgtcaagctgaccttatgtgtggttactatagcattatgaaacaaaatgctaccctgcaatgcccccataaaaacagaattctctaaggtccaattatatgtcaacctgtctccacaaaaattgattacaaaatgaataacccagaaatcacaaaaataaagtattttccaggggcctgtcttctttagttgaattggaagacccattaattgtcaagaagaaagtccatcagaatggtcgaactctaataatactcaggatccagatctgcaaaattccaaattatgtcaatgaaatcccacggatcctctctaataaatatcaactttatgccttgaaataaagactctagttttatacaatagtcataagaatgtctgggcagaatacacccttttgcccagataaatcagtgtcacaaataattatatgtaactagaattgctcattgtttaggaagttctagcctcagttttattctttctgtagatggaatccatttgaagagcttttttctcactccctttctcttccagggaatgctttctgccagtgtgcgtttcttatataacatttatgtgccccaagagggcactgatcatctgactatattggcatacagcatacactataagcatgcagatatgatgaagattttgccaattaatgtttccaagttgtgggagattttctgctgtgtccttggccttctaggctggcctagagcatgacttttgtgtcctctctactgacttaattattccaagggaagatttcagggggaattgcaaagagtatttatgactgctccagatgtaccagaaggccagagggctcctagaatcattcagtgcatgagaattcttcagaaaagtgtagccccagcaccaggaaatcctttttctctattctgatccagagcagttttgtccctaccacagtctgtatctagattccagaagcttcaggggagctctttatggacgcaagattcaggtatctacaaagtatgaatgaccaaactcaatgagtagataggatcatttagtggcaggcagaaactgcagcttttggcaggatccattttgctggtcttggaaactctttcccattgtggcattcttttggaggattatcctcttttggaggattatacaaaagagtagaagtatatagatgttttggaagtgggtttggcaaggaaatcacatctgttgccaaactgtcattaagaataataaaataaaatattgagaaaggtagcaaggtaatggataactgaagggaaagttaaactcctaagtttattttaatcacttaagtctctggcctcccttctacctaaatgttctcatatattgattcaaaataagtgtcaccccctgtttctcttttgctctactcctaacttcaaatgctaatattagtaaactagttcaaaagaccaacagtgaggggaaaagtcttggaaaatttagaattggttgtatatgctttttattggagatcctgactaatatttttctttctaacacacttgatttaactaattttatatagttttttgtgataccaaagacatcagcaggcatagcatgttataaatgtaatcttcctacctactcccattaatgtactgcatataaagcacatcatttaaaaatatttgaagtagccaactgaaaaaagtacatgtatgtgtatacatatataaataaaacctaataactacttagaaaacattttaaatgaactgtgttctccaattaaaacataaaagaagcagctatctctagtgaaaggaaggaaataaaaaaatagagactggttcccatttttttaaccttcaagtggacagaattcttcctacttaaagagggaaaagtttactgcagatcattaattgctttgttcataccctaaaagcattatagggaaaaatcacaccttggtcacactgagtgacagagaaacagttgtcagacttggacatgttttccaatagaagaaaaatccagttaccaactacatatgggttcgttttgggttcctggaactgatagcacatcagcatgtcttctgagactcatgcatggcatgttattacagctgtatatcatcagagcaaaaaaaaaataattggttttcctgggagtatctctaagttgatgtcatattcaataaccctgtagttgaaaaatctatatatgatggatggactctggactgtcttttgaatttaattcctcatgtgccagcttctctaggtcctgttgtacctgtcatttttaggtgagcacatgcagtatttacaaaatgcacccagggaccaggcgcggtggctcatgcctgtaatcccagcactttgagaggccaaggcaggtggatcacctgaggtcaggagtttgagaccagcctggccaacatggcaaaaccccatctctactaaaaatacaaaattagctgggcgtggtggtgtgcacctgtaatcccagccactagagaggctgaggcaggagaatcacttgaacccggcagaaggaggttgcagtgagccgagattgtgccattgcactccagcctgggcaacagagtgagaccctgtctcaaaaaaaaaaaaaaaaaaatgcaaccaggcactatttctgccagataatgaactgctgaagaacagtttgtcttgcatgtacattggcctcattcttcagtcttaaccatgccaccatggagccagtctcacctggcaaccccacactggggtcagtgccaaggtgcagcttgaatcagttctgtgcatcacagcatgagggtggtggcttcccttcctctgaatttgagggcttcaaagacagccttaaacatacaggcatctaagatgggcttccatgcacactgccggcacatcctcatcaagaattcttcctcgtgaaaataagtaagacatctggatccactgaggatgcttcttttgttcatcctggacaaaaggatccatacttggacagggaagcctgaagccgattgtcctggattagcctagcatcagtaccctgcatggccctatttgtcagcattgcaggtctagccttgggagtgactttaggatgtggcctctgctaaggggcttagagtttaatctcagggttcaaagctgctcttgagcctggggatatggcttggtttggaactagatgcaacctggcctccagttggaagtgacatgcccaagctttgaaattcagatttgtaacatgtgagatgcaacttagcgtattcttgaactcagtttcatgtctgacaatcagttaatatatacagttacagaaaggcaaaacccccattagtttgtatgccactaatttgaaatgtatgtaatataatcttgatgaaattaatctcaccttttaccagaaggcaatgctgtttaaattaataagttaataactaaaatattaagttaattacctaataattatttaagagaacagatgaagaaaacagaatttccttacctattagcagagcttctttctctgattttaagccttggcttcttttctcaatattgttctctcggtcttggttgactaatgcaactgtcaacacattgatttcctataaagttaaaagccaaaaaccatatatgggtttatgtagattctgtgcatgtcaataaaaaacaccagatctcttaaactctataaataaggtcatcacttctatttataactaaagatcaaatcttttatacaattgatctatttgcccaagagtagaaaagtaattatgtaaagttaggctcctaggtactgctccccgcataccaagtaattctctgcacaagtggcaaatttggcacaagttatcttagatttttgtccatgttttcattaaactctgttcattaaaactgtgtttgattatagctactttaacatgttttatttcaaagatgaataatctttgggaaagcatacaggaaactgatttataataccatgctaaaaatttctgagtgtgtggagaaatagggcctattggggagctaagatagaattgttagaagtgtttttaaattgagtaggtatggatcctcatgaataaatgcaagaggcagataaagcaaagcttggtaaattcttttttttgaaaactaaaaatgaagagttgtacaacaagccaataacacgtgaaacattgaggctggactatttttagttctttctgtagtcttttacatttaaaaacagagatgaagatttaactcatatcatcctagacttttgatattaggactcaaaatggagagtgatttaatggaaagtcaaattaatgatctgcatagatgacctgcatatatgggatagtagaatcattagggaagttgagtcttactggaggaaagttgctcactgaaagatggctccaaagaaggactagtatatgagcagtggtggggaacctgcagggatgatagagaacaggtacggagagccgaatggacgaagaattcagaaggtttgaacaaatgtgttgacaggtgtccctagaactggaagtggttataggagagatatttagatagttagtacaaagtaacaaaactggtcagatccaagagtacaggaagtattgggagcatgccgagcctgcaaaaagtgaaaaccacacccgaaggcattcaaagaaaaataaacccagcacatgccatcaaaacagatctttgagcttaatttaacttatgagctaccactttgtaatccaggggtaattagaaattgccatgaaagaaggctctactgagaaattgcagttggtaatatctgataagcattttagaggctccacttaaggtcccacttatttgctgaagaccaagtgatgaagactgaatgagaaatgaaaatggataaggtaaagaattgagaaaatcacagtgatgtgatgatatatcacagggaagaacttggttggctagagggtataacaggcctcaggctgatggtaggaaaatcccaataaggacaggagtcagaaagagtttggggagtggtctaagctaagtctggagccagctgtacatcaaaggttactagagatgaaagatgctcttacaaatcaaaaacaggatcttgggagcaagcctcaatggaaacacaatgaagaattttaaaatagaacaaatccaaaggcttattatgtagatgggattagaacatttataaagaggaattgcaggaaaggaaatagaaattcctgctatgataaaataacatttggtactttccgattaggctgattaggcactttctccattggaacagagcaggtctgtgtgtacacatcatctttctagggtagtggggtcaatgggcctgctgaattctgttagttgtatgccctaaggacaaataggtcccacagggacatggcagatggacttccaggcctgggaggttaagattgttgagcagacgcaagctgaagctttgtaaggtctcccaagagaggtgtaggaagaaagtggatggaagaacattaactaggataatgattgcatcattaaaaaaatacaaaaaatgaaccctggagctgagtggaaataatatctccaagagagggtgatctgttcacagcctggatgataattggggccaaatgaaattattcagaatgagtttagcagataacaggcccacattaattgccaagactgagtggtgtcctggggccatcacacagttgaagatccaggttcattgagggaaatggactgtagagggcaggcagatgtcaggagccagcagagaaaggcaagggtggaacagacagaccacctgagaatgctgttttctccccaggtccaaaagtggagtcacatagaaagggggactctgagcaaggttcaaagaaatactgctgcatcaacaatgtctacaaggagccagataagacccagtgactcttgctttggtgatgttttagggttgaaaaaattagtatggagagataagagtcttagggtcaccattctgtggaagtatttcttgagattggatactggagtgtgtgctctgctgaccacaaatggtgtgttctcatgcagtcatggccagtgactggagtggacacatctctctgcatggctcccacaacagtccagcaggccttggcttgatggacacctaaggcttggcagacatctcagcttttggggacatctgtgagttttgtccaggttggagatggagctgtttttctgactcctctaggaggcagaagaactatgctggaagtggtacagtatcattgaagctgatcaggcaggctccaaggaatgcttgcttgcatcttataataaactggcctcaagaatctccaaaagggaaaacatcatttccattagagtcaagggtgtgtccaagcatattaaatagtctatagcatagcattgagtgaagtggaccaacttgtgaccactcaaaagagtcactactgactaagctccagatgctaagcctgccttgggcatggtataagctcaggctcttgctgacaaagtcacagagctaattagatgggtgaatgcttatgtcatccattttgccaaagagaacagttaaagttaatatagctgtgtttcaagggatagaagacaggatagtgattttagacagccacattatatgttgtagttttaccttttccaattattagaaaaggagagttttgttttaatgactcactaatcatgggttccttagaaaaataaggttaatttgatttgtctgtatttatattggtattgttcagttgaacaagataaggacaattatcgataatctccaagtatggggtagtctacaaagtagatataagcaacaactgtaccctctctctttgtttttatttaatgtctagaaatctaagttatcacatttgtcaaaagagctccatcatcatgattggttaaggcgaagggaatacacagagagaatgtggaattaattaattcccaaaccaattccctgttgcacttaagctaagcctgtttttactttcagccaccaaataaatatttctgctacatatatacatcacatgcctactatatgccaagaagttctaagtttttaaggatatggcattcaaactgatcagaagtgcaagcttacccagggaccagcaagcaattcttataaaaggtctaaaagaaagaaatatgagaagatgaagctggagaagtaggtagatcatggtaagaagtgtagattttatctgggaggcttaacaagtgaagagttttcagttctgcattttaggacattggtttggaggcaaatgaaactggagtcagcctactgcaaaaatgtatccatttttgccttttgatgatgacagtcaaaacccatgcagagtgcaaacagcatttaagaggtggaactaaaaaaaaaaatctggtgacctggtggctgatgaaaatattgagaacaagtaggtggctcagtgaataggcaaatggagaaagaagctagtctgggagaagattgtgtgttcagttttggaaatgttcaacttaaggtttctatagcatcttgtcaaaatattttggaggaagtaggattagccaggaagtaggatgtgcacgtttctgaacttagaagcaaggctctgacagctctttttatggggcctttctctggttttgtttgcagcaggaaatcttgatgttttcttgtgggacaaagagcaggcttgcttacacttgatataaaaaaggtagattcctaagctcagtgtttctatcttgtaacacaaaccactgcatgtgctggcatccttctggacccctctacggagatactgaggttataagatccatgagagtagactggtgaagccaaaattcttctgggaacagtctctcagtgggatttcatattctctacacaggacattccaacttatctttttagtaattggggaacacataaggacattgaatcataaattacacatggttttgctcctttcttaaaaagttcatggtccttattactctctccaccccaaatctctagagaatggaaaggaccttatcagaatgggaaagttttatcattagaaacataaagttatgaagaccctttatccttttatcaccttaaaatcctttagcctgatagatgcaacatgcccagaagaatgatgagtctaccagatattccagaaaagaggttccagatgcctagcaattacaaagtagaagtgagtgagtggggatggagtgggaggtgaggaaggttactatgtatgaattgttagtggtatacaaagtacacagcgggacgggaacattaggatggagatcaagagtttcctctcagtgagatctattggattatgaagtagtctcccaaaggaagtgggaagaacacagtaaaagcacaccagactagaaaatgcactgcagctaacaattctgcacttgacatgagattggagattacctaataaatcttttctcagcctaccttttaactctaatttctgtgatacgtagaaggaatcattaaagggctggagaagaggttttcagtaactggaaactagatgtcacagactttttaaaagacttcttaaagagttagctacttgaaggcagaaatttcccttctaagagtcctcatcacttactttgagaaatgatcaaagtaatttatcatttagaggagctctttttcaatagcttattgagctagaatcatgctttgttattttgtttttgtttctctccacctacccaagcccctaaggaccaagaaaatggcttccctgccttataaaatccttctgctactgctttcacttaattattcctgtggcttccttacctttagggctgttttctttctgttgcaaagcttcttgaatacatgttgtccacctgtgtctactgcctcatcatctgaaatctcagctttttcatcagtcactccaacaaatctactctgagatatttccagtgaccctcttcttgccaaatgattattttcccagtcctcttaccatgtgatatttgacacccttgacattggcccctcttaaaccatctgcctcacatctgctacacaggaggtcctggtctttttcctcttaatttcctgtttagtcttcactggcttttttgtttcctctgctggcccagtgaatgtaaagaagaggctactctcttcctcctcttctctagctttggcccttgccaaagtgtgctccccaatttttcttacctgttccctttctttcattctcgtgggttcagctatgatcaatcttaattctttaagcttctgttctttaccaccaactgaccactgggcttgtctgcctgaatttaccaatgcccagttcaaattcagaatgagaggtggccatgaggcagtggaagagacactaaatacttgggtttcagccttggctcttcctccagcagccaggtgaccttggcaaattactcaacatcttcaagacccagatcacttgtctaaaaatgaggggctgggtagggccaatcatctttgaatagtacttgatggaacctcattagctttatagaggtgacatggatggtccaaggggacacatctctggaattctactctttcactcctttcttttgcttaatgatacagggctcctatgtaaagcttcatttaaagaaatgtccttaggccgggtgcagtggctcaagcctgtaatcccagcactttgggagactgaggcaggtggatcacttgaagtcaggaggtcaagaccagcctggccaacatggcgaaaccctgtctctactgaccatacaaaaattagccgagcgtggtagtgcatgtctgtagtcccagctacttgggaggctgagacaggagaattgcttgaacccggaaggtggaggttgcagtgagctgagtttgcaccactgcactccagcctgggcaacagagtgagactctgtctcaaaaaaaaaaaaaaaaaaaaaaaatctgagtccaggtccttcctaatgtaattttctaaaattctataattttatgactaaaacccagttcatctcactcgtcaaactgcatcctcttctaacttttctgtttttattaaagtcagcatcattcttccacttgctggcgctcaaaccctcattttgtctttgattcattctctactatcccctaagtgcttttaagatgtctctaaatccaaattctctcaagtgtctgtgagatgtctctcctgctgcattcccatttccactagtgctctactctcggttctacgtgtttcatactttgttttagggatgcggtctcactatgttgagcaggctggtcttgaactcctggcctgaagcgatcctcttgcctcagcttcccaaagcactgggattacaggcatgagccactgcacctggcagatttcacaccttgaccattttaaccgctgcaggaacctcctactttgtctctgcctctaggctcttcctcttccagtctatcttacataataccaccaggtcaattttctaatatgtgacttttatctcatctatctctggttaaaacttcagatgctttctgataacctacaggaaaaagtcagatgctgctgcttggcattttgggcttactcctatcaaactagcatatcttctttctatgctatgtccagaaatgctcttggaaagctctctcctccttgccttgccacttcctacttacattttacacacagcacaagtcctgtatctcccagaggcatctgtttcaggccacttgcaaggcttccttatctgcacacatttcctacgccacttatatggcagttcatcacttatacatcacatttcacctatttgtttcctccacaaaaccactgccttctttagacagtaatcacatctaagcaagtgaggcagaatggccgaatggaagctgtgttctaaatctgtcacattatttacatactagataactttaggcagggcatttctctaagccttaactttctttaatgaaaaacatggataataccatgtgcctcttccccatggttgctgtgaggaccaaatataagtgagacagcgctttcaaaaactataaatttctaggaatagattgtggcatgattattacaaccattactcacttttatgattcacaggattgattggatatggaacaagtgttaatatatacttggggtactgaatccatgcaacaattctgtataagactttgactacaattatataaaaatatttatgcaaaaataactgtggttgtattcaaaaatagtggatattttctattttctctatttttctgtcagtgttgttgttattatccttataagtaaagaaagaaaaagaaaccaatgatatacagttgttgttttgaagagctataggtaaggacagccagttgctgaatacttaattaagtaacatactgagtgacatcacccacaccctaaatagagaaaccaccgccatgtgacttcccctatgaccctccaagggctggcggcctccatagctgctagtgcaagatgagtgggacagtcgacaagatctatgtggtaaagattctccatgtcaccccggactctgccagcagcataccacaaggctcgttttccttccctgcctgcttgttccatggccttcttgtgctgttggctcagttctgctaattgctcataggccctactcttaaacatcacacttcatgaaatcgggggccctatagataattgtcaagatgtgtatcagctacattcttatcctttactcacattttgcaaagtttcaaaagcaatccatcaaatgatgtgccagttgccaataaccttcaaattattccttatatgattagaactgtggttgggggaggatggagaatggagatatcccttcacactttcctttatgggcacatagcaggtgcccagtggctgataaatgaaagaatgagcctcaaacaatggcctggaatattgaaaacatgatgatttggacatagaagacactggttctatttgccgctggcctgctgtgtttctttgtttcatttttgctgtttgtacaaagacaggattgaagtggatgacctccacagtgtcttcctgctccctgattccatgcctgctctgtgcccttttccctgacttggaccttcccttcagattcaggtagccagcttggtacagaccatataaacttatcctttatttctgatgccagtaagaattagagaggaaagaggaagcagagtgagaaaaacaataaaaaaccaaatggatgaggaaaggattgatgagcatgagtgactaagctttagaattttttatggtttcttatgggaacataagaatgcatccatcccccaatagtgagcaggatcgcaggaatttcctgtggggcagcaatcccaaggccttgctgatctaatcagttgtgaaatcttggcactgcccatcccgagggtcgtgggctctcaccacctctgccctttcccagcagcctttgatggtcaaggtctgtataaggggagcctcagaggcccaatagttttcagcatcagagagataatctgaaagcagatgtgtggggctccaagatgcagtgattcatcatgatgtgaccatattttacattctgagatgttccaccttattggggttcaattgccggatcggaagcacatacattatgtctttagacaactccaagaaccgtgttttctaagatttccaattgcaaagattaaaataggcgagaactagttacggctcacacgaaggaccctttaaagaaagataaaaactcagtgtagtttactgccagagatatccagatacagcatttatcctggtggccttctttctaggtcatctttggttatatttatttaacaaacatctgtacagtacttactatatgcaggaagtgttataagcacttgacaaatataaactcaattgtcataagtgctcttcgaagtcaggctattacattcttaatttacaggttaagaaaatgaagaataatgaggctaatgacttgcccaaggtcacaaaactagtaagaagcagactcaggatctgaaccaatgctgtcttgctccagagtcctaaccactacactaggttgccggttgcgtggatattgagtgcctgtggcgctctgtgaccaaatccctcctgagggctgcctatagtcctagctcactcaggagccagccaggctccaggcaggcctggtgagctgtggttcttgcataaacatgaaaggaaaggggagcagggaggaagccacccacgggctggctgaggagcagcattagcagggactgagggggctggctggctgctgctgtttgcgggtgacggacttctttagtgtgacttttaaccacagtctgcaacagggagggatttcaaaggcagagtgctggggccaatgaagaagaagaggtgggacacatgctctcttgatttgaaggatgtgggtaggggaaggccaaggtcagaggagcactccaaaagactgtggttgggccacatgcaggattggctgggcaggtggagaggctcaggcaaggaggccccaggtgcttctccagccacaccccaaggatgtggcaataaggtggaaccacagaggtgacaggaagagaaagaaaaggtggatagagaagccattcggaaggaatggaaagaagccattctgaaggaagaatggaaagattctatgtgtgaagcagagaggggcgagctaaaatcatttaaacaagtcaggtctacacagctagcagaatattgataccagaatcagagatcacgaagaattagaagtattgcctctaggctgggtgcggtggcttgcacctgtaatcccagcactttgggaggccaaggcaagtggatcacttgatgtcaggagaccagcctgaccaatacgttgaaaccccgtctctactaaaaatataaaaattagccaggcatggcagcatgcgcctgtaatcccagctacttgggaagctgaggcagaactgattgaacccaggaggtggaggttgcagtgagccgagatcacaccactgcactccaacctgggcaacagagtgagactccatctcaaaaaataaataaatacataaataaaaaagtattgtctctaatattttaaaatattggagctgaggtcttagaaaggcagctggaaatagggaagatgagggtgatgagctctcaccacctgtgccctttcccagcagccttccatggtcaaggtctgcacaatggaagcgtcaggagatttttcatggtagtacttcaggctgtgaagggcgtggacttgagtagctatagcagtgtgagttacattttctacatactgaagagaaacagctatttttgagatcaagtgtattttttcatttggttatatctaccgtggcattcaggctgggaatacccctttccagcctcttgcacggtcccagtgcacctgttgtccccacagaagtagcaacagtgctgcctttcaccctcaaagacatctgtttgaattttatgtgatgactgtacctataatctctacagagcaacagtgtcctcagtacctggcacagtgctctgtacacagatgcaacatatatatatatatatatatatatatatatatatatatatatatatatatatatattttttttttttttttttttgagacggagtctcgctctgtcgcccaggctggagtgcagtggcgggatctcggctcactgcaagctccgcctcccgggttcacgccattctcctgcctcagcctcccaagtacctgggactacaggcgcccgccactacgcctgtctaattttttgtatttttagtagagacggggtttcaccgtgttagccgggatggtctcgatctcctgacctcgtgatccgcccgcctcggcctcccaaagtgctgggattacaggcgtgagccaccgcgcccggccgcaacttatatttttaaaagaaaaaatataaatagtagaccctctaatattacatcaaatgaatttgttactacatagacaggccagacctcatgggtgaaaatgactggccatcataagggtttggtcagtaccctgggcctggagtcagctagaagtctatgaggaatatatatgtatggtggatagtgaaaaaaactatgcaatcgctttggacattttacagccttttggtccctaaatacatttattgtagtatcattttaaaataacacaatttctttaatctcgtaggctgaaggaggtaaggaagttaatttttcatttgtatctattatcaatgctttcaatgttttaagtattaacttttaatttttttggagaccaaaccataagcttataaccttttttcctttcttttccaaaatatataaccttttctctttcttttccaaaatataagacatattttctagttgactttcttagtaataacctttgttttctcattacaaataaaaatatgtattcactgtagaaaatatacaaagtaaagattaaaaattaactgaaattctactaccaagatataaatgctattaacattcagatatttgccttttatagtttatatataaccccctcccacatacatataacatatatatgtgtttgcatatacacatacatgtatatattgttgtttaactcttatttgaaaaataggattatgatacatatatagcccccaagtagaatattctacataaagaacagagactttgataggaaaggatcatttcaatttcttaatgtttcccattaaatactaagaggatcactgctgcctggatcataacttaataatgactatcacagttcacaccatgcttaaattgtggtctcaagctggcaatgaaatgactttcttttggtctagttttgtgacagccatgttaaacaaaaatgatctaaaaatgagaaaaaaaaaattcctttgtatccagtaaccccattcattatttaaactgttgtagtattttatttttagttttactatatgccactgtagacataaccaaatgaaaaaatacacttgatctcaaaaatagctgtgtgtttctcttcagtatgtagaaaatgtaacccacactgctatagctactcaagtccacgcccttcacagtctgaaaaagtactaacatgaaaaatctcctcaaccaataaaactagagcagcaaacagaagacattcaagtgaaatactttttaaaaatgtatgtatgtgcatccagaattagtcggtttgatttatcttgtatgatactaactctattgctggtaaagattaattttattatggtgctcctggcatgttattttctcagttcatttctcagtatgacatttcttatttttctctgctacaaagcacccactatcataattttcacctgctgagtttatgttactgatgataatattaaaatttagagggttttttgacctttctagtggtaaattaggtcataaaaatagatgggacacaatctgataaatgagaaagagaaagatttgattattattaaagtaaaatcaaattttacaaggttttcctggcatactgtgagatcttagtaaacattgaatatcttccttctctcacacccccaaattgaattctctctattcaccgctgccttgcatatgccacacatgagaactattccaagaaccaagcgttcctgattgcttctgcatggtgcactggagatcttctgattataaaccaaataatacaaataatagtggtgataataatactaacagcttttattgagtgcttggtagatggcaggtgctggtctcttactatctccattttatagattaaacactgaggcacaagtatgcctcgctgtttaatctgtaaaatggagataataatagtaagtagcttccttaagttcacacacctggaagttagtggcatcatgactgggccccaggcagtgataccccagggcctttagtccatgctgccttctgtctgaatgatctctccggaaactatagcttctccacttggttcaagcccttgatcccaccccaagtctgttccttactgagaagcctgcagtcagtcttgagtgagttcccttttcagttgtgtgccctctcttcattgggcatgtgctcctggaggacagtgactgctctgtgatccaatgtgctcccaacaggcggcattgtgcctgtcatgtggacttggatggaccttgttaggagcggctagttatgggtccactgactttttttgcatattatccaaatcaatgtgatttcttaagaaccagagtctcacaattactaatgatgtattttcttttgggggctgaatggcagcaaaattcaacatttggattaaatgaagtatctgtacacctcagttcagtataatttgattgaatttattgagcctcctcctcttttcatttattgagtacctacaataagggtacattttgtgttaagacaacaagattcaaagatgaataatagtggttcctgctatcaaagaatgtaggagtctatagggcagccagctatgtaaaatgtattaaaatacagtatgatataagccatataaaatatattaaatacagtatgatataagccatgacaaaggaagagccagggtgctggggaagcccagagtggcacctagcctgtcctggggtggagagtttgtggaaaagtatggtccacagactggtaacactggcattatctgggagcttactagaaatgcaaattctcaggccccagcttggacctgcccagtggaaaactctagggtagggcccagcaatctgtgttttaaaaagctatctttgattcgattgcttattaaagttcgagaagcatagcctcagagaacataagactcacaggcacaacaattagacaagaaaacatatatctaattaaaacctgtaaaataagaaagttggatgatgtgatctctaccacctcagttttaactgtcagtccacgagacttttatacacatcttaaagttaactggagtgatgtgtgtttatcttcaagatcacctgcagataatatgcagaaggaagatttgtacttctcacctaaccactccaaacagattcatgagctgactgaggctgctgcacttccatcaatgcaatcatcaatcgatgagtgttactaatgtatctacctgcataggctcattactgtgttaggttctgcaaggaatacatacaaattctccactttaaggaacatgatctgagttggggagataagcctgtcagaagtgggttgttcaagatggttggaatgatgataaattgtaggaatctagagaagatggtgattgatttggactgatcttagggtaaggacctaagaaatgggaattgaggtaggcttaaaaacaggcagaatttgcattgcagacaaaaagggcgataagatagatggagaagctgagttatcaatacaaaatctaattacttagaatttttaatgaatggtgcaccaagctgaatttgacctgctgactcaagccatttattcaggaaatcaggccaacattttttctgaataccaggctgatggttattccattttcaccaaggggactagtttgaatactgtcatataaaatggtcaggaatgatatatatgcttacagctgtgagacttatatgttatgcatatatgtgtgtgtgattgtgcgtgtgtgtagtgaggggacagagaattatactgacacaggtactggggcttgatatagattgtagttgtatactgttcccatagtttcaagtcatcttcctaaaagttggcatggaaagaaattgcctttgcaaattagattctgcaagtctcaaacataagtagctcaccagcgtacactgaacagtctggaaattgtccagacagagaaagccactctgtaatctcacagagaggctgatagaacaatagaaacgacgtgttactgagcatcacggccacaagtctcccctgcaaggacagtttcaagctgggaaagctgagactttgaggtttttcttggaaaaaaaaattaatagatttctgctctattaagtgttccaagcctggcggaatgtcttcaggggaacctagagttttcagagaatggcctccatatacctggcaaggtgctgctgcccagagagggtgacagggaaagacttccctggctctgatgtctgcacagcttagaaatgcactctttctttttattttcttcttcaggaaactcttgctgtctttcgataaaaacataatttaaaactgtaacaaaacatgtgaatgtcttttcctttgggcaacagctttccttccaaattcaacttttgctctgcctgaattaggaacacgtggaggagataaacattgaggtgcagtttgctgaatttctgacttttgtgagaccctaggttagatttaaagccaccagtgtggggttcatagtcttggaggtttgatttaaatgcccagttatagctggctacaaacaggatgtcaggtccccctgggcatggtggcaggtcagtaaggagggaaggtgtagctgcatttggtggccatgaactcacaactggggatagttctcactgttaggccccagcaagggaaggggggatctccatcagagctgggaagagttttgaggttggaaggattaagacacactccagtttgttgtgggaaatttaaacatatttattgccaagtccaatctttgtttcccccaggaagaccaccaaacatgttacttgtagactgacatttgagcttttttgcttccaattcaagagccttattttaggataagcatttcattaagtgtggatatttgtgcaactgcaaacatacctttgatgcaagcagatttcacagctagagttggcaggagagctgcatgatggtgaaaactgctgctctgccgcctgccagggtcaatttagaagggctgacacgcagggcaccacgacacttaggcagctcttcctgttccagtctttcccgcctttcttcccttttttcttcattctatctttgtacctacttttttccttgtcattttcctacatatttcctcaaagaaatgccacatcccagtgagctatgtgtcaatgagatggatgaggttggagatgagcagtgtgtgaagaaatagagaatgactgccctttgcagcactgcagaaccatcctgggagagctggagagtaccaggcaaggaatccttgccaaagaccaatgtcaaagatggagtcagaccagcactggctggtgcatttcacaactctccccttcctggtctcacgtgtggttagcagaaatgaagtggtgcgaaaatcactatggaatatttaataatctaaatcataaaaacaaatgtctaggaagccctatggctcctgagtagcatacagaactaagaggaaggggagttcacctgctggtgcatccttgctcctggctgcttttataccactaatcctggtgccttgtcccctcccctgctgccttcatgaggcactagggtaatctgcttctgtccaccttttgggctcccgactctttccatagatgctactgaatgttcctcctgttccttgttgctcagggtatcaggcagtgctaagccatacctcttgtgaggcaggaataccgtaattgagccctctaggtttatttgactttaaaatgatattgcttgcatgcaagtcatgtctgtatgtttgtatatgcatcccttgttgatggtttggagcttacctggaacttcttggccataagtagaaataaatgcttaattttggggttgggttagaactcattttgttaaactttaaattaatcactcttcttaatctcacatattttctcgagaggatggacaagtctcatttgggtacggatggccattaaccttggtctggggtccatacagagcataggctctagaatccctaggccacaaagaaggttcggacatagagttcacagcacacgacctcaaataatatatctaagtattgttctcctaaattatttatgtagtatataaaatttgcctttctcttcaaaatgcaaatattattgaggctatttcctctcctgttgaggaactcagtctcttctctatgtggtaatatctagccattattatgggctgtttatttcattatttaccaagtaggggcttagctttaattaaaaaaaaatcagtgaatcttcctctgttcctaaattccaatcaagtacaaaagcttccctatttataaattgctttaaatgatagctgaattaaccaatacattgtcaatatccactgcttattatccatgagaacaaaaataagattttaaagtcccacagcagggactgattaaagaaattagagtacatctgtggcatgaaatattaggcagtcattaaaaatcacaaaacaactgataccacagaaaacacaaatgatccttagagtctatcatgaataactatatactaacaaatcggaacacctagaagaaatgcatacattcctggacacatataatctaccaagattgaaccatggagacatagaaaatctgaacataccagtaacaagtaatgagattgaagcagtaataaaaagtctcttacaaagaaaagttcagaacctgatggtttcactgctgaattctaccacatattaaaaaagaagaacaaatagtaatccaattgaaactattaaaaaaaccacaggccaatattcatgataaacatagatgcaaaaaatcctcaacaaaataccagcaaacctaattcagcaacaaattaaaaagaccattcaccatgaccaagtgggattcatcccagagattcaaggatggtttaacatatgcaaataataaagtggtacatcacattaacagaaccaagaatggaaaccatatgatgatttcatagatggtgaaaaagcatttgggaaaattcaacatctcttcatgataaaaactctcaacagaccaggtatagaaggaacatacatcaaaataataatgaccatatatgacaaacacagttaacatcatacaagatagggaaaaacggaatgtttttcctctaatatctggaaaaagatgagaatacccattttaccacttttactcaatactggaagtcctagccagagcaattaggtaagtgaaagaaagagcatccaaattggatggaagaagccaaattagccttgttcacagatgacatgatcttatatttagaaaaccctaatgactcggccaaaaaactggtagaactgatgaattcagtaaagctgcaggatacaaagtcaatgtacagaaatcagtagtatttatatatgccaacagcaaacaatctgaaaaagaaatcaagaaaactcatttacaatagctaaaaaaatgtaaaatgcctaggaataagtttaagtgaagaagtaaaagatctctagacaattatgaaagactgatgaagaaattgaagattacacaaaaaaatggaaagatattccatgcctatggattggaagaagtgatattgttaaaaaggtcaatactacccgaagcaatttacagattcaatgcaatcgctatcaagataccagtgacattcttcatagaaacagaaaaatactatgaagccacagtaaccaaaacagcatgctactagcataaaaacaaacacataagactgttaagagtagagaacctagaaataaatccatgcatttatagccaactgattttcaacaaaggtgtcaaaaacatagattggggaaaggacagtcttttcaataagtggtgctaggaaaacagtatgcagaagaatgaaactagacccctctctctcaccatgtatgaaaatcaagtcaaaatggattaaatacgtaaatgtaagaccagaaagtatgaaactactaggagaaaacattgaggaaatgctccaggacactggtctacgcaaagattttttgaggaaaacctcaaaagcacaggcagcagaagcaaaaatagacaaatggaattacatcaagctaaaaagtatttgcacagaaagggaaacaatcaacaaactgaagagacaacctacagaatgggagaaaatatttgcaaactctccatctgacaagtgattaagaaccgtaatataaggaattaaaacataaggaactcaatagcaaaaagacaaataatctgattaaaaataggcaaaatatctgaacagacatttcttaaaagaggacatacaaatggccaacagttttatggaaaaaaaaagatgaacatcactaattatcagggaaatgcaaatcaaaaccacagtgagatgtcatctcacctcagttaaaatggcttttatcaaaaagacaaaaaataatggatggcagtaaggatttgaagaaaggggaaccctagcacgctgttagtgggaatgcaaattactacagctgttgtagaaaacagtatggagtttcttcagaaaagtaaaaatagagctaccatatgatccagcaatcccattactgggtatatattcaaaagaaagaaaatcaatataccaaagagatgtattgatatattgcagtactattcacaatagtcaaaataaagaatcaacctagtgtccatcgtcagatgaatggataaagaaactgtgatatatatatatacacacaatggaatactatttagccatacagagaatggaatcctgtcatttgcagcaacgtgaatgaaactggaggtgattacgtaaagtgaaataacccagacataggaagttagacaccacgtgttctcactcgtatgcgggagctaaaaaagtggatctcatggagttagagagtagactggttgccagagtccaggcagggttagggttggggatgaagagaggttgattattgggtgcaggaatacacttagataggatagagtgtgatagttcagtaggttgacaagagttaacagtaatctattgtatatttcaacatagctaaaagagaagaatttgagtgttcatagaataaagaaaagtgtttaaggcagatgatatccaattgtcctgatttgatcattatacattatatgaatatatgaaaatatcacaggtacctgaaaatacgtacatctattatgcactgataaaatacattttaaaaacctatttaataacatgggcaaatgctcattattgataaagaaaaatgtaggttgtaaaattgtccatatgatatgctataaatttgataaaaatgtatatacatgcacataaacaaagataatggaaatacaaagaagtggaaactgatttgtgagtggtgagatggcaaatggttatctttttattttttctgcatttctacattttccacaaaaagaaaatggtacttagggataacagtatttatgcatatttatatgtatgtatattggctctataaaagttaccaatctccattcaaaacaattgcttttgcatttatctctggtaggattatcatgaacctttctgggggaggacattctgtctccaaaatgggtaacttttgttcagatcttggttttatctatacaggtatccatgtccatgtcagaccatttcacacagcactgaaatttgtttcctttgcctgattttctctaacctggcctggaggaagaaggtattttcacttctctaaactcaatctgtcagctttattaaacttgctaatcctgttacatgctccaaattcactaatgaccaagcaggtaccaccaactctggccctgataaaaaggacaaacttctagccccagcctccagcagtggaaacatagtcagctggcattgaggtgtctgggaaggaaacttctctgagccttgactggatacaagaacattcaccgtgagccagcttctgtctgtttttgacagcagttccctctctaatccttccttggagctctgtacatgctgggatgggggtgtcctaacaaggtacctttgcaatcattgaccttttcaagggtgctgggttgggacatgtgtggattttttcagttggaactatgggtttcacagtgaattgcagcacatacagttaattcacagcagaaaatgtggtgaaacagctggaagaaggcagctgcataggggcaggggttgtagagggagagcagggttagaggtggggaaggaaacattggcaggagaaaagcaataatgttacagggctataactgggggagaagagcaagttctgggtatgagcatttaatatgtggacagggtaatatattcaatagggtaaaggaaatattagtccacgaaaaatccaacttcttgacttcaggcatctgcagagcaaaggtgacctcagacatctacagatatgggcccatccctctctaaagggaagacaaagtggctcctgattttccagttgagcttttctggaggccgtaaagttctctgtaccactcattgtgccccactcctactagactctcctcccaagcctaccatggagccagtccttccaaaaaaggtctcgtctccagaggattgctggaaaaatacaaataaaattacttcaagctcatcattcccactgtgatactgacctacaggcagagaatgaggcctgatggaatgaaacaggactagcaggttttggtaagtgaaaggcatgaggacatggagtcagctccatgtgggggcagaaatcccatctttattactcatcactgggtctccaaaaccttgcccagtgcccagtgtgtccaaggctgggtaacagtaatgtctaacacatgctgatcacatcagcactgcaaagcaaggctcacagtaccctatgaggtaggtatggttattaccttaattttggaggtgaacaaaatggaagtgcaggggttcagtgtatggcttagggtcactcagattgaaactgggctgcttcatgtccagatctgttcttaacctctacactctgctgcctccctcaatgaatgtttgtgggtgtaccaagtagaaagtgatgtcaggctgtgtggggacacaaatgaggtctctgtacaggtcaagggcagcaaggaggaaggctggaaggagaaacatatggagcaggatgcaagagctgcaacacctttggtcccaagctagtgcttgctgggcttagtcctggtgggtctgggctcattttccttctttttttctttgagacagagtcttgctgtagcccaggctggagtgcagtggtgcgatctcggcttactgctacctctgcctcgtgagtcccagttcaagcaattctcctacctcagcctcccgagtagctgggatttacaggcatgtgccactatgcccagctaatttttgtatttttagtagagacagggtttcaccatcttggccaggctagtcttaaactcctgacctcgtgatccacccacctcggcctcccaaagtgctgggattacaggtgtgagccaccgtgcccggccttattttccttttgatagagctgtgggttggggtgaggaaggtgtgaaaccttatatttgtccctttctgctttgtctgctcctctcccagttcaagatcggggcccctaagaccaagcagcaagttctgggaagaaagaatccagcctgagttgttttttacctttagaagatacggtcccattctttcgtacaggttgtctttttcttttttgccttgtttggtacatcagtatgtattctctctcacgcctccctgcctaaagggtggaagctacattcagaaactgagcagaggactcagcacatgcagaggttccctcacatacatcattaaaatacatggttaatgatagccttctgctgtgctgtactaaacttgaagaatgttctttgcacatatctcttccatacgctcctaacgtctttactctgacagacttaaagacagctctgaggatttactttcttaaggaggtgacgtgaaaaactgaaaagtcttttttcttttgtgtttttgtttcactggtgaatgggaaggtgttctgtttgacagtggcaaccttcagcatcaccaattaaacctctttacaaattgcaaatgatttctttaaccccagtgtgggagtgtgaattgagcaaatagaggaatgtgaggtagcaactttactataacagaaacaaggacaggaggagagaaaattcatggaaagcttttagatcaaattgttttaaacattgctggctgaagctgtcactgcatttcattcctcctacctgatcctacagttctccctcctcatccttcccctccaccagacacacacatgcaaggatcataggtggcgatcctgctgggaagaaggtcatcaaaaaagatgcaagataagaacatgatatatatacatatatatttacaatttaagatgttgatatctgttatacataattaccagggaccaggttattcagcagtcctaggaacgtggagatagctcagagacagagatgaaaagaaaatttataggtttgctttccaggaaagaaaattgggtctgaaacaactgaaatccttaaagaaactggaataaaggttagttttaaatttggttacacttaaatggttgacttgcctatctgtcgttaatatatccagttccaactacaaagagaaaacaaccagcaggcatgagcgtgaactgcacaagtcctcttggagaacaaggcctttgcagttgacgtcagtttctggccctaacagttttaaatctgctttcagaaaacttctcctgggcatgcattcgcagatgatcttgtgataaggggcaagggttgggctttttaagggtgtgtctgttttgagacctcaagcatgctggacaatgtgttggtcagatcctggtggtacacagtagaacgtaaaaacaacagaaaagtaatactaacagaccatgagctagatgagtcttgagactaagacaaatgaggaaatacaagactctacgtatcctttagtggattccttcaggacgactaatagatactataagggtgcagcagctgcaccaacattctgaatgccaggcaattccagaagtttgaagctccctgtcagactccaccacacagctattaatatacagaatcccccagaaacaaatatgagatgcaaccaagatttatggatatgttaattacagatttataatagcaaaaacaggaagttaaatgcctgacacacaggcgtgtggttcaattatttcacatctacattatacagccgttaaaaatcatgtctttgacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacactgcatattctcactcatagatgggaattgaacaatgagatcacatggacacaggaaggggaatatcacactctggggactgttgtggggtggggggaggggggagggatagcattgggagatatacctaaggctagatgacgagttagtgggtgcagcgcaccagcatggcacatgtatacatatgtaactaacctgcacaatgtgcacatgtaccctaaaacttaaagtataataaaaaaaaaatcatgtctttgaggaacatttggtgacaagaaaaatatttataataatataatgaaaaatcaaaaaggtacaaaactgaagacaagatgatagtatttatttattcatttatttatgggcttttccctctggtcatatacatgactggaaaaaactaaaataaagcgttaatggtggttatctctgagtaatgagataccaagattttttttccttacccctatattcttttctttctataatttgcaagcttcaaacatacttttgctttttacttttataataaaacatagtggttttaaaaacacaattgtcagctctcacaagaacacccagctaagttggcaccagtccactgtataattgttattaataaatgataatgcatgaaattcctgcccccagatataaataattataatgaaaaataatttatttgtctcagacaatagcctttggtccagaggctttaaaccttgtgttctgccttaaaattcatcctgccaaaagtcctgtctgctatattaaatactttgttatttgttgagacagggtctcgctctgtcacctacgttggagtgcagtggtgtgatctcggctcactgcaacctctgcctcctgggctcaagtgatcctcctgcttcagcctcccaagtagctgggactacaggtgcgccatgttgcccagtctggtcttgaactcctaggctcaagagatccgcccacctcggcctcccaaagtgctgggaatacagacatgaacctccacacccagcctatattaaatactattgatgcatgaagagagaattaatacttgttgagtatgtactctaggcttggtgttaatgtacatggtttcatttaacacacaaatgaggaaggtgaagttcagaaataatttgtctcagtcacatggctactcagtgatcaaaatggattcaaaccctctcagtcgggtctgaaggcctcgtctcttttgaccaccacaaggctggtggcaacttcagatgagacgtagacttcatttcagacatttaagaatagatttgcaaaatattgccagtgctcctaatgtgagggcaaaataattgatgattaattcttttctttcacataccctagtggaggtactggggaaacttccaaaaggagacaaagttcagacagaaaagagggtgagtaagtaatccaccacctgggaaacccctgataaaacaggcagtgattgtaaagattagcccagccctctgcctagggagggaggtggccacccgcagtgactggcaaggactgtcaggttctgttacttcacaaatatctcccccaccccctaggtcaaggtgctgctcttccttcctactgagccagaaccccatctctcaacagtcattgctttgagttgataacaaagcctacgtcatagactctagacaggtatcttaaaaaagctgaaaactttcctgtagaagggacaaagacctcgaagattatctcactttactttttccattgaataataagtgacttttaaaatttttcaaaaagggcctatgggctagatactgtgttaggcctgtctatacatgtatcatctaattcaatcagcagatcaatttataatcaaaacatcttagctagaacctcacaattacaagtacttccacatacattctctcatttgcttctcacaataagccttaaggaaggcaaggtaggagttatccccattttacaaaccaggaaactgaggcctactgccactttgtctggcttattggaacagacagcagcttccctggaagccacagagggactggctgtgtgtggagtggatatgaaggttttggttgagaatgtggcagccttgtgtccctggaagacagggtgctgaagaagggttttagggtaaggatgagggtcatgaatatgagagtggaaagataaactatgtctcacaacattgcctatggggagctctgtatgaatggcttcctcctttggctttctactttctcaatcctattcactccccaaaaccaaacccaagtcccacagatccaggaaacctttcttgattatctagcacaaagaaaccatacgtgtaacaccttaaggttttcccaggccttagctcattacaatattatgacatgcttttgagataggctttgccattctttttacaagtgagaaaaaggaagctcagagaggttaagtaacttgtcaggctgatacatttaataagcagcaaagtctggatttcaaactacatcacatcatagctgcctcaacttcctgtacacttatcatgtcctgtatcttgtcatgtgtttcttaattccttaactcagttgtaagttccccgagggcagacaactagtcttatatttctttgtaacccccatttctgttcccctagaacttagcagagtcctatgagcacacaagtcctcaataaacatcatatgttaaatatctgctgggtaggaacaataatgattaagtgggatttttttgatactctgaatattaggctctctgttgtatataattaaaacaagagtgaacaagaaatatataatttctcctagctctagtgtaatcaggcattcattatcatgtctaattctgtgttcagtgaaaagaactgcttagtaagcattttctttgatgaggataatcaaatacagatatcagagagatttaaaaaagacaaaatcatcaaacatatggagaggcaatgatctacagggtataatattccatctgagactaaagaactttcaaggcaaaaagaacacttgtttactttttgacaattggatattcaaggaacactaagagaggaagtcacggtgtaactgggatcttgtaccatcacacattattctttatcaagaagatggatgcactgtgctactgttctgggtgaggaacagagaaggagtacatttcaagggctattctgagagaaggggttttctctgagaccttttcagcatgtcagtcatttaggtaccaccttcgctggcaggcaaacttaatgaatatacatgcaatgcgcaactgattaccctgtcgggtctcttgctatttccctcccagtatatcatcagttatagttttggaaatacaaagagctcaaacagactcactgaaattagaatttttgatggtggggattagctcacatacttctaaattgacatttgataaactaggctgacaatagcagtgcctgtcaatcacattttcttgccaaacccatatattaatcttaagctgctgacaggcagagcttctgatttcctttatgtggtagataaagtgctacatccccatgtgttcaaccaacgtcaagcaagaagaacaaataccaggtttgtggtacctacatttgaatcctcatggctgtggccattggtctcgaccaattccttggtaccttttaactgcaaattttaaggaaaaacaacacaaaacaaaaaaatgaataagcaagcaaatctcttaagtatatcatcttgttaactgatttatctgaggttgcattttataaaacttccaatgagataaaacagatggagcacatatttctaatgagccttattggagccagtttgagaccaatattttatgaagtttgatgcctggcaaaagaataaatgggtcttggtcattattttttaaataataagattagaaagcagttccataggcataaaatgtataaaattggttcttaagaataataaatgatttcatttcctagttggattgctattaatttaaaccctgcagtgtttgcaagttgccaccagcaaaatgatgttatattaacgattattcgtgaatgatgcattttcagctgcttttaacatgctactgtgctaccagacaggtcctccttgagaatatatttgaatgactgacatctctggaggactaaagacggttgcttctttggtagagaaagagtttggatgacatctccttggccgctgaggcattagaagaaattatatttctctaatgagatttttagcagtgaacatttgaaaacatttctctttctcagaggcttaggagtaatcagttataaggaggtttcaggaaacctttaattgtcattttatcctatcctgacgcaaaacagacatttagaatcagacggcaaaggaagagggtgagctggcttgcaactgttttgccagtattttttcctgacttaggaaagcagcatctcctccattatcttttttatacctaatacaaagtattcatggtaggaaaaaatacttaagatttgaaagaaaatcaatgcacatataccaccaatgtgtttgattcataacattggttccttctggctacttgtgcatattaaaatgaaagcttctttagttttttaaggccagtcttaaactcccagcaaaaaaaagccctacccgctccatgccaaagaaggggttttgccaaaggaatggtaacatgaagaaattgaggatcaggtagttgattatggaccaaaggctctttggctcatttccatatcactcccacttaagaaaaaagtctgcccactgttctctagggcaacatcattgatggttctacacacaacagacacaggggagcatgggcgatgtatggcatatatgacaaggcagaggtgtgccacaataataggaatactgtctattatcacaggacacaaaaggactttttaaaatcccctcactcttttcctagctgagggtttcttattgtaggtatccctcatcttcatcaacctctctgctcatcccaccttaggtcctgtagcttgtgctcccatgagttcgagtggggttagctcagaaggtcttgttctttttcagcagaagtagaggactattttgtgaatgtctgttccacctttacgtgtttaccaacataaatgtgccagttgctctcctctcttttaaataaactccattcttcccattccatgatgtcctctaactctgctctcgctttttctgctcctgtttattctcccctcactccctgtctcctggcattgttcactccgctgtgctccattgccagaaccgtggaggaaacccctccccgctgcagcccacccctctccttcctcgagctgcagctccaggacagctgctgctttgttcttctctctgctccctgttcttctctcctttagctgctactctcccccaggtagggctgaacatcctgtctgatgaaactgaggtttgtgaacaagctccagaggtaggaagctatcctcattgtaaatgagatgaaaggcaggagtcagtggggcctggagggacctagaaaagctgcatcttcgcaaatgggaagactgagagcttaggggttagcgtggccttccctggaggggctggggcctgagggtgggaaaggtctgccctcaggacctatcctttcttgtcaggattcccagcacggggcaatcctgtgaatagcaacattccaaatctgcagagcagggtgtatctttccctgcatgtgtccatttgtttaggccacatctatgtgggcactgaaactgtttacgcatagagttactctacacaaatccaaagaaagcctcaaaggcagtggtcagtggaggtgagaggtgtcatcagtgcacatctgtgtgtgggtacagggacatggaaagaaacctgtaccctgcatggccccttttgcaagaaccaccaaggggtagcaggtgaggggctcttggacaaacagcttggtaatggcaccagcacccaaaaacatttggtgtcaggcttaaagattcttggtatctgtgcttgtaaagagctatcccattgaaattaatattgcagatttaaaattcttccttctcaattgtattttctaggtctttaatgattttagctgtttcgaatcttcttcacgttctcttttttttaaaataatggagagtgaagtgtgatgtttcacccataattgtgtgtgctctgctctttaaaaatgcatgccacaacaagatatatcaatactttcagcaaaactcagaatctatttttatgactagggtttggacttcaaaataaaggatttgagtcatttagagaaaagagaaattcacccctccccactctagtcaaagctatctaaaagaaaaaaaatcggggtgagagagcagaaaacaacaaaagctcagagctatatctggttgatttggagcaaatttggaccaactcagttccactttgctgggagtcttttcataatataacagtggaaagcacagtgatttcaggtctcctcaactgcaggtcattgtgaattcagtcaactagatttttcatttcaatctactatatctgaaatcatacagagtcagcctcagtacaagttactgaatctatattcatcatataaagataattattagttttataaagcattttcttccaaagctataaaggtttataaactaatatctgtacttttctctcacaaatcactcatacctttgggagaaaataactaaaaagatattttctggaccccaaaccattaaaaaaaaatcactcataaagtgacacagagctgactttatattttctcaaatgtcacctttgaagttatgtatacagtgtaaggttatttatacaatataaaacgattatgtgtatgaaaaatttaaaacaatctgcatttgattactcacagagggttggggtaactgtatgcaactttttccttcaaattaccattcatacattgttggcagcaagtgaaggccagaaataggaaggcatttcaagagctctcctggctcctctcatgtagatagtgggcttagatttcactctgctgcctgccgagtgttccatcttaccctgctgtaagacaatactttccaatccacttatcaatgtcaggccacacttttgtatcaaagaaagccagaatgaaatgatcaggtttacaaacttcatataaaaggtctgttgctcaccatggttagataagtaccctgatgcacagggaagatactttttaaatgttgctatgaatcagtccttgttcatgtgtctgcaggagtctcatgggttatgctgaactcattttcctcactgttagacttaagaggaaaccagctgcttactttgaaacatacctcattgccagtattttgaaactttatcgaaatttgattgtcttctggaagaaactttcacacaacactggcaggcttgggcaatctaaacaagtacaggagtgaggatagcgatgctgggaatgaggttataaattccgcatagcaaagctgctaggaagtttgacagggttcagactaattgtactgcagattactttcagtaaatgtttgcacgggtgacgcacaagggaggtatgcaatggggtgtttggactgattcataaatcagagctgtttcattcacttacttgttcctgcaggacttttagtaacgcttgtgtatgggactgctcttcctttgcttgttccaattctgactttttgttgtttaactcctcctggatggttagcaattgctgtgaaattaaaggatatttagcataagtaggattgaaggtcaggtgatttaaaaatatccacaatacccattcaaaattatgagtagaagatgtttacaagtcttgaagcttaattcagacctcagttgaccttgtgtgttttccgcactaagtatcaagggcattgcagttttgacacactttaggttgtttgtgatactgatgcacaaaacttgttttcatatttgtgaaggcatcattatattcctttgagcaaatgcctatttgtaaaactatataggatagtgctaatacattacattcatagatgaaaaaattataatatagtcaacttgtccaacgttgcttcatttcacatattacagtaaagctagctttacagtaactctataaagctactttgccaagtggctgggaccacaaaagatccttttactttctctgttatgatggtgatgttttattagatcagtaggactgaagtccaaactgcaatcaatatatcagctgagaaaactgctgatataaactgtcaaaacatcaagctatggcctacactgctatttttaagcagggccactgtatggatttttgtaagccctgagcttcccttgccctatcaactgtaactcatgtgaaggctttccttgtctgccaaaagcacagcgctgcgcagtgcgaattctttgggacatggtgatatgttaatatatacataggctggagaatacattcaagagctgcaaaaaggccctggaaacagctctgactattcagagcttcttgacaacaaaggactggttcgaaaagacagagtgcatttcttctgctactgtacataacaattgctgtactaatgatctggaaatgttagtggattcctgctatgaagagacctgtctccaatagccaggctacttcttcagggccttgacaagctggctgcagagctgcctggccagttcctaaccatcaaagcctggagaaacactggcactggatttctcaggcttaaacctaccaactggaaggattaaattaaatctccaaatctactggtttggggggattttgcagggtaggaagtactcagaaaaacacactgtgctttccctgggacttgcttgttctgctaactactgtggcactgggtataaatgtaagaacctactttggtcctgtagcataaacagtgatttcttgcaattttctaaaagctcagtgtgtcctatttcaccacctgcccatggaataatcaatcacatgtgaggtaatgtacacattccatatgcgctcacttaacaatttgtgggatttaattgtgcatcattgattaaagtacagaaaccaaggagcccattttgcactttggcacagtgacaagcacctacattgtgtccagaccgtggggaatggctctgttccttcattcacattcctgactggccctagaacagttccaaagggaactggtgccctgacttgggtaatgccgagtgaattttacttcatgagacgatttcaaatccaatccttaaatctcttttgaaaaatgagccaaatgaaagataggaagttgtcttcaaaggtaggtagctcatgtttgcttattgcagcacttgaggtggcaaaaccaaaaataactgatgtccagaagaagggaggtggacattaataatcgtgtatctgtatcatcagacactatgcagccatttaagatgaagttgcacaaatgtcttctaatgacacagaagaagctcaaaaagcactgctcagcaaaaaatacattcaggttacaaaatgtaactttgcagcatattcataggaaaggatctagatgctgtctctgggtgggtgggttcatgtatctttcttttttgcttgtcagttttctggtatatctgtaacacatactgctttagtaatgagaaaaaatcaaatgaatttaagatcggggaagaacaaagagaggaatactacttggacacctctctcagctattaccaatactgtgaataaataagagggagaagtgcattggagtcttcattgcatccgcacacttacaactcttccttctattaaaacacacacacacacacacacaagcatgtgtgtgcatatacacccctttctcttgaccactctttttcttttagcctccctcttatctcatccattcttggattcacactttttaaatgaaatgtcttccctctcatcagtgcttccttttcttcttatgtgtcagtgatgtagtgtctagatttttatttcaatgtgtttttccaaaacatatattgtcattgttttgtgtgtttttttatgtgatattatgtttcttattgtttgctatgttttaaattagcattatgtttttaagatccatccatgttactatttttttgttaatgaatttatttaaaaatctaatagattttccccttttattcccaaaatgtgctatacataaggaaactttgaaattcccttgagattttactgagcttgatttattattattttttattatactttaagttctgggatatatgtgcagaacgtgtaggtttgttacataggtatacacgttactattttatgtatctaatccatgcttctgatggggtatatccaccccattttacccaacccactctcacagtgaaggccattcagattaccccaattcttcccactgtatacaagcctgcaatggaatatgctagtgcaagttcccttatggccctgtgggaggatttccctgggatgcatatccagtggtggaactcttaggtaaaagagtgaatttggcaaagctgctctctgggatggttatgccagtctacctgcctgtcagtggtgtgtaagagctgctgtgctctactgaataataacactaaaagcattgttcggctttctaattgttgccagtttaatagaacaccaagattcttcatctttgaaaaattttgtacttctttgattccctgtgattttaagcatcttatatacttgctagctataggggtttatttataatttttaaaatagtcaagagcagtggttcttaattctgactctccattaacattatctgtgaagattttcaaaaaaatacttatttctgggcctgacacaagaccaattaactcagaatattgagaggtgggacccaggcactgaccatttttaaaacaccttcacaggtaattattctaatgtgtaactggggatgaaaaccactgtatcctgaaatgcttatttaatcttgcttatttaatcttcagtctactataatgtgactttaatccctagtactctactcagactgttctcactacagtcaccagtgccttgctaattgccagctagtattccaggttcttttcttctcactacacgctctctccaggggatcctattcacgcccatggctttaactacacatcacatgtgctggtgctttacaacactgcctttacagcctctgcctctttcttaccacctaccagacccttcacttcctgtgtttacaactgtgcccattagcacacctacccttcccaccccaaccagtctaaacgtctttccctggtaaccagagttaaaaccttgaagtcaacgctggccctttcatcaccttcacaacctctttgccggttccttgaccttttctccatcccatccttgctgtcatagtaaaggctaccatctcctctcctctgggtttttcctgttccccctgccatttacccgacactcctgagagagttgacttcccatgaattaaagtgctcccatgattaaaagtactgttaattctctaacccctatagataaaatctaaaccactaaactcatccttccccagacatgccagctgcttccatgacttatgacaagtttaccactcagaattctgcctggcttattcctactcattctttaagcaccacctcaaatgttgcttttggcccaagatcaactcagatgatgcctttgtaaaactgaaaagagccccatcctctctaggtagagacaatccctcaccaggcatatggttgggcactggctttgaggcttgatttcattcccacttacccctttggcctgctgctcttgtccagggcagaacctacactacgaaatgcggtagccttgggttcttgctccaaaaaaatattctctaatcactgaagcaaagttagttcatctatcttcttgctcccaaagcacttaattcaatataccacatttcatatctgtcttcccaaccagactacattcaccaatattaaggtcaatgattaggttacctctaatatataatagctgctgaatgaataaatgaataaatgaagggataaatgaatgtttgctcttgtttccccacttctatgggattaaaccatgatccaacaacaaacaataaaaaacccaccaaaacaacaaaaacaaaaacaaccccccaaaacacctgaggaatgataaactactaatgtattgttctaaacatatggatacataaaactttttgaggaaaacagcagtttcatttaagacattttgtttcattacctggcagttccagatatcctttttaatctgaaaagaaatatttctcaacaggctaaggaaatccaatcaatgaatttataattacgtaatttattcttcaagtttcaccacaataagaacaaaatcaccattatcagaaaaataaaatcactcctagactgttttctgcattctgcaaagttaatgtgctcttttgttttcaaggtataaactcataaactaatatttatatattcaaaacaatggtgattcaaaactgccactcttcatgtgactagaggtcctataaaaacggaggtagttcacaactagatgatttaagtcagcctttctggtctttttcacttgaaatttatgagtctctataatattctttccagtttgaatttttaagtactaaagtgcctcaattatagaagttcataagcagctagaacttaatcagaagagtctcttggttggattggctgatggcagcgtaattttaacatttgagagtgtggcattaaacagatgcactattacattctttggtggttacaatggagtgtgttccaattagacaattatccatatgccaatcaagtggaaacacttgggcggaccataagcaggtaaataaatgctgtacctgacacatcttgatatttccaggccactgatttaatgggatcatttgtaatgctctttggggatgcagacttcagtatgtaatgggtctttctttctgacaaattcaaagagcattacaaatgttatttggagccctagaataagtgaggtcacatttccatttttacagatgggagaatcatgggcacatagagattaaggtcatgctgtctgggagacacctaccacttgcacagttcaattttcctacctcaacccgtggtttctatcctggcaatcacactgcactgtgaatttggaatggaaatcagaacatgccaaacttaaaaatcctcctagcaacgacttctatctaaacattcatcatttccacttaggagccaggcttgttacagacatgcttttgtgtatacttctgtgagcggtgtgtcaaatttgacgtccctttaagaacaacaaccccttccttgtcttttttcttaaattgtataattttgttaccaaggtgaagtttttatatagttaacagactatgtaagtttggttccatgaaagtcatagatgacagtgcaaataccctatatgaaatacatcagccacatcttgttgtaagctgaaattcacaggattgtgattaattcaggaatctttggcaggatagtgtggggttaggagaacttctgtgggatggaggagtaagtaccctttctaaatttaggttggtggtgggtcaggtaaactaacacaaggtagatagatatagacagtgactgacaccaacacacacacacacacacacacacacatacacacaatttcttttcttcttctgtttcaggatttccccagtgcttggctctttgtttagttctaaaacaatctgctaatatttattcattcattcctttagtcaacactgagctcctgctgtgtgcatggtactgggctgggcaatgtgaaagatacagaggaaacaacagtaaatagcctctcctctagatgctgggtcacaaaaattcttacatgtacatgataactaagtcaggacaatacaaaggactcttacaatggctataactagtatggtttccataggaatccaggagatttctggggatcagtttaggggtcaggagaatgagctcaggggatccatcttgaatcataacttgttccacttattggaaatgagccactgaatattcacgataatctgggaatatttgaacccacagaatgttatcaatttaaattcaatgtgttttttactcttttggttcagttttaataactgttgttccatctctgtaactttgctataaatcagatgtcctactcagtgggataatcctttaaggctagcagagtatcacctaaggaaatgagccccagaggtttccaaagggaattctcaccaaaggcgatggtgggtgtgactgcgtctgatggtctcatcccagcagtccttttaacatttgctctacgtggcaatacccatgagtgtcccgccccatcctgcctctgtaaccctgttgccaacctgatttttcccagtattttggcctgcaatctgaactccacctgtgaccagctctgccagatccctgtcctactgtagagcttgagatggaagtatacaccccttaatcccctttctcttggtgggatcctgttacatcccaccgccccacagcttactgtgtcttcaggtctccccaggactctccagaccatccactgctccatcaagttttggttctcactgacttcagaactctttaggaatgtcagccttaggtcccgctgatgaggtctacctatgcttgttttccatctgacactgaatcctgagctaatccctgattgttagagaaagtttgagatttaaaaattcaagtgaacattatcacaacctaagagcaaggctttgcctaaaggcaaacacatctaacaggatttctgacaaaggagagagcctgtctctggggaaggacaatcatttgccacctggtatctacaatgctcacttttctccttggggaaaaaaagaattgaactagcttgaattttcttgttacatgggcttgtaagactactcaagatctattctagtttaaaacgtcatctgcttccacctggggatgaaactgcactcaatttacactaaggcatgagggtatccaagcctatggccagtgtattaaccctggtgcccccctccctgcctcaggcatggtgacccctgggggagaaacatctcttggagagaactccaccattcagacgactgataacaggaatcctggatcatggaaatgaaattgtgttcacagcctaatatgctattacactaggctatacatatttaattccttgggtctttcctcataaatcaattcctctaggcctttaatctcgtcaatatcttttctgatattgaattttaaatgccattctcattgctaggcagaaggcaatctctcattcatgatgagatcaggcttcatttatagctgagagatggtgggagcatggccctgttccctgaccctgctgttaagatcctaatgtcagctagaccgcacagccgaggtgcaggcctgcctgggttgatctctgagaggtcaagataatgaaccctggggtcatgcctatcattactctgggagcctgggacagctatggagaggagtgagaaagctcaagtaagtgtttccaagggtctggcttctcatgggggtgcctgaggcatgaaggaccctgctgcaccctgacctggcaaggatccctgtggaccgagtaaggcatgagctgaaggatgcacactgtgtgcgtacatctgagcaatgtctcccagcgcaggggtgaagggagggcacaggctgtgtgttcgctaggggaaaagagggcatggaggaactccagagaacaaggacttagagctgaaaatgtttccaggttccctagggctggcctggaatgcagtgggatttcctctgctgcagagaaaaggaaaaaaatccaagaatctttgagccatgaaaaatctccaaagggaggagtgagtttttttaggacctcaggaggcacagagaggttgagaaaacacaggaagccatctgagatacagatttgagggcctaagtctgcagcaagtggcggggcaccaaggacggggcctgggctacctgccttggtgtaggagttaagcaggtacaattgtacaaaatgtaaaaacaataataaaactaaaggtgtatccatctatcatcactatgcaccagcaattctaagcaaaatcattgataaaactctccttcctcataacaatcttttgctgatctaaattctaattgttgccattactgttaagatttaataatatgtatgtaatcttcaaattagcatattctgttgcttaccctttaacaaacattttatgtggcaactgatttggaaaatttctagctttatacagtctgccccagctctctctcacacatgacttagctgcacacatttgttctgatttgagcttgctttggatacagtgtctccagcctcctgtagcactacatatattctgcatttctatactagattcaaaataaacaatgacagcacagttttgcaaagacgatgaactagaacttgagctacttccattcatcccacaggaccactctgagaatttttatgtttaaaatttaaaacaatgaaacatttttagttggcaagtgaaaattttagttcatatgtgaaatatgtttacgtttcagtatttttaaaattgaaaattttctttatagattgcttgctttaaaactaaaagacaaatcaagaaaatgttacatcagagacacaatacttgcctaaattgtgccctttgcatttggttttattaatacttatgatttactggacaattatttatatacagcaatatgttaactataatcaagaatcaaagttctaactgttaggtaaagtaaagaaaactattgaatagatagttgcaattttttccttttatcacactatttaattttcttactggcataaatatacatgaagttcaaaagaaaaaaattttagtctgcatttctttcttggccattattattcattccattttatgataattaatgaaaataatgttgtctaaatttagaggaggaaatatttaaaaaaggatcctctgagtgttaaatttcactaggtgcacaattatcaggcagccagtgcctgagacggggagagtcatgaccttggcctgttgggctaggggctggggagaactgtttcatcagacaagattttagagaccatttcctttgcttgaatgtacccctgggagggactggtgtgaaagacagatgcttcgtggcattcccataatccactggagttattaatcatgatatactatatcccaatatggcaacattattctgaaaagaaatatagtcaaggactggcaaaaaggcaaaaatgaagctgcatgtcggcatttcaaaggctagcgtgattagctccattatcagcttgctgtgcaagcttgaacaagctactgctctggtctcctcttttccccaagccttctatccttacaactgccaaatgaggaattattgatcattcacaaagcaagatatcaatgaatttcttgactacagaacacagtaaaggtagatgtaaaagtggtttggaaggctctaaaatctattttctcttctacagatgattttcttaacactgtaatttgcagggtcatctcaggttcccgtttttcactttcttcacatgttaaataaatataagaatacttaccagtgggatattgtatgactaaagaacatgtgttaagtatgtgatgctccttgaatgacaaaaggtgcccgctgagttaaatgaaagtgctgtcattatcctctttgcaaaaatggaaacactaagtcccacgaggtgaagtgacatttaagtcatatgagtgggcagtactggggattaatattcagagagaaaggtcggttgttcagccccagcctagccatgctgggtgcactccttcagcccatgctgaaaacataggccagccaacttgaattaacaccattcatgcaattcacaagagaaggtgtcaaataccttgctgaagtaggaacatgtatcagtgacattctctcccttgcctttgctggcagttcttctgcaaatggtaatccaatttgcttggatttatttattcttatcagttttgttttttgcaattatgtgaggtggtcatcacccatcctctgggcacgtgtacagttgttaatgtagaaatttaaaatattaacatgctttccagccaggttggcccatttacttcaatcaaataagaacttgatggaacagctgggtcttgcactatgccctgaaggcctacagaaatttgttctttctttacagattttataacctagtcatgatcagagattacagctagaaaaacccctatgggtgacttgtagccaaagacctgtggccctctttggaggtaccttttgcaagcgatctgggcctcattcagtttaaccactggagaaccaaacaataacttgttttagcatcattaacaacagatattaccatcatcactagtctctttggttgcaggtttaggaaagaagcttttgccttaatcattatggaataagaatgtgttggagtccagagagcttttagttgaatcttaatggtgagagttgcaatgatctagcctgttttgcagatcagtgaagagagaaaatacagctgaaggtctgatccatcagccatagatgtctgactaaggatggaaaactttattatggatttagaaggtctgtatcacctatattacttaactcctgataattgtagaactttagtgaagttaatccaatgattacaatattcccaatttttctttgttaatacaagtaaacatttttacaactaggagaatcacacatttaggagcagggtaaagagagaagaatagctctgaacttagcacatttaatctttaggtggctctggaacaagatatgtaaataaatgggcacattcatcaatcactaagggaagtgagagggagaggaagtttgctccttcccccaaagtttccaagttatttaaacacatttaggctggtctggaacccaacattttaggaatgtcagagtaactagaacctttggaggtctccaagtttcacctatgccctaatccagggtcaagccctggataaactggtgagggctgcattagacaggaacagtttccccataggctttcaaccacctatagcaactactgaacctctgaactatctcagatttgccctgtctttgaacttcagactctctgtaaggaaaaataataataatagcagcagcagcagcagaaaacctcaacaaatactgccattgtgaaatgtgccacatattcttaatacctgctgctgaaatctatctggcaaaatacaatacagcaccaccatcttgcatagactccaaagtgtagaaaattatcatcttaaaccaatctcctctgcttcagaaacattaaatatagaaagcattaaagaagtgagccgagttagaccttttgcaataaatggtgtcagcatggccatgaatgataacagcaaaaaaggcctccaagatatgaaaattaagagaaattagagccccagcttcacacttattattaatatccacatgcctgtgatgaagtgctcctctagctttagcagtccccctactctcagttggcaattgcatacattttaacattgcatgtgatgtttacccgtgaaaatttccaatcacaagttttgctgaagtcatctgaaagtccagctgctcacagtgatggcacaaaaaagatgatcatttgtgatatatgggtatttaagttttcactgtagaaatacgggagggataacaccaaggttagtgttgatgacttttcaaaagggaagaatagggagaccacgtttttagggtctgctggtagactttatgtagcaatctttttctgcttccagggacaatttgaaaatgtaaatcatgatacaaagcaagtgacataaatcagttgcattctagtccaagtgattatatgaggattgaaagagattatatcgggattaatctgggaaggttaaaaaaatcacattttgtcactgaggttgctggggataacctttaacaggataagaaagttcctttctattccaagttgttaaaaccttcatttttcttggttgttttagtttaaaatcatgaatggatatttggtggccatcaaaatgtttgtattattctggttttgcctgttaatgagatctattacattgatagatttttcaaatgttgaacttaccttgcattcctagaataaatccaatttggtgatttataaaataccagattaattttgcttttctaaaggaattataaatctttgtttataactgagcctggcctataattttttgattttaacttttaactgtccttgttttatttcagtattaagtatactagccttacgaattagttggaaagtgtgtcttccttttgtgttctctgaatgagttagttaaagattggtattcttttttctttttttttttttgagacagggtcttgctctgttgcccaggctggaatgcagtggctcgactgcagcctcgacctcctaggctcaatgatcctcctgagtagctggaactaccggcatgtgccaccatgcctggctaatttttaaattttttatagagacagagttttgccattctacccaggctggtctcaaactcctgggctcaagggatctgcctgccttagcttcccaaagcgctgggattacaggcatgagccaccacacccacccttggtattatttttcttaaatgtttggtagaacttgcctataaagcaattttgggtctgttgctttgatataaaattttaagctattggccaggcgcggtggcttatgcctgtaatcccagcactttgggaggctgaggcgggtagatcacgaggtcaggagtttgagaccagtctggccaatatggtgacatgccatctctactaaaaaaatacaaaattagctgggcatgcacctgtagtcccagctgctcgggagctgaggcaggagaatcgcttgaacccagaaggcagaggttgcagtgagccgagatcacgccactgcattccagcctgggtgacagagcgagactcggtctcaagaaaagaaaaaaaaaaatttaagctattaattcgagctttcaatttctttccaattcagttttgattagttattttttcctattgaaatttgtctgtatctccaaagttaaaaaattgtcataaaactattcctaatattcttatatttctttagtctctgttgcatctatagttataccttatttttaatactgtttttaggttgttctctttttttcttgatacatgttgccaaagattttccattttattcatcttttcaaacatttggctgtgttgatcttctctattgtatggttggttgctattttagttatttttattctttgtattatcccctctactttgtgtttattattttttgtttgtttatttgagacaggatctcactctgttacccaggctggagaatacagcggtgtaatcatggctcactacagctttgacctcccaggctcaagggaattatcccacctcagcttcccagttatctgggaccacaggcacgtgctactatgcctagctaattaattttttttttttttgtacagatggggtctcagtatgttgaccaggctggtctcaaactcctgggctcaagcatatcctcccgccttggcctcccaaagtgttaaaattacaagtgttagcaactgtacctggcctatttttttttcaatagaaattggatgcttacctcactgttactagttttttttcctaaaacaaagttttaaatttttcctttaagttctgctttagctgcgtcccacaagttttgatatattatgttttaattatcaattacttctaagtatttttaagttaattctgatttctttttgaagctgtaaaaatgatgtatgttttaaactttccagatatacaaaatttattttagttatttttggcactgatttctaacaatttagtgtggtcaaaaaaatacaataccactcttttgacatctgttgagatttgctttaaggcctagtatgggattaatttttgtaaatgttcccagtatatttgaaaagtatgattttctttatatgtcctacatattgagcttatagtagtatatatttacaatgttatggacttcacagttaggcctttacaaaaacttcctgaaagtgaagttaagtggcactgaagataagaaatacaaaccgttaggaaagaaatataaacaccagagagaagaggacaaggtgcacggagaatgagagaacaaaatcatggcataccaccctatgtttaaatgactgaaaaatgtgtaacacactgactcagcaaatgactcagtataaaatgtaaatcatgggtggaaatatacatatcttaataccatgaatgagaattccaaagctggccaacgaaagccactctgactgaatctgagtgatacctggtttaaaataaattaagatggtaatggtggtggagggcataaaaaatagaatgcagttgtctggtgggtcagcaggatgaattaagagaacaaaaggaagaagaaaatatgataatttatttttatctctttgaaaagtcactgtgttggtctttcatttataagcgctacttattacactcttccttggaaacttactgacaaagttcaaatatactttcttctttattttcttccccagtaaataaggctgttgtggctatttgttaaaggtgtgtgtgtgtgtgtgtgtgtgtgtgtgtgtgtgtgtgtgtaagagagagaggggagataggaatagagacagagacacagagaagaaacagaaagcgcaaaaactggaaactggagaggtaatgagaggcaattataaaagaggagatagaaatatgtagagaaggagagtcagagacacagagagaagaaacagaaagtacaaaaaccagacagtaattaccagatggaagaagctgcacatagataagaacttgaccatgcagggtgtattcactgatcaattgagtgagatgggtggtctgtaaagtgaggaccagattgggcactaacttgtttaagtttcccttgatgactattcagggtgctttgttaaacagaggagaaaacatagtctttaactaaccatctaacatcttggaactgaattcccaattccacactttggttacaattccagacactttaactgactaagtttggctgttctattggccagtatttaaaaatgattaacactctatgtttatatatatatggagaaaaagactgaaaggctatatgtaaatgttagcaatagttatatctaggtagtgacattatgaatgatttttatttccttttatatggttcttttatgtttccaagttttgtgcattgagcataaattcttttgtaaaatgaaaaaataaaacaaaaatttaaatgacaaaccgagacccaggaaaactgctactcccacctatatttctcttcctctgtgctttctcttagtcatataagaaggattttttttgccgaggcaggcagatcacctgaggtcaggagttcgagaccagcctggccaacatggtgaaaccctgtctctactaaaaatacaaaaattagctaggcatggtggcaggcacctgtaatcctagcactcaggaggctgaggcaggagaatagaatagcttggacctggtaggcagaggctgcactgagccgagattgcgccactgcactccagcctgggtgacaagagtgagactctgtctcaaaaaaaaaaaaaaaaaaaaaagaggaattcccccctcttcttctttcttctttgttccaatgctgtatttctttgtccccccatcaaatttctccctgcattttcttcactgctttcatttctgatgagaaggaaattggctggtcttcctaatcctgttgcctctcctagccagctgcatagaggaaagccctggagcatgaagacccccaactgcggccggagttgaaatgggtaattacatcagtctggctgggagcaggacacctgctatagacagccaaccatgttgctggcagggttcagggcttcagtgtgaatgagtcggcttcttggcattggtagactagaaagaaatgaagtcaaagccagaccacaaggaatcattttagtgtccatagctggagggagaaagatgacaatggtcagcgtggtaggccagtatatgtctgcagcaaaagtccgctttgatgtattacatttaagaaaagatccatttcactataaatctcgtactcatcatgtgatatagactgtaagtcaggaggcagtttccaaaagaggcagtgaaagggaaggtcattcaaaggtcatttaaagactgccaggaacacagcgttgggaaaaggagagttcctttatcctgggaatggaagtctactggagagtcaggatttcccattgcagacatcagggaaagcagcaaaaagcagaagtcaaatgattttaatagtctgcagggcaatgccattatttttgcccctggctcctacattgatttgtctgctagcctcattattttgagaaggaatgattactaatgaggatgcatttgatgatcaaattaattaatggcagagcaggataactaatgatgagatgaagcctctcatagttaaattttattagggcttctcttccccttcccagaagtgaattcagagatttattttcatgattcaaatttaataaaagctgcatctatgttactttcctttcgcaggttcttgctctgctaatgcaaagaccaaattaggggctatgacacagagtcagaaaataggcaatgggtttttgccagtaatattttagcaatctatctccaagcatatgaaggagggaacttcttgtcttctgctgtcttgatgactgcagttctgaagcactgctttcagggtacactctggaaagccatggtgtggggttatagagggaacacaggggctcagacaggcctaggctgcagttctgactctacatggtgtacctgtgccctgggtcagtcacctgacacctctaggtctcagtttcctacttgacacactgggacagtcacatacccctgagttgttgtgaggaccgcataaaataacatgaaggtgcttttgtgagttaactggagagactggccttcctgttgtaaggggcattggagtaaacagcacaggccaccctgtgtcaggaaattatgacctagacttgtcccgactaactctgtgagcctgagtcttcttttaagcctcaacatcttttcatattttcacctggaatatggcaatgacagttcacacttgtgagtagcttttcaaaatgtcctcacgtacatgatcacatgtgatgtatgattttatcgtagcaagcccttactgaggttggaggcacctggtctccaggagaagaactggaggtccagacatcctgagtttcccaaagaagtacagaaaacaaacagtgaagctgaagtcacattttccttctactagttcagtgttttcatttcattattcatgcccttaggtggcatcagtacggcttatcttcttcctcatcttatgacctctggtcagtgaagacggcaagatactcagtgggccatcctcactcaaaactgctaaaaaacatataaggaggcttcctctcatcttcatttttagtctttgtatcttgtccagaatcaaaaggaaaagtgctctgaaaagtcccaaacctcttacagatgtcatgtgtgatcctttcaaacaggtagggctttgtaatgtaaagccctgggccgagaattggagaattggtttctatttctggttccaaatggagccaaccgttccttcaagagtctcacactgaagtgagatacttaccttcttaggatgtaccaggagtgtaatctgcaaatgtcagaaaatgcacacactgccagcaggaaccctacaaatgaccttgaacagcctaaagaaaggtgccaaggaattatgaggattatcatcttgtggcctgttattataatgcaccatcccaatattcttggccgaggaatggataaaaaatgaaattacaaaccctggaatagttaaaggaagaccatggtggaccccaaatttggcaactcttgtgaaccttgatgtttaagtcactaaacctttttaaagccgtgtaatctgagagatgtacatgttttaagatttttctgattctagtaaaatgtcggtggcttttaatatgaatgtgggaaatgtcttctgcatttcccacagccatattctattctatcctattcagaaagaaagaaacttaatctgggttgtcgaagaatcagataaacatggggtatgtctttgcagccacagcttgtaaagactccaggtttttatatgtgtatgtctatttatacatacacatatttattttttgagctttttaaagctgaatatttgactacttgtacatgagagtctaagagaaaactcctttctctacactgttaataagattttcttgccctgtccagtgatactgaattattttctgcactaatgtataatctgtcatatattaaagatattaggatatcattcttcctgaatgagccaataaccagatcattgtgtatgggctattccttccttctaattgaacatttttgaggctcatgaactctacttagaaggtagatcctcctgatacattgcaacttaatttccaaactttctatctttagtttttttttacattctacatctaagtatttacatctttcataatggctcttaaaattagtaaagtttcaggatacaataactgtgtacaaaaatcagtagcacttctattcaccaacaacatccaggctgagagtgaaatcaagaatacaaccctacttacaatagccacgaagaagataaaatacctaggaatacagctaaccaaggaggcgaaagatctctacaaggagaactatgaaacactgctaaaacaaatcagagacaacacaaataaatggaaaaacacttcatgctcatgggttggaagaatcaatgtcataacaatgttcatactgccaaaggaatttacagattcaccactattcctatcaaattactaatgtcattctttacagaattaaggaaaactattataaaattcatatggaaccaaaaagagccccaaacaaccaaagcaactctaagccaaaagaacaaagccagaagcatcacactacctgacttcaaactatatactaaaaaaccacagcaaccaaaacagcatggtactggtacaaaaacagacacctagaccaatggaatacaacagaaaactgagaaacaaagatacacacttaacaaccatctaatatttgacaggactgacaaaaacaagcaatggggaaaggactctctgttcaataaatggttataggataactgactagccttagacagaagattgaagctggactcctaacctttcactgtctacaaaaattattaactcaaaaccggtcaaagatttaaatgcaagacctcaaactataaaaatcctagaagccaatctggaaattctcttctcgactttggcattggcaaagattttttggctgagtccccaaaagcaattgtaacaaaaccaaaaatagacaagtgggacctaattaaactaaagagcttctgcaaagaaaaagaaactatcaacagagtaaacagacaacctacacagagtgggagaagatattcacaaactatgcagctgacaaaggcctaatacccacaatctctagggaacttaaatcaacaagcaaaagccaaataaccccattaaaaaatggacaaggcacatgaacagatacttctcaaaagaagacacacaaatggtcaacaaacatatgaaaaaatgctcagcatcactaatcatcagagaaatacaaagcaaaaccacgaagagataccatctcacaccagtcagaatggttatcattaaaaaagtcaaaaacaacagatgctggtgaggatatggagaaaagggaacacttatacactgttggtaggaatataaattagtaaagccactgtggaaagcagtctggagatttctcaaagaacttaaaacagagctatcattcgacccagcaaggccattactgcgtgtatacgtaaaggcaaagaaatcattctaccaaaaagacacatgcactcacatgttcattgctatgctattcacaataggaaagacacagaagcaacctaggtgcccataaatgataaatttgataaggaagatgggatatacatatatatatatatatacacacacacataccacagaatacaactacaaccataaaaaagaatgaaatcatgtcctttgcagtaacagggatgtagttggaggccttaatcctaaacaagttaacatagtaacaggaaaccaaatactgcatcttctcaattataagtgggagctaaacactgagtacacatggacataaatatgggagcgacagacactgtgggctgctataggggagagagggagaagggcacggctgctggatactatgctcactacccaggtgatgggatctgtacgctaaacctcagcatcacgcaatattcccatgtaacaaatctgcacatgtaccctctgtatctaaaatagaagttgaggctgggtgcagcggctcccgcctgtaattccagtactttgggaggttgaggcgggcagatcacttgagatcgggagttcaagaccagcctggccaacatggtgaaaccccgtctctacaaaaaatacaaaaattaaccaggcgcagtgacacacgcctgtagtcccagctactcaggaggctgagacaagagaatcacctgaacctgggaggtggaggttgcagtgagctgagatcacaccactgtactccagcctgggcaacagagtgagactccatctcaaaaaaataaaaataaaagttgaaaaaaatttttaaaagctcttagaatacaatttatcattaccaaatgttgaatttttcttttaaaggggtttctctttttccatttttcttgtccttctatgcttgtgcattttcctttgaaagcggtttttaactggagaggaagaactgtttgttcttctgcatccctcactacttctgcacatccttcccatccctgtgtctggaacggactctactgttctgtgtcctgcacatgcatgggggcttaggcgtgccctgctctggaccattagtcctgccaccttctcttctagaacagggaaacagaaatagtgtggagagcaagttcactatctatctttgttccatatttcaacctcttcatgtcaccttttcctatttgtcttcctttctcactttcagaaactattttactttgtgcatctgcctcttcttgctgattcagctatcttcactccaaagtgtgccaccttaagttcccttgtccttcctcctagacattcatgaacctgcttgctgttcctcctttctctatatgtttccgggcagccagaacaatttgcaatactctccatgcttcccactgcaccacttccccctgccccaccccagccacatggtaaccaagaattcattcaaagactgggttaaaggtaaaggcccccgaaacaggctcctgttcaagatgtcagaggcaatgtatgtgtttgtattttcttcctccagagactcaattaaaatatctgtcaatgaataaacttacaaaaacaaggagaaaggaaagtgagttccaggagttcctagtgtatgacaggttctggcattcaagggatccccacatctccttaaaatgaagcctgcctgtcaaagagctcttggctggccactgcccaggagaaagactcggccacgcagcagatccagacacagcaatgagcaaagccacagagcttcacagaaaagcaaaccaagccctccacacctaaatatacacagactgccagccatcaccttgctcatgaagaaacctgtacataaaagagagagactgaaacacaatagctaaacaactaatcctggagtaaagagagatgattcaggaaccacaaagatcttaaaaatcctacttagtattcttaaaaagatttgagaagatactgcacccataaaatacgaataagattgcatgagaagataatgattagaggacaaaataacctcttgaaaataaaataatatgattaccaagcagaaacttcaattggaaggatcaaagataaagttaaaatggaagatactaggaaaaagatgatgggcatggagcgcccacctattaggtccattatctgactggtgggtatttcagatagaaattaaaaacagaagacaaaagtgaaaaatgatcaagaaaaaggaaagcctcctgtcacaaactctggtgacactctgtgctcctgcctgcagccctgcatttgctcagttctctggagcactaccttctgaagttggctgggagcatctggtctgctgcacttttgaggctttccacaatttttaagggacaaggtttaaaaaaaaaaaccctataaaatattagtgaatatgctcattttatctctttccctaaagctttctaatcattaaaagcaccaataatgctaccacagcctccttcaccaccatagccaccaacacagccatagccaccgttgccactatggccccttcaccaccatagtcatcatcctcaccataactacccttcatcaccacagccaacattaccatcacagtcaccatttctaccccagtcaccatcttcatcacagccacctttaacaccatcctcaccatggccatcaccacaaccacagccactagccccaacatggccaccttctccaccaaagtcaccatccttgccacagctgcctccatcaccacaaccaacattagcatcagagtcaccatccccaccacagccaccttcaccatcacagccaccaacacaaccacagccaccatcctcaccatggctgccttcattaccacagccactacagccattttcactaccatagccaccattctcaccacagccagcaacacaactgaggttaccacccccctcacagatgccttcatcactacagttgacattaccattagtcaccatcctctcactacagtcaccgtcactaccacagtcaccacagctacctttaccaccatagctaataaggccaccacagccagcacccccaccacggccatcttcaccaccatagttaccttcacaagcacagttaccttctccaccacagctaccttcatcaccacccccaccatagtcaccaaaacaaccacagctaccatcctcaccacaatcaccctcacctccagagccaatatcactactgcagtcacctttaccaccatggcaaccatcacctccacagtcccttcatctccagagccaccatcaccaccacccctaacattattatgatcttgattttgacatataacatcagacttaattacatgtgagttttggggaggaattgagtgcaagcttttctctttctctaaaaaaaacgtacttactaagcaactaaatagtttaaacaagattgcagaagacatgctgaacttacccaaggggtcagatgtaatcactatgtttaatttcaaaaatactttcatttattccttagcagatattccaaagtctgactcttacccaacatctgacaaaactaactggggttactttgtattttaggaaagtagtaatgttatatttcttcatcttccataaaattagtctaagtgggtgagattttaacaatgcatacacagaaaatcacacatatgttctactttgagtataaagaaaaaaatgcttgtcacttaatttctaaaatgcttttgatcataatcatcctacttttcccattttttttttcctgatcttcccttgctgaaagttgtcaagacagtggaccaggcctgcaccttactaatgtcaagctaagagtgtgagagagactgctccacatgggccactggcttgctggcctaagacagctggtcttcagactagatttaacactgttcaaaagcatcggcttatttaggaaggagccctttgacataatcatcattagtcatacgcacttttatgatcagcagtttttaatggtatcctgcagttatccaaatatttattagtcctgtcaatatgatttacacaaggcttcaaaaagaattctgatttttaagcggattattaaaaaattatgacatgttgacctatcctcatgaatgaaaataaaaatactgcaaatttgtgtgtaaataaaaccataatgagatatcactataaatttactacagtagtgaaaaaagacaaactgaccatgccagtgctgcctgatgaggatgcagaactggagtttgcagacagtcccgagggaatgcatgatggtacagacgcttgggaaaagagtttggcggtttctctgaaagtaaaacacacttgccatatgacccaacaatcacattcctaggatttactcaagtaaaatgaaaaattatgtctacacaaaaagcctgtaagtgaatgtttatagcagatttattcccatttgtcctaaactggaaactatccatccactaactattgactagacaaacaaaccacagctctttcttacggtggaatactgctcagcatcagaaggaatgaatgcctgatacgtacagcatcatggatcagtcttagattcattatgctaaagaaagaagcccaactcaacaggttgcctactgttcaattccccttatatgatattctggaaaaataaaagctataagggtagaaaacagagcagtggttgctgggagtggggctgactcaaaaggggcaagaggcagcgagtgctggaactgatttatatattgattgtggtagtggtggttacgtgactgtatgcatttgtcaaacttcatagaaggtatgtctaaaaagaatatatttcattgtatgtaaattttacctcaataaacctaacgaaagaattcagtgtggtaacctgaagaaaaataagagtttaaaatatgtatagtctttacttgtacacctaaaagtacaaatgaaagtcaaaagcctcactatccctgtggcagagacaggttaacttcactgccagtttaagatcaggtaaaggctaccgtgttaccatggatacaagctcttattctcttttgtatgaaacctttcatattattaaattgtgactcacatggtgcaggggtaaactcggaaacttccagacaaagtcacccaagagtttttccatgttaggaaccctgcccatagtgttttcttcatgaacacatgcaaaactgtgtgatgtcagtgaacatatccttaaggggttaaagaaagaaaggttagaaaatttttggctaaactgaaggcgattccaaaagctgtctgctagtcctaaggtcattaaggctctttctttttttgttgtttgttacagaaataatttcccaaacatagactggaaatggtgacatatgggaggctgacccctcctctctctgtcatctttcatgtgaaaccatgattttctgatttatacagtggatagtgtggagattgaaggcaggttttaaagtcaggctaattctttgtggtgggattcaaattagcaaattgtggtcatttattcatacaaggtagatcatgatagaaacaagactttaaaaagcacttatattttaaaactctgtaaaagatgttctgccacagagatagccatacaccgcctaacaaccagtaaacattaacatcatagcagccaccggggacccagtgctttctgtaggttaaagaggcacacctctcaggccttggctctcccgctccctgtcttgctcttcatgatccaggatcccacacagcccagagctcccataggcaccatgctaggcttgcctccaggtctttgtctattcattccctcatttgacacagatattttgactgtctactacgtgtctgttatggattgaattgtgccctgccccccagccccaaatccaaatgttgaagtcctagcccctactaccacagaatgtgaccttatctggaaataagtctttgcagatataagtaattaagatgaggtcatcctggagcagagtggacccctaatcctacatgaacagtgtatttataaaaagcagaaatttggacacacacacacggagaatgacaagggatgatgaaggcagagagcagggtgatgtttccacaagtcaaggaaggccaaagatttccagccaacctccagaatctgggagagaggcaggagtcagactcttccttacagcctcagaaggaaccacccctgcttttggaccctagatcttggacttgtagccttcagaactgtgagacaatacatttctgtctcaactacatttttagctatataaagtacatttcctactgacaaggagattctgaaaagttatgagaagctcccttaactgaatccctccatcaggaggatggctcaggtggtgatttggaacactgctcctttgtggaccaggcacgtggctcctcagtgcttctgcaaccctgactgagcagctcaccctcgcctcctctgacttcttttaggtttgaatttgcaataacctaaaagactttatacacttttaaagcaactgggataatcttttctagagggagaaagggagagttgtgtaaagtgtgacatagtggcttttgggctaggtctggcgtcatggtctttggggaaatcgacggcctctcatcttggcgagggtgccaacaaacacccaatgttggggcacatggacaaccccagaagtctcacacagcagctgttacatcgattttcaagtacagagacttgagcaataactgtaatgacattttcctggctggctctgacctctgaatctcactgattagtctaacacacactgtgaacatcaaccagttaggactctaagccaagactcaaaaattgctttaaaatggcagaagatgtttaagatataatttgtacgagttggttattaacttgttcacttcccaatccgtgattcttttttatactctccctctcaattatttttccctgttaggttgatgtatctgtagtagttacctctaatcactaagatacttctgtaggcaatccatgctctggatgttacagagcagtcaatatggatgggggaattaaaaaaaattgactctatatattttaactttccatcattctacttatatttcccttgtttaaataaaaacaatcttttttttttcagaaaatattgattggatttgtatattcagagggataatttaaaaatacccatgatgataatatatgctctgttattctaaggtaactcaaaggcccaaacaccttaagaatatcaggtaccaattgacgttttcagatacaaatctgactgtgaatctttgactctattccctcactgccaacagtcagattttcccctcctgtcgacattttatatcccacagtacctgttccttttccctactccaaagccctcaactttcatttcctttttaacaattgccataaatatacatctttaaattcagtatgccaggatgaggtctggcactcttcaacaaaaacacagctattgccctgtttctaaagttatttatcccccaaaactctgatgcttcatgtattccatcaacaaacacttcttaaacacgtaatgtgctcaaagaacctgactagatcctaagtgtaatacagaaaaagtggaaacaatataatttacatttacactaaccttgaagacagacaaacaaactgcttttgtaaaatcagttgtcgtgctttgaagttaaaagttctaagattacaaaatgcttgtatcatgcagggatctgctaggtatttgccatggggctatatttcacatgcagcctttcaatctcctaaatccaaatcattttcctttatttcctacctccagggtgatttcttcaacatattttattggcttggcttttctccagattctacccttccacaaacagtcattagcacttttctgtcctagtaacatagctttttggttgtcatttcttctccttcaccctttccagcacacggctgcctttccattttcatttaatacacatatctctttctctcaaaaaaaaaaaaaaaatctgggccaggtacctgctgcatgccttgcatggtttgctgcagaaactgcagttgctggtccttggtgaggttttcttctgttcggaaaagctgttctttttcttgtttcagcagctccacctcattcctgtaggcatccagctgccagcggagactgtcattctcctctttcagagcgtaggcctgggcagccagggctgagggacaaacagaacgagttcaggtgagctaccttcttgcttagcttgaggaggccttctgtgggaaagggagtctgtcacccaagttcttaatgtttgtaccagctcagaaataaaagcaaaatgccactccctgggcctctcttttgtagtcggtatgcatcacttctctcggaacttttatctattctgtttgtcctgtcttacatgtgaatgtttcttatgggcacaggattaattcctcccaaattctcatcccttgacctctccctcaatgctagacaccctcacagacattggtatgtggtgctaggtggtgacaacatttagaattccaggcaacaatcatatctactaaatattgtcttccccctttctacgggattgcttagctacttggagggctgcttgctttcaaataatcagcagttccacaggttgagacatgcggcagcatcccaggggagagaggaaattatatgcacaccactccttcctgctctactgctgggacaaattgcacagattgttttcctccaactcctatcagaatgggaagctagttccatctgtttcaccaacagattaaaactcttttcctctacaaggctgagtggttactctaatacctctccctgaaaccccaaattctccacatttagattcagacttcattcatatgtctatcttattaagaaaccaagacagttaactcagggtctcacacatctcaaggcttcagaaatagccgaaactgaaaaagaaacaaatggtaccaaacaaagattgagggtagggaaatccctttccctagtttctaccttattgcttaggggtctctccgaaaatcaacatagcctgctgagcactcataaagcactggatcaagagctttgtatgaactcactcacttcatacccccaccaagcctgtgatgccggtgctggtcttatgctcatctttacagatgagaaaaatgtggcacagagaagttatgtaactcatccaatcccacaaagtaagtagcagaaagccttcacacccaggctgcaggctccagagtctctgctctcgattaccatcggtccatgtgtttagttcttaccaggctgttcaaaaccagtctcacattcccccaccaactctcccaccactctccctttaatcttccccctcacagaaaagccattccccacttgtgtaagcaagagaaaagtgaaagaaaatttgaaacgcttgttaccagaaacttcaaacatgtaacttccagtagataagggcacggtgtggagcccactgcacaccaggtcgtcagtgcatgcgcgtttccagcccccgctccccgtgtcagaggaccaaatcaaggtcgcctcctgagtgttctacctgcacattacagttccatggtgataaagctttactgaggttctctgagaccacagtgaattctctcctcaaatatcaaatgtcaaattatgttaataatagttttatagttgagtgttttacagtactccatcttgcaaaatgataatctctgtgtagtacacactgaactactaatcagacagaacatgcaattacccagaaatttccctacctcaagccagtagggatcaattacttaacacgcatttacttcatatttactgtgctcaggtccgtgagggcatctcagaccacaaaaagaggagacagaatacatctcttctctcaaagagcttaatctagtagaaactgacacatttaaaaagaaactattgctttcaaaggaagaaaggatagtgtgatgtctggaatacagcagacactcaataaatgttggttgaatgaataaatgaataaataaatgagtcgagatgcatgacaaaaaaatgcatcctataggagttcagagaagagaaataaaaattcagactgaaggaataaaagagggctttggaagatgaaaaccccaagaacttggaaaggatgtctctcagtcagaagccagagcataagcaaaagcccagatatgaaaatcaaaggtagaacacttggggcaagaaggagagaaactcgaccaaaagccaagtgtttgcctggaagcagtgagagaaagggaatccacgtcaggtgatgggagaagatggggaaggttaggttcaatggagtggccaattgagaaccactgacagcgcttggagtagtggaaggacatgatgaaattgggatttaggaacattagtttggcaatggtgcatggaatgaactggaggctgaagagaatgaataaaggagatttcatttggtgtatgtgtgtgcaaaaccaaggagcagccacttttacagttttcagagacctactcataaaatcagaaattatccagcacataacccgcagcatgagccagtgctttttaacattgtgcagcccagcttcagatcttgtccacaccctgagataccacctcctgacagctccgtttaccaagccataaggaaatggttatgaggattcatttgtgagagggatgttgtaatagggcaaaatcacagaaaatgcaaatgatgaagaaagtgttggcactgcataggcacattactacatttagtagcattcaaagacacttaagtcatttccttaggaagctctatttggccctttttcaattcagagtggcatttttattatcataactgatagcaggtgtttgtgaagaaatcgattagtacgcagggatggaaattacattttccaaatgaattgcatagtctgcaagatatgctgaaatctgtatagcaaaatgcaagcagctataaagcatgtgccaacagcattatttaaataaattatctgaacataaatacatataggaaagtgtaccatccattattttaggggatctcttacaaacctatggaatggtactgctgagagttcttattcttggctaagccaagtgactacagtgcctgccaagcagtatataatattgtttgcattcccggaataggaatgtgatatcatcatattaaaaaaacccacaacagctgtaattcccccaccaaaaaaaaaaaaaaaatcaataccatagcaaattccatcaacatttttataattggggcacataactgatttacattcctgattaaatgatttcaagcttggtttttacaaaaaaattttcgttactcatgtggcagcaagtagttatcttctaaagggtgagaaattgtatattgactccacttagcttcaggccacctgtttgtaaacaccactcagtgtcatactgcagccctgaatctattcctcagacaaggctgcctggaagaggctatattatgtttcttgggccagagcgctaacagaaaaaaaatcctaataatttctgacttaatataacttctcagtatattaaaaattcagaaattggaaagggaaactttttatttctctctcttctctttctttctttctggaatactgtactaaattaaagagttttgaaaaaatgtgtcatcaagcttccataataaaatttaccttatgagactgcacaatgaatccactatccaaataagtataaggattaaaaaaaaaaaaagtacagtgtgcatctttcggtaggaattcctaaggagtgcaccgagtgccaataaatggaatatgtaagagacaccccatgtggattaccaatttccgataataaaaaaagaatagaattagacaccttaaatgtcaaccggactgaatgtgattaaatattttgttggtgattttaaaggcactgctgaatctagtggtgcctctggattaccatcaattaattcaccagccacccatttatgtatttattaagaaaacatggtgaggagctgtagcattcacaagaagcttaaggccagcacagtcacccatttctagttactcagtaatttagaaaaattctgaatactggaattttctgattggatcaaaaatgaaataataaaattggaaaaattttgctaggcaagattgttatacttcaaaacttagcactagactaaaaaatgaccaaagtgacactaatgtatgaaaatcaatccaaaggttgaacggcactgctgaagaaaaggcttaaaggtattgcggcatcttgttatattctttactagattctatataaaccattattctttatattaattatggtcaaagtgacctcctcttctgtctcctgtcttactgtgtttccatgggaacagataatgccatgcttaacttctttaagtaaataatctggagaaagccttgaaatctcttttaccagcctgagccagcctcagaaaaatagttagcaatatatgaaaaatgtaagttgttttgggttatgtcccagtaagctgacagtctgttaatatctttttcatgctcaggcaagatgtaactaaataataaaacattttaacatatcgtttctaacaatatctgtgtttctccagaactcttagtctttgtgtgtttggggaactctgtgtttaacattccccctccactttgccagatgtcctcctgaaatgctggaaggacgctgctgaactgtagatttccttcccacatgcaaagaaagtctttttcaagaatttcattggctgctacccaggaaggcagttgtaccgatagcccctgaacacaggagggcagaggcaggctggcctggcaaatgtcaccacaatatctgtgtgccttcaacggctgcctcctcagccacgatcctgcctcctgctccactaggaaagggagctgtagttatggcccagtgacagggactctctccagcttctatctgcttctctgcattctgaatcttcttgtgaggtgccttgaggcctttagaagctattctgtggcagagacattatcacgctgtgtactcaaactcatgcttctctttgtatagagcagtgttgctcctgagaggtgactgccctagagggtgccatgtgagcagtctcatcaatggagtgtgagggggagtgaggatgccttctgcacagtccctcagtctctgcctgctgctggaataggcttgggtctctgagtcaccacatggaggaaaggtgcccacaggcccagaatatctgccttggactgttgtgtgcccaaaaagtaacacttttttttttggttaggccatctttatacagcagctggtgttactctaacccagtgttctccaaacattggcctgcattacaagctcctggcgggcatattaaaacacacttttctgggccctaccctcagtttccagttcagtttgtctgggaggaagcccaagaattagcattcttccaagtcccccaggtggtgctgatgctgctggtgcagagaccacactttgagagccactgctcagaccgctgctcattctatcccgattcctaaactggggttgtggttggcttgtttggagaaatgcttctgaaagaaccacatgcttggcttgtcattctggttttattccttgatctccttttgtatgagccccgactccatgttctgcacctgggaaggcagccctgttgcatccctgtgcccaggtcccatgagctcagcttgccccgtgccctggctatctcctatggaagatttgggcaaaaggcacagtcactattctgctttcttcaaataacagtagcagtaatgggaatagcaacagtggtagtgacagctaatgatttttatgtgccaggcactgaggtaagcatattctttacacagtatcctttcaccatcatgaaaacatgatacagtcaatatgattattatttctattttccagatgatggaagtgagtttatgggagacagaggttgctggttggaggtaaaaggtgtggctctaggactatattcctccatgtaatgccaccaggctagcttagctccatgtaagtgccgcccatcccagagaaaggagtaaaccagggaccctactgtagtggctagtttgctcctaacagaagtaaaacattcaatttctggctctatctggggagtgttctgctggagagagactctgctatgaaagcagagaggatgatcctgttttaaaataaacatgcaggtattttctgcaggacaaacttggggatgatttatggagaagttaaactcactcttcaggaaatcttgaggcctggctggaaccacttagggatcctactttctgccctgtgtccctctcctctcaaacggccacactgatacccactaatcccagagctcaagagcctgagttgctaataatgctttattgagagagttttgtccatagacccatgctgatctcaggattcccaaagatccagtatgagactattcaccccatccatctgaactcacctatgtttgatttttaaggtgtctgtgccttcagttagaataaaggtgacagaaactcctctgcgttatgctgacctcccatgaactctgtcccctgagtctactttgcttgggctaatgaaggccaaagacaaggaccagtaccatgtcagaagattaacagaggcttggggtccttcatcattggtagcctcattctcagtggctgctgttgccatcagtgcctcccagtggccaggcacagagctggaaagtatcctaggatgacatctgccaacagccagtctcctgctggagagcctcttatggtaccaacaaagtacaattgatctgcttttcaataatacctgtatcaccactgatcaatcttcctcaaattgctcacggaaatttcttctgctacatttttgcaggattattattattacaacttagcattgacataacatttcatatgtgcagtgtgtattcgaatctgcacattagctattattagggaaagctaaacagaagcacaatgcagtgtctatttccatctttgtgtgaggccagcggaataagggtaatttcgggagtgcagggtaagctagatcctgttacgatgatggcttaaatgtgagtctggaggcacaatgggcagcaggtgactcaggaaaaaaaaattctctgctccttcctccagagagctcttcctgaggaagtactctgcaccagcagcagaactaggaggtgctgctgggctgctgccactatggagacttcacatcatgcctcatcacttttccatttacattactatcctctgctccgacccaaaaccatccccattttcctcagaggaaaataagcaaaggaaagagacatgttcacttcttgcaaaagcaggataagtctgtcatttaaaacactgttgaaggatgctctgtcaggtgaggatgcctttagagtcctccgggaaacacatcagaagtgaacgctgcaagcatgagctgagctccctactctaagccaagccggggacagggcagggaagcagagctctcagcccctgcccagcctggcctgcgcagctcccagcccagccgcaggaagagctacagatatggaacctggtagaaactggttagaagggctccaggaggggccatcctcacactgtgtagtgggagtcaaataagggagagaaggcttctggctggaacataagagctgggggaggctctttatggaaggcagtggttgagctcacacattgaaaagctgaaggaaagcagagtgggactgctgcacagtggacactgctttaccaaaagattcggcgatctccaggaggatgtgccatggctatggagaggcgagcaggctgcttcctactgagccccaaggccaggcaggagcatctcaggagggggcacttttccccactcttccttttcttttaattcgattttagttttctttttcactttcagtccctattttgatttccaagattatagggccatttaaaaaaaatcttctaaaggctttaaagattcttttttaggaaagtcaggcttagctaagccaagctagacaataaaatgacactggctttcaggaattgtaccccctcccctgcagacagtgcacctcccttgggtgtagtactccaccatgggcttggctctgtgtgacttcatcctaactgacagtagttggtcttggccaaagacagaaactttaaacagcaatccttccctccaaaacaactcctctcattttctcaccaatctacagtataaaagcagtgatctctttttcctcccatcttacaaatgtccttcctttttaacaagtggtcatttctaattttcatcaagaaactttccccttaagaagtgtatttcccctctcctgctctaccctctacatagaaacacacacacgcacacacacagttatattagtatttgaattggtgcttctaccatataaaacacatccacactatgaaatgtgaaatgatggccagctcaaacctaaagtatatcttctcagttctatgcattgctctttgcaaggagtagcatctttttttgtaaagtttttattttatagtgccaaatacttgcaataatgggttgaacagaaaactttttttgaaagttacttccgccttaggtaaaccctaactatccagactagtaagtgggcaccaagacttcacttttatgcttgggcaatgactctgcttgggctgtctctgagcctcctcctccccactgttctcattaccaacattgaaattgacttatgaacacttacttgtgtctggcaataggatagaaagtatctgcatcctctctaaatgtataaccaaggtgggaggacccagtatgaacaggtagctggcatcttgaggtatctgtaccactttggtatctcttaaatgagaaacctgggactcatcccagatgttacgaatctgagattctggaatggggcccagggatgtgcctttcagcaagtttctagggtgattctgatgcatgccaacattttagagccacctccctggcctttagggaccaggtccccacttcctaatgctttcttcatgactttcttctagtcttagatttctttcattagtttttcatatttgctttctttcagccttttccaacagctgaaaggaccttctctcctgcttttacaacccaacacagccttctgggcttctctgcctctgccatgtcttctcacattccattaacctatcggcctgctccttgctgaatgctacctcctgcctctccaggaatgacactgtgactgaatgcttgcgtaaatcctacaggcagtgtctccaaaacacattgtcctcaactgctcgatgttgttgtgcattacttttctttgcagccatatgtctggagaaagtttctgctatggcaggcttgtggcttgcacccaggagaggccaggctgaacctctggaactaattgcccttgaccgggccccgggaacagccttttcactgtgggagaggaggcccctcccatgtacacatgcttaccacaccagtctctagattcgcagaggcttttctccttggcgagtggccaggcatgcctgcttccctctctcactgctgacggatgagcaaacagttcctgtctattctcctagaggtagagaaaggcagagactctgtccttggcttgcatcaccactcatatcaggccaccctccacactttgccctcccttttcaagccgcccttttttccagtgaaccagaggatactccaaatgtgcccgacacagacctgtgaggggacttctccacctgggtctcacacgctccacttaaactacctccctctcacttctcctttctttgctcctttatcattgcctatgtcagtcacttcctgtccactacagatttttatactttactccatttttgttttcttctcattcccacattactttacctcacctcaacccgttttgtccttctttcccacctaataggtgggaaaagaggtaacctttctcacatcctcacaaaaaaagtttctgctttgttcattaaaatgatttgttttgcatttctggtgagtataatttttcaggtagcaatattttattcttaccagtgcctccttaaaaagcctttgcaagtgctgaggtgccagttaagcactatatgacagccatcatcctcacattacaggccagtggttttcaatcctttgtgcagcgaatcacctggggactgttttaataacaccgatgcctgggcattaacctgcggccattggtatgtgtataaagtttcccaggtgattctcatgtgcagacggggctgtgaaccacacattcacaccttctgctctacaccagcatcaactctccacattgccacagtgcctggtatttgcaaaatgccacagaatcccttaattgtttatttctcacagtcttattgaggaactctcaggatgagcctcatgtcattgctgagaaagctgaggcttggtgaagggatattatttgccaagccatgccagaaataaaaccaaggtacttcaagggccctctgacctcatctgctcaaagttactttttttttttttttttttccagagtctcgctgtcacccaggctggagtgcagtggtgtgaccttggctcgctgcaacctctgcctcccgggcttacacgattctcctgcctcagcctcccatctagctgggattacaggtgtgtgccaccacacctggctaatttttgtatttttagtagagacagggtttcactatgctggccaggctggtctggaactcttgacctcaaatgatccgcctacctcggcctcccaaagtgctgggattacaggtgtgagtcactgtacccaggctcaaagttacttctttactgtactcactgactctaaactccccctgccaacaacacttgttctcactcatagaggtccctttctcagagccattctaacactcttaccacccagatgagcctctcttccaaagagagtatcatagtgagcttggcagtgcttagtaaggcccgacagtggagaggaaacgcagaaggaagccaaggacttattttcggaattctcaatatttcagtgattcagatggcttcagttcacattcttcaactggacacatcatcacttctttttatccccagagttcgagtgccacaaaatcttgctttgacaaactcagcattagtcttggagtccttgggcagggaaaatgcatgtattttataaactgtctggatggataaattacagcaatttttccctgggaaagagttgttcagacatttaaaccctctatatattgagcatgataacctttctcacatccccacaaaaaaacagtttttgctttgttcattaaaatttgttttgcgtttctggtgagtatagtttttcaggtagcaatgttttattcttaccagagcctccttaaaaatcctctgcaactgggcgtggtggctcacgcctgtaatcccagcactttgggaggctgaggtgggcatatcatgaggtcaggagatcgagaccatcctggctaatacagtgagaccccgtctctactaaaaatacaaaaaattagccaggcgtggtggcacacacctgtagtcctagctgcttgggaggctgaggcaggagaatcgcttgaacccgggagaggttgcaatgagccgagatcacgccattgcactctaccctggtgacagagcgagattccatctcaaaaaaaaaaaaaaaaaaaaaaaaaaagcctctgccagtgctgaggtgccagttaagcactattaatcaaacactaaatgctttttaaacagctctacctttttttctaattgagaaacagagctgtttgggcaagtttatgaggtgaccttgattgaattaaagaggtcagcgatggaacagacttcaaacccatattcaatgatttttttaaaaatgacttccttccaattaagcagaaattagcataaaatattttgtttctgaaaggttaaaagaattcctctgagaaggcagctgtcttgttactagctttttattgaacatgagagggaagggactatgggtagtttcatctaaagtgctttgttaacatgacactgatgatccagcatcaattacaatattccttaggagcctaagtgttacgtagaagggtcaaaaagtccattttaaattttatttcctatttcaaagtccaagaacccaatgactttcaattactaagaaagaaagaaaagaaagaaagaaaaaagaaagagaaaattaaatcaacatatagtttatcatttgcaaaaattgcaacctagttctacagaaaaaagcttcagtcattacctctttaattcaatcaaggtcacctcataaacttgcccaaacagctctgtttctcaattagaaaaaaaggtagagctgtttaaaaagcatttactcatcttcctcttagccccatccttctgcttgccatagtcccccacattttaatgacctgaaagaacatcaccttcttcctaccaaaaagagtaacatacagagtgtctgatatataatgatggaagcagaattccacagaggggagggggcaccacacacaggtgatactttggggactactgggtgtgtctgaggcacagtcaccctgagagacacactcgacataacatagtgctctgcatcccacatatctacccctgccaacctcaaagagtcgagtggacgtggattatatagaggagagaggcacaggagtgctagagaaagagaaggggctctgaagccagataccagctatgaggcttagggcaagaaactaaacctccaagagacctcagggtccttatccaaaaaatgtagtcagtactgtgaggattaaataggtaatagggttttttttttttcttcaaaatgaaaaaaatatcccccaacagattaaaaattagttcttcctagttttaatttcctatccattcatttaacaaaatcttgcccccctaccatgtacaatgtagtgggctgggcattctttatgttcaagtttatgctctcacacttctttatgttagagtttatctactagtttttggctatgacttcggagggcacagtgggcagagactgtgaggacctgtgatctgacactattccaagaaaagccgaactgatgttatgctacgaggatttttcagaggagagaagcaaccctttcagatccaagtcagtgtctcagtctttcaagactttgttagctattctttccccttaatctggcactgtaaagaagacaaaggatatggtcccacacacattgtgagaatttactgaatatttgttgttttaattttatcactgctttgtattatgacattgtttaagacaattcgtggaggcaaaggattaagggtagagaaatggatggctttaggaggctcggtagataaactacactagaaaagtctagtattgcatgtggagacatttcataaacaactgactggtaaatcactacaagaaaaataaaatctctcatggtacttccaaaatatcttctaaatatatgttgtagattaagttgtgcctgaaaacttgtaatcacaaaaaaatcacaagtatcaaatataaacttgtatttattcagcagctcacctgatcattatttgggggtaccaaaattcatttttctcattaatttaggacattgggggaagggagaagacatattacttccaagatcagaatttccctgagtctgtgaatctcaagaagattgatattactgtagatgaggtccctcagactcttattttaaagctatattggaggcacatctcataaagaaaagcctcgggaatagagaaacagggagaggcacttcaataagtcttgaaattagatggtgagtcaataaactggtgatcctcaggtaggctctcccagaccctgggggtgcaaagaaaacatgggatgagatgggaaatcaaagggctgatattgtagctcagatcatttcagatcaaccatcaagcatgtgcctgaggtttgaggaacgtcttcatttttctctttatctttttggggacttatgaaatggaaaacatgggttgtgacagtgtgtatggttaccaaaggaaacacataacacagcagtgaacatccctatgcacttcacctcttcaaagcattttcttttcttctttttcttgtctaaagccatacagcagactctgctttcaggaaataaatgtcactcaattagcaaatgggtggtaccaatttccagaataatttttaagggtggcatttctgttgggatgggcttaaaaagagtttgctgggtgcgttgcctatattgaagcaaatctccttctaggtagtgggaaaatacagaaaatgacgggaagaccaagcagaagccccagtcggctttgtctggattaacattttaaggtaataagcatctccaggctacctttgcctctaaaaggcattatggcaccatgtacactgcaggcactcaaaatccttcgttgattttatttggttactgactcttatggtatcactgaaggcatttgaaagagattctggagtccttttcccataaaattcattggtgccataacagggtcattaacctgaaaaggagaaagctagtattgagctctaggctttccacttacgatcttgggtaaataacataacttctcatcattgccaatctctctgtgggtaagaactcaacatttctgcctggtttagaacttgaattatttcttggatccattatttaatatttataccaatatgattagctcttagaataagaaattataagattatgtggtctgggaaggtaagcatattatggtgagttaaatgtggaaattccctaatttaaagcaaaagaaggcaattcaataaactatcattatctgatactagttactattccttactattcttgactttccagaatgactgaaaatgtctagggagtattcctcaatcaacatggattttttcatagattctcctaggtaatttataaattaatatttattgtagttttaattatttaaataatacatgcatatattgacatttttgaaatgcacagaaaaaaaatcacttgtaattacaccatctggtgataatcagtctgaatattttgacctatatcctcacagattttcccctaacataaattgtgaatataacacatacacacacaattggaattatccatgctggtttgtaactgcttttatcacttcacaacatattgagaactttctttcattccattatatagtctaaaccatggtttctttcaagactgctcatggatatacattaattaatcaataccctagtgttcaatgtttagatgtttctaaattaattctgagaactgataatttaggtaactgctttgagctgcaatgaccagcatgccccaagtagaaagcaagggcctttgggacacagcagctctagaacttaaagggggctcattaaagaccctgcaatgccctgccggaaatgctacaattaatagactctgtcttgtaacttttgctccagaaatgttcttcctacttctctgctagtgatgggagtctaaaataaaattttctttctctagccacttcctagaaggcttcacacattgtgtcctggaactggggagaagagttgctgagctcttgctccctctttgatatcaagagcattcagtcaagtgaaagagaagggtctctaagccatttagatgtgggagagcttactataataataatttcctataaacttcaatttccagggcttctaagtatcatataatggcaagtagaatttccaagaaagggaaggaagtacttactttttaaattagttatgtggctcttaactacctacggttactagaattctacaagacatcatcctgtcttcattttctgtgttcatgcagtatccctagcatcttcaagtcttcgattaacgaagctcatgtgcaacagtgttaggagtcaaggtataatagctttatgtcacctactgtgttttgatgaacaatacagtataaaagcagaggagaattaggacaatgatgttcatcaacagcacatcactgtgctaagaggctggtaacagtgtatgttttaatgtggcctagtactgattcttttggccagtgtcctactttaacaatgttacagtcacacttcaagatttcagatggagaggtagagaagaaaatcaatagatactatttttccactaccaactggcctacatatatatagcttctctgccatactcacattcaagggacctaaaagatgcctttggaaggtctggcccagttaccatgcttttaataacctcaggaatctactctgaccacctcaaagattttagcttcatctctcaaaggtccacaggaaagagcctatgatccaggaagaatacaaacttatttgttctctattttctattccattaatatataaaaagaaaacttttaacaaaggcttgcttgttacacaaggactcttgtctgaaaccaaaatcatgtagaattttattcctgagccttaaaaaatacacggaaaaatacttatgtagttaactgtgcaaaagaaaaaaattagaagccaaaacattcttctgtaatgttataacacaattttgttttcttctttattcattattcttagttgttaggttttcaaaaatgaccaggtattatttttattcaaaaaacaactttcattttttaaaatgttacatgctgctagagcgcaatgaggtgacctactgaaagtgttttctatgagcatctgctagaatcacaggtgagcatttgacaaaattcatcgatgttgtaaagggtaatccgtttttcaaaatcagagattcctgagtattgcttataaatgaaaacggaaaatcaggaataaattctactgaagaattctctcctgtgtttaggaaagaacaacaacaataaaaagcttacaaagttgcccagattctgtcatctaaactccttcaaaaaatatcctgattttttctagaagttgtgcaaaccgcacttaaattccaacaacactgtgttaattttgctcaaacgcaagctgaaaacatattttaacatcctgtcagaatgagatactaagagtgtcgataaaatgacactaaaataaatgtaaatttggattgctgttacaagtggctgcttggctctgctaagacgttaggttgctatagtactttccatagcaactttgcatcttattacataaatattccctcagtgtccttcaagcctgctacagaaacaggattaaatccactctcctatgtaatgatcctgcatcaaaccttaccggaatgaaatgcccagaacacataataaactgtaatgtagataatggtgttcctggcagtcaataagcatcagggcactttgggctgcacacaggcggcggtgcagtgaccctgtactactccctggtcatgcgtcttaacctttcccaggtcaaggcgtcagtggctctccctttgtgaagattggttgctcatgtcctcattctcctcctctccctgccaactgcccatcagctcaagccctccaccaggctcaagggactcatagcactaagcaagaagccagggcctgacaggagctgggaacatgctgggctgtcatgcaggaaactttgtggagaccccacccaggtctaagctaggatcaaacaggtatggattgtttaagaacttcagctaggcctcagctgaatttcaccgaggtgtggcacagttgagtagttaagagtattagggaaagtccttggtcctgtagacaccaatgtcagcaacacagattaatcttacataaaataccagattatggaaagtttgtgcacatatgagagagatgtcaagaatcatggcattgataggtgctacataaaaataggattataaaggggctaagcttaaagacagtttaggctccaagtgtgaatttacaaaacaaacacagtctggttgggcagaaggagtgcttccattgaaatggaatcttctgctacaggatcaatttaaatagcatctgttttcctgcatttaaaaggtgaagcaatttacaaaaaaaaaaaaaattctacacttttcagaagcatatccattacggaaagggaattgtaactgcacatgaaattagggaacttaaaaatccacccaaaataaatatttatttgaattccttgggcaagattagcaagattaaaagaaaaaaaaaaaaaggaaagaaacaggaaagccttggctcctttgcaaatgaaactctgtttagagtttaggaagaaagcaggctactcagcccaccttgcaagatttcttttatcatctttaagccacattagttctgattcatcacatttccttgtttggcccccttgggttcccagaagagaaaatgcttgtctttaattcagtggtcagtgatggacacaccccactggtctatttctctttcaggagatggtgccctcggctgtcattacatgtgaaaacagcttatccttctatgcttccactcaacacagacacccctgcccttggggtctgctggcgcccggagctcagatcctggcatgtggcctcagactgagccatctcactttcagtgtctgaattctcttgtccctctgccaagttctgagccaatctcgggtgagcctgctttcagttacattcagtgcttcctaaaaggaagtttctaccagtgtgaatgacagagccccttgcagttggccccttcagtcagctgctgcaccctggtctggtatttagtaaccctctccttcttctgtgcctggctggtgatggggtaacagtgagcctcttcttaagcttgtgcctgattataatcttcctgatgggcatttttaaggatctttcagaagtactaccacccagaaaatacttaatcagaaaaaataggttgtcctgctattcaaagaaatcaatgggatggtcagagagccctattattattatttttattacttattttttttttaacataaatcttccagctacatatataactattcagataggctgatactgctagttccaaccaaacctaattatgagttcctaatttgatttagtggctgaaagatttggaaagtccttgtttgaattcttagtgaaattaaaaaaaaaaaattccgggccaggcgtggtggctcatgcctgtaatcccaacactttgggaggccgaggtgagcggctcactaagtcaggagatcgagaccatcctggctaacacggtgaaaccccgtctctactaaaaatacaaaaaattagccaggcgtggtggcgggtgcctgtagtcctagctactcgggaggctgaggcaggagaatggcgtgaacccgggaggcagagctcgcagtgagccaagatcatgccactgcactccagcctgggtgacagagcaagactccgtctcaaaaaaaaaaaaaattcctttgtacctatgttatggtgaattttcatgaaaaattgacagctcagaaaaacactcttcataatttagagtgtctgctcctataaggagctcagagtttaaatgaaatgcagttaaaatccaaaaacatttgtttgtgtattatggaaaggcataatgattgtctactgagcaagggactttttagttttactcttctaacatttgtgttcaaagtacactcatcaaatattgggtgaggtacatacactatgtagtgatgttcattttggtttataataaatttaatttaccagctttaggacatccctaatatttttaactgaaaacacttttttcaaatgagtcttacaccctagagaactgggtaccctgtatctaactaactctgtgtgccctgggtccacagcaccttggacatacaaaatgtagataatcaaaacagtgctgggttaaagctctctgggccatggcctgttcgccatgtgacactgaattttgtacgtataaagttctgaacattttgtttgaacatgcctctttaatacttgccatttcaatttaattagagcaaatgttctcagggttatcatcctcctatcaacttctgggacaaaggcatcgaaaacattaagatcagaagaaggggaatatgaattgaagtccacagacttttattgattacgtacttggggaaaggcccagggccacgtgttggaggatgactaagataacaagcagagttaacatttattgagtacttactagatgctcaacactgtaagtaaagtcagaagtgccttgcatgcattgacttattaactctcacaatactaaaacgtatcgggttttgccatctgaggccttacaatctaggacagccttcctctttcctttctcctttttatttcttgcgaacgctatcccgccccacagagtcaacctggagggagagagggaggaagggagtggaaaagggtaagggagaaggagagagggagagagagggagggaggaagagagagagaaagagaaaaaggaagaacagatctggattttaaagtctggcttcatttcagtaggaggcagactaaacaacaataaatttgaatttttatcaaaaattatcttcacaggcttcagagcaggatgccgatcttctagaatgaatgcttcaataaatctgtcattatttttgaatttattaacaaaattgattttcatttttatcagcatcttagttttgctccagtgaactccttttcccctttaagattcaactgatcaagaagagtgaacaccccacccagaattctattgtagatactgcagaattatagccaaagacatattgcaaattattatatatggtaaaaagaaaagtacaatgaaatattcttcataaccaaaaagcagagatatattgaaacattttgattattttttaaaaagtaaacccaaggtatcatataagtccttacacaataaattgtgcctttcctaaaaaccaaacaagtcaattatttccatctcttccctgccccccaaaataaaacccattacagggtactttttgtcttagtatggagatgacaagcaaagctggccctgggggaccacagacagagcgccctgcagtgggtgcagcctcagcacctcctcccggcacaggcaggtgacaactgaaggatattctcttctggaatttccaagaattcctgggtcagctactacccaggaggtctgaagcaaaatcccactgtttaagcagagaggaaattggcaggggattccttacagcatggagaatttcacttccattacagcactggcaattcccctgttagtgaattagagtgctacattttgagaggactgctcctatgtaggtgactggcagatgcaaatgtgtacctaaaaacaagggatgtgtcacccaagaagataccgctggaaggtgtttccctcgggctatggcctccatcctcctgcttcaagcaacagttagcagggatttgtctgaggtttgaacaaaagaccagatgggaattcttgctgtcaggctgtgtccccaaatatgcagggctgaaagaaaaacaactgcctgcctttgggccagatcttcagggccccgtggaataaaaaaggttagttgccttcctttccctttaatcagtcctgtgctttcttcagaaaccacatgccacattctctggtccatctcgttttgaaaagcacgaaaagactttgaactgctcggggcctggcatttgaactccggttctttcatctcttccctcagaacttggcatacaacatgccctgcactttgctcattaattctgctgaccaagtaacaagactggtgaaagttttttttaaaagttcaggctctacttcacgttctcatcagatgcctggggaataaaccgagagaggtgtcgggggatcacatctccgtcgatgcttctgcagcagaggccgggccccgatcctataagcatgtacgtgccgcaagacctcagtgagcatactattcagagtcatcattattctggtcctatcctaagcagactatgaaattatacacaattcttacttgggaaattgacaagttatttaaaaagaaacatcaccaagacaaaacaaaaagccacaggttcaaatgagaatttctgactgatgcagttcttttctcctacacctaccttgtcaggatattaagaatccaagtttcatgtcaacttgcctctcatccagaagcttcacaaaggatgaaagcgcttttgacaaaaaaaaagtttatttctttatttgaagatcttgttgaacttaagaaattcacacaaatccttgcccccttcttttgctatgtgaaggtttgtagaatagaaatcctgtgaggaaggtggtctcctcaaataaacaaacccaagagtaaagcagtcctgaggaatctgatctgggcttagcaggagacatacatcattgacacataagtgctgggttcatttttcagacaagggatatatggcttcagaaaatagtggcatggtgcctacttgtatgttaagcacctgaaagattaaaatgaatgaatttgagggtgaaagggaaagtttctaaggcagtggttctcaaactttggcatgcatcagaatttcctatagggcttaaatcacagattgctggacttcacttccccacaccctgtagccactagacgtttttgattcagcaggtcttgggtggggcctgctaacttacatttctaataagttcctagatgatgctggtgctactggactgagaaccacacttttgagaaccactgctttaaagaaattagagccctttctctatatgcctgtaggcaggagctttttcttatgaccatcactcgcacccctacattctcttctacagccctggagaaacagagcatcctgaccactttgcagtcttggtgacctgatccttttagaatcttgattttggtttcttaataaattagtaaagatcctcgattcctggtcacctgcaatctttctgttaaaaagtctctaacaggtgtatgttttattcacttatacacatgaggagacagatcaaatctataccatctctgtaattttcttttttgggaatgatggcaattatggttcttcctaggtccttcggacaacacccttccaatcagacaagcagtctcccttggtgtctcatgttttgaatgagcttttcccttgcctgtttttacaataccaatggatttatatataattcaatgagagcgttttaaatcagcagctcccattagacagagcacacaaagcaaggttctctctaagtttctcttctttgtacaacctaaggagtgacacccctagcttggtaccaaatggggccagccttttaattacagattaggtgaaagaacatttatgggaaaagaagtctaattctccagcatcttggctcagaagctagaaagcttcttcagggattaaacaattcccatgtaagaagtacactgactaaaaccaaattttatccatatttttagcatcagctgtggctgccgtactctggaaaaggattttcatggaaacaggcaaatatccctgaaaaaagcttaatggccccagatctacgtacggagaaacaactggagcaatttaaatcactctgttcccaagaaggagtttaaagttctattaataaaaagcagagtcactcaaagatgaaagtttagtataattcaaataaaagtgagttatagggccatttacttattccccatctgagatttggaagatcattatgatacctcatgggtctgtggcagttatcggcattacctgattcatcgactctcattttctttgtagggctgtcacagttctcatcatcagacatttccatttcttcttcgcggcggatgcccatgagctgctcactttgagcattccggagctcctgcaagtagaggatacacaaatgtcagagtcacagacacatatggctttccccaatggtctttgggtatatatgactggcatattaacattcagaatccaaagcttttatctcccaaatatagcctcacctaacctaaaggaggttctgaggggtgtggggtacaggggagactgaggtcaggcttagattaatccctgctcacccatgactagggctctttagcaaataatttaatctctcttgagtctcaatttcctcatttgtacaaagcggataataacatccacctaatagggctgcaaagattacatagaaatacctgttacatggctggcacatgtacagtaaggacttagaaattatggttaagaacatgaacagtggaattttaaaatggactgttctaccactgacccacacggtgtgacattaggaaggattcttcatctctattaacctaaattgctcactggaatattatgattaaaaatagttttgaggatgaaatgagttaatgaatgtacagtacttagcatcatgccagacacttggtttgctcagttgataatgctggacattattatttctcatgcaaacatagtgcccctgcatgtgtgtatgtgcccatgtgtgatcacatacacacacaggcacacacacacaccattcagatatccaaaattcaaaattagtaagatgttagggaacaaaacacaaacagatgccctttctttcgtattgcacacggtcatgttggggttactgtttttgttgcaatggttgctttagcatcacataatttagagccacagatcttaagatcacaccttactttctccatttattaggggagtgactacaatcaagttatttatttgagactttgtctagtcactcacaagtgaggaataataatacaaggctgtttacatgtagtagcatatgtgaaaactcattgtaaagattaaagaattacacaggaaatttcttactactgtgcctaaaatctgaacattgtaatacttatgctaagtatttatattattattttgtatcaagctgtatattacatatttgtgaattcttccttattcattctgttctcttacatgtactatcttcagaaatacttaaaacaggggaagcctccattattctttttccctctgtaaagtctctaaataaaaatcaaatagttaaaataatttcatgttatgatcaataaacatatgagtaataataaaactaaattactacaactgatttattaggggcatgacttgtgcccatttgatggacatgcatatatcactccatgttatgggttttctccattcttttctctccttagctcacagattttaactacagcatgatggagaggaaagtatttattgctaacagcatttgaatggtcaactctgtaccctgggaatcacccttgcagaagacagggaagggagaaagcagagagacaaggtccgaggtggggtgcaggggcaccaatcacaggcagccctgagaggccagagggaaggcagacaaggctcctaatttgattatgccacccagaataaacaggtgccaattccatcttaaataacaccatcaggcattggaggtgggtgtcacatgtgattagtgcggaaatttttaggctgtggacagctaatttttctactgacaaagagcccaattcccaaagaggtggcttaacacttgaaacaaggaaaagtcaggtggaaagaataaatgaggctgaaagggactgttgtttagtccctgcgattaatgacaaactgtcatatggtagttgttcttgtgggaaagggtggtggaaaagaaaaaaaaattgaggaaaaagagctgagggtgtttccacagggtgcctctggttcagcattaaatcactagtacactctaataaatctgtagaggtgttgcagataattaacagatgctgtacatgggaatgtgggaaaaaatcaagccaattatcaagcttatacgcaactgagaaatcatccacaatgttaaattaccaactggtatttaatcaattcagcgacatgcaagagaaaatcacagctaatttagaattctgtggcctaatgtatatcaaaagaggtggggaaagtagcaggaaggcaaaaagacccttcgcaggagcacctttgacagctgcactccatctgtccttctggagcatcatttctgtctcctagtaccaaacaaagcaagcaggctccttagacctgcatggaagccttcacacgtcctgctccccaccacacccacgcagaggaggcagggttaagcgaaggtgagaagttgaggcagacatggcaggaagtgtgattcagatcaatatgtgacatttgctgacactcacattctaatgatggcctttttatgctcaggtttattcggcagcaggccaccagcctttctctcaacattccttttaatcatgtttggtttttatgtgaaaaaataaataattcacagactgatcattcccaaatctgaatcatagtttatggactccaatttgtgttttcataaccctcagtttgtctactgcatcacaaacagaggactcttttttttttaatcttgaaaatcagccttgacctcagtcttaagtcagagtcagggagaacatcaggtaagcacccttcatttttctggcccctgaaaaattaaagagaaatcccacctcttccttactcataatcctgaacagaaaaacagaactgtatcagtcaccaaccaccgtaggcattagtgaacaaactaaaaaatgtccttcttaacaataaattgcactagcattttaagtgtcacattattgtgaagtcattcggtattcaccataataacagtgataataaagaattcatttggtattcatgtggatattacatctagtgctattggtattcaactgtaatttagcattagttaatgggcacttaaaatgctacccaaatgattgatatcatagtactttgtgattcctcaaactctatataaaatacttattttacaagtgtaagccaaaatcattaaataaataaaccttaccttccataagtttgggattttgaaagaggggaatgtcatttagagaactttaatattaacatgctagagatggagaggcatccaaatgaaaaacattctttcattaaaaaaaagaagcaaagacagtatacttacttttaaattacaggttcaaagcgtacactactctgtggagttaaaaataacagctggacgaccagtgactaatgacacattttggtccttctaagtggcaaggaggtcaaattctagactgttctcttgggggtagatactcacttcacacatgcatggttgctgatgggtggacccagttggcctagatattcactccccttacaacattggatctggagagaagtgtaataggacttaatggctagcatagggactaagatgttgcttatgataagaaaatatggacggaaaggcgtacttgtccaaagagcaaactgtcatcatcacgtagaacactaaaaaaaaaaaccctctgtatttaaaagccagttttctattgtaagctccatttttcttcaaaataatttgctagggaaagtgtcttggtttatttctgaaatctttactatgaatgggaaaaagtattttctcccattgcaggggagaaaaacactgtgttccctaagtgttaagtcagctgcttttctggacaaggaacaaatctcagctgcatttggagctgacagtgagatcagacaatggcaggcggactgcccactataacagaaaccatcatggctgcagccatgctattctctgccaatccagctgtgtgatggtggttaaaaagtaataataaaatcaccaacctcagaatgctttcgccaaatgtctatgttcttgcgctgggctttcgagaaatggtcccaagctttttgtctggtagaagcgttgaaaacggccacaatctgctcaactttggtgaacaaggaagtcaaacaagacaagtaatttatgttgtgatcactatagggaagcaaagcaaagacactaggagtctatggatgatgtcacaatagaaacaacatcatcaatatccatccaatttgtgcctttcgtacttacattttagcaaggttggggatgtctcccttcaagtctgtctccacaactttaggttaaaacaaattctaagtatgaccgggagaagggcaagggcatctacttccaagcattctttagctgttgtttcaatatgtgatttggtctatctatatacctagatctatagatatatagacactggtgttggcatccagatatacagacaaagtaatgcaagggttgggtgcagagaagtgaagtcagggagaagtggctgaacgaggaagagccaaacatatcattttctcttttggtctttatctcaaggactcaatcacagtcctctcaagacattatcatgtccaagttccaaattgggacaatgaatagccgtgccatgtctcccctcaatctcagggggccatttttcctccttggctcctttttcctccccctgttgcactgactgcagccagccctccagccctctggcagggaacaggaaccatagcctctacctcaagacagaccaaagctcacccaaccagtggcactggcatgcaggtcttatttcaaccaccatatggcaccctccatagctcctcatgatcacattccattatcactttcacaaggctccccgccctctggctcccagaccacttgaagttctaactctattatcttgacttaatttagtacttctgctgctttcaggcctggtgctactggactggtaaatgttgaggggttatgaacaaaactacatagacaaaggcatgggctcttagtagtgggtattatgggtggagccaactaactgtagacttaatcttgcttaaacagttattgatccagtaagcatgagattaaggaaattaaagcactaaattaatcatatgattaaacctgaacttctaaatttttagttaagaaggctcagttaaaattagcttctcaaggattctaacaccccatcaacataaatctttcataagtgattcccaaggctctattataaaaaaggacatcaaagctcttccaaatcttctggtgtccaaagaatgtcaaagagcaatagagtaatccccacagaagaacaacacttggtgccataatttttaaattagcacacaaaataaatgtatgatggagcagaaggaaaaaagcagattccattcacttacaatatcgtgaatacttttctatgctgatgaacaactacttctcaatctatggctgattttcacagagggcttttatctttttgctattaatatttttactattttccacttcaggagaatcccaaccccaaatctccttatttagcaaaacctgtcatcatgtcacatgatgaatttatttgactcaattttaacaggaggatttgccttcaatttgtctcatactctccttgggcacatgtggcttccctcctcgacctcaactggaagaactaaactccagactaaacacctggggctgctctaagtgctggccatcagctgaccactgatccttagtgctctggttggctgtcctgcagcacagctggcagaggagagaacctgttccagtggatcaccggggctttctgcatgttttgtctgtacacaggctgggatcattgggaatttcagctgccttctgtaggggcaacacagaacagtcagccccaaatctaggctggcaggggtggtgatcaagaggttattaaagagtaatgggcttcgttgcttataataacatagctctttggcatcatttagaagaggaagaactatgatgtcctgacaccagtcctaaggggaaaggacaatatgggttgagactgagtgtttggttggtaatagtgaaaattctgacatcaatcagagaaggctgttaataaaaatgaaacactaaagaaaagtatatctgttcataaaaacgtgtaaggggccagagagaatgaaggtaaggaagactagtaatgcacctggaggagtacagaaaagaaagaactaagaagaaggacccaatggcccaatagtgcacaggtttaggggtaaaaggagatcccctaatatctactcaagccatgtgctattagatatttcctgtttgtggctaagtgcctcggttacttagaacatgttattaccatatcccaaggcataagttcagttcattcattcattcaacaaacatctggattcctgttagctaccaggaacttgattaattgctagaaatatatgatcaaggcccagtcttgtctttgatgcaatcatagtctcggaagagaaagaaagacaagcagataattatcctgtgcaagagaggtgcagatgacagctttgaagacacagagaagagaagagagtagctaagtagataggtggcattagaaaacattccacaaatagggcaacatttctgccaagtcttaaatagtgaagcaatgcctgcttggcagagaaggcaggagtggcctgttcaaaggctggtatagagttgtgggaggatgagtgaaagtagctgtggggctggggctggggctagtgttaggtatgaatcaagagagaccatgtatgctaactctgattgggaactttatattgtaggattggcttgggagaaattacaaaggaatgaattaaggcagaggctctggcatggagtgtggcacaggcagtcatttgacagggagacttgataggaggaggcagctgacttgctacatgggaggaggaagaggggtgcgaggtaccacgatgactggagctggtaagtacatcccaaactatgagaacaagcatcggtggagggctgagaaagaagataaggaatttacttttggacgtattgagtttgagatgcctgaagaccatccaaatggagctgaaatatggattaggggttcagaaagaagtcagaattcaaagagatatggccaacattttctgggccattctccatttcttgtattctttttcaatagggtaattaattagatgtaaaactaagtgggatttaattttatacttatgaacttatacactttttttccctataccaatcaaaaagcaaaacaaaaacaaaacaaaataaaatcccacaaaaccccaataactgtgtaactcaggtttggaaaccactctcacagtattcacacggcccagttttacctctctcattgctgcacacactgtccctgaaccagccatttgtcttgcaaatgaaagttcctgggcacacacgaaaaaggactctggaggagtgctttcatcagcattaattcatcatcattagggaaaaagcacctctaagagtatgccctaatgaatgtcattcaaagacagcatacttttaagctcataaatcaggatgactactggtattgatgtaaatacactattcattgcttatagcaggaaacaccagagaggaagtccatgaattagatgaccactgactacctctctggtataattcatactacttactctatctatatacaataaaacctgttaagaagttactatcagaacaggctcttcaaaactttgcttctcagagaaagatataaccagcaaacaagatggcattggcatttgttcaaagcaagtagcttatagaagttgtgctgcaggcagaacaaattgagacctactccctacccaatgccttcaccacctcagtggtccacagagtggtggccagaggccccacacaatcctgtatcagataaaaagcatagattctgtttgattgccacttacttattcaagaaagtatactcaaaagttttgcaggtaaagggaattttttttctttgagggataacattttcccaaatcttctattagcaactgaaagagctctccatcagaaaatttaaatttacccctcacactttgcaaatctttcccccccaattctgtgttttaattgtttgcctaaattaggttatttgaggatcataagaaaattaaaaatgataaattcttcagaagtatgcctgaatgccagttttagatatcacagtagagcccctagtatacccagcagctgtaaatgaccttaagggcaggataaacagagccttgatgaagttgctaatcactccacagagctgcaaaccctcactagtggttattcattagcttacacatatgtatgtgtggagatacatacacgcacctagcatacacacattacacacatatatgtatatattcttccaattttaaacaaacccataagactaatttaacaactttttttgcacttttccccaccccaaaatgtttggacatttgctgagtttagagcacacttcttactgatagagaactttacagactatcatgagaagcgctggtcttcagccttctctgggagggaaagctcagaacagaatatccatttatccaggaacagaccacactgaagcaagctccctgggaaaaagcagccactgggtgcaaaagctcagatttctgggctgcacaagactcctgaatttcaagctctgggcaggaatgcatgggagatgaaagagaaaggttagagtcctctagagaacacgaacacagcccttttcccttcatgtcttgccgactgccttctttctcacaggccctgcacctcttgtattccttgttccagctaaatagcggtgaaagagccttaatccagttagtgtcccaaatatctggagaaactgatttagtccttaaaggcagtaggcttgcctaaataaagcacctcaaacaaatcttccaagcttagtttttgttttttaatgctatctgggctcatgttagagcctcaactctgcagggtacacaggacatttttctttttttaagggataacattttcccaaatcctctatgaatagcccatgagagattttcaaagggatatgacacaaatgaaataggtgacctctcccaccccagcttgtttttgttgttttaaaatactaatagctaggggagaagggacagaagaaaagtgtaaggctttagatgtagtgctggaattggtgagccttggctttagactgaagaattataatggagggaatgcagtaagcgattccagctctcaggatacccagaggagcaagacaaggtccaagggagaagcggtatgtgtcggacagcacataagaggaagctgctgctataaaagagattcccagacagactcctgcacattcactcgggttctgggtcctgagcatgaaggagctggcagtcagcctggcagaaagcccaggaaacagagaatgaatacggtcaaacccatactttaaggagggatggaccggaatttcaaatagaggaagaaaagggcattctggggttttgtcttgagatatgttaaaaaaagcctcacatgacattgtgagtccattacagcccacttaaaactgaggccaagacaccaacagcagacatcatattactgaacttcctggctagatgaggccagatatttgttgcttttagggcagcatccccaacgtttttggcaccaggaaatggttctgtggaagacagtttttccatggacagggggttggggatggtttggggatgaaactgttccatctcagatcatcattagttagattctcatagggagcatgcaacctagatcccttgcatgcacagttcacaatagggttcacgctcctgtaagaatctaatgccgctgctgatctaacaggaggcagagctcaggtggcaatgctcactcacctggtgctcacttcctgctgtgcggcccagttcctaacaggccatggacagtactggcccaggggctggggacctctgttttagggaatggaatttgaatagaataaagagaagcctactgatcacagtatataaaaaaacaggatgttttaagcaaatttcaagcaagcaagaaatgatcaaattgttcaaataaaacagaaagatattaggtatatagtgacttttaaagatttgcatcactccaagtatactccagggaattgtagagccctttattaatgcatatatttaaaaattttggaaagtaaagcaatacatgagattataaatctaatagttcctcaaaatatatagcatttattaagctttttaaatccaataaatctcctgcctagattacccctactgactaaatgaaagtaatgtatatacagaagaaaaaagggacgatataaaaaaaaaagtctaccttcccatcttgacaactctaccaagttctctttttaaaggtaaccagtaaccactattaacagatcctagcacatccatccagaaaataaggttatgcatatagtacaaacagtgtgtatttttctatgagaaaccttttttacttacacaaaggtgctaatattatatacgctattctgtaccttggttttttcacttaatatatcttggaaatctattcatatgtatgttatcaataaggctgctataaacatcttccaacatatcttctgaaatccttacataaatatctttataaaaaattcttagcagtagaaaggctagataaaagagcacctgaatttttaattttgaaaggtactggcaagttgcactctatgtccctgaagtgtttttcagtttgtttctcttaccctttgccaacagtgcataatcaaatttagcttttgccattcctgatagatgacagaaggcatgaattacatggtaaccaattgtctgcaccagtgatatgtatgtttgcagtttccattacaaataacagaaacaagtccagactcattgagcctgccctgtattcagttgttggctcgatgctaagtcatcacatagcagcaggaggagagacctggtttctggggatcttttcttctttgtgaccctcgaaacggcaaccctgatctcctctgagtctctactaactcccttagtggttatgaaaatcatataatggtaataggagatttctttctttttgagacggagtctcactgtcacccagcctgaagtgcagcggcatgatctcggctcactgcaacctcagcctctcgggttcaagtgattcttcagcctcagccttccgagtagctggtattacaggtgcgcaccaccacacccggctaatttttgtatttttagtagagacggggtttcaccccgttggccaggctggtctcgaactcctgacctcaagtgattcacccgcctcggcctcgcaaagtgctgggattacaggcatgagccaccgtgcccagccctgtgataggcaatttctaattacttagcccttactgggctaggcactatgcttgatgatttaaaacagtagttatcaaagtgtggcccctggaccagcatcatcaacatcacttgagaactcactagaaaggcaaacactcagactccagacctaccaaaggtgaaactctagggatggggcccaacagactctgctttaacaagctctctgcatgattccaaggcatgctaaagtttgagaacctctgattatcttacctaagttttgcaacgactgtctgaggtaggtgctagtatgaatgcccatttcattgatgaagaaactgaggttcactgagacgaatatttacttgtccaaggtcatatatttagcagtggtgaagttggcaatggaaattacatctgtccaacttcaaatcatgtatttatacccattatatgatgggccaaagtcttatgagctctgtggtgtgtaatgtgctagactttgtactacacactggggataaaaagggccaaatatgcagctggtccttgagctgctcagagtccctgggggagacaacatatatatgattgaatcgcaagatgagaattgcttaagagagctgcagagggtgccaagggaggccaagaaaggcttaaaggaccccttggctgaaacttgcagctaagttgaattttcaatgcaaacaagccaaacattggaggttatgatggagcaggaagctgcatttacctctctacaaaagtgtattgaggaacatgagccacagtgcagaagaatcaaagtgtctggaaaaaaagtccctactttttttgtgtctaccaggctggaaccaatttctctcagtgtgtgccctcagccttctcattttgtctaaaatccagtctgtcctactttttttgaaataaaagtcattgaataagcctcagcaggggaaacttacagaagtggggccaagggagtgtttttatgaatacaacactgttttgggggttgcatgtagacgggaagagagagttgggaaatctgtgttggtcaagtcttagctccatcgctaactagctgtgtgacctgaagaaagtgtccatctgtttgaatcccaaggcaaagggggctaggctagaccatcctgaatctcctttctggctctgggagcctttagaacagggcttagcaaactttataaggaaaggaacagatagcaattatttttggctttgcaggtcatacatctaccttgctatagaaggtgtctacacacataagtggtttctctccttaaatagaaatcctctcactttgtctgtggctactcttccatgattctccccaggtacaattttctttggttggaaaacaaacactaagttgtacttctctttcagttacgcagagtcaagaacacatcatctctgctttaaagtaactttactgacaccttacttttcctcaatttgaaagtgtcttggctttaaaaaatctttgtaaaaattttttttatgcatggattttgtccagtgtagctcagagactgtttcccagagtaccccaatgctatcaacacacattcccctcgcctgatgtggggcagtggctagagtccagtcctagacctgggctcatatcaaagtgacagagttttcatctttagctcccagaagttatacctttcctgatttgctgaatttcacttaatatgcactccaattctttattgttccagagtgtaagacttgatttctatcttacattttggtattattaaagatttttttaaaaaaacataatgatttgactcagtgtatatattttccacgagactgaaaggaaggataccaaaaaaaaaaaaaaagaaaagaaaaaaaagactcatttcagttctggcaggcatagtgtcctccaccatcacctttggcatcctgtgaaacagaacattctgtgctcatccttgatgctgaagtttttatacatattattttctctggatatttattccctgagaccaaagaggtatttttttaaatggaaataatgtttccagcacttaatgcattggcaaatacagccatcagtacaattttgaggagaaatagaaaacctgtcacattgctaaagcagttatggggaattttttcccatggatgaactacagcaatgactgctacagacatgggcaaacattttaacacttcataaaattcctttttgacagcaggggacatagaagccaaatttcccttggtggaaataaaaaatgtttggctgagatgttcctaagaagtaaatgatttcagaaagagcttttcaggcagaagaaatgtggacgaggacaccaatctgcctaaaagggggatcacagtacacagagatcagaaacccctcacatttcactctagcacttagcacacaacttgacacttgataaatatttgtggaatgaatttaatcattcagacacttgaggcttttacaattttacccaagaagatagatgagggcgtgacagtggagaactgtcagtgccctgcgcagctgtctttgacaataattctgaccaatcttcagcacctgcagaatgcaatgcacataacctcagggttgaaatgtggcttaaaattcacagtgtagcccaggaggagtaaccttcacagcaaggtataggcagaacatttgcacagagtaatatctgattgcctgttctatgatcactttaggagctttgaacctcatggttgggtcctggaagatacctgtatttagatatccagagacgataaaggatccacatggttgacataagaactgtggaatcttaagggtggaaaggaactttaagggattactggttaaacccttttattacagagatgagaaaaaggagactgaagttgcttaaaagactttcccaaagtcacaaggctaattagtggtcaaacttggattagaaccagatctctctgccttgtcaaaagtctttccaccatttgcagcttttaagacctaagatgaggctgatgccattacctatcacaaatgtataaagttgcatgacagttctaacctttccaatctccaggttgaaatgatattgataacggtactctaatactcctactgtaaaattctcaactaaagtatatgccgtatgctccactttaaagagaatggcatattagagctaagatcattgagatcacggtttactaaaaaacacttaggctgtgttctgcaatattaggttctagcccaattttcagcaccacgttcctttccacctgtgattggtcaacaaccaatattttttttcttaggtcttctatgtgcttacaagaattatgccaggtccagaagtggcacagtgaggtagaaaagagaacagtaagtggctcatgtctctatttagcctaaaatcttgctagagggaaaatcaagcaaacaaaccaataaacttgatgcacataaaataattagaaaataagtaagtcctcaagtagatagtattaacaagcgctgcagaaggtaggtgaaagggagatgattatgggttataatggataaacaaggtttcatggaggaaatgtgatagaagtggacttcaattttggcacttggaggaggggaaatagttcaggcaaaggaaacagcacaagcaaatgtgtggaggtaggaaagagggtagtgccagaagcaaatacttcattttttagccagatagcagcatttatactcagtgtgatgacagcacacctcttcaactctacctataagctgtacctttacatttataatattcttaattttcattttacacacacacacatacacacacacacacttagaaagcaaactgtacaaggagccaagagtcttggttctaaactgcccataaactactaaatgaccaaagcctctcacgtctgctctctgagactcagtttcctcctctgtaaaatgacagggtttggcccaaccctttaagatccctcttagctctaacattctataatttctgctttttatccatgctcattatatgtatggcacatattcttaaattaatgttaatcaacccttctgcactgctgctggctttcccatttgccttttctccagtttgttcccttctctcttaccaggaagcatgttgggaaagtagcaaaatggggatatcatggagtgtttaaatttttattagatatgtgtgtgttgtaattgttaaaaggcatgcaaaacttatcatcttggcatgcatattaataactgaatgtggtagtccatgcttcctgaactttataaacagctcctgtacgagctttgaaatgacaagctttgttcataactgagaaactgaaagtgggcaggcctatggggagtttctgtgaagtatgcatttttaaaaagcaaagataaaaactccaacgtctccgagttggaaaacctggggaagtttctggcaaatggacgggttaagaaatgacataaagatgagactaggatgctatcgggataaggtgacatgacaaagatgatttacctgttccgaatttttttttctctttcttctatatctaggaaatgaggtctatccagctggcccagaagggaggagaaagccccaggtgccacagcaggatagacgatgtcctcatctaacatttttcataactggacatccatggtcagaagagaaaaatcgccctacacagaagtgaatggatgccatactccccaaaattcaggttgggtttttttttttttttttttttttttttgagatggagtctcgctctgtcacccaggctggagtgcagtggcgccatctcggctcactgcaagctctgtctcccaggttcacgccattctcctgcctcagcctcccgagtatctgggactacaggcgcccgccactgcccccggctaattttttgtatttttagtagagacggggtttcaccgtgttagccaggatggtctcgatctcctgacctcgtgatccgcccgccttggcctcccaaagtgctgggattacaggcgtgagccaccgtgcccggcctcgggttgggtttaattacagccccctgacactttaagctaagactttgctaaaaacaatgactgtttgatatttaatagctggtcctggggtgaagaccagagatataaaaaaggttagaactttcataaatacgggcagaactaaacaccaacaaagctagagggtaactgatggactttgatggagacctttgaataaatcacaactttttctttatgttattatgaatgacttgtgacgtttttcaaacaacttttgttaagcactgaacttcaggaacggtggctggagagcaatctaggccaaacatttgagcctatggatcctttccaaatgaaagcaagaacaagtacacaagcacagaaaggagataggtgcatctaatccagctcatggatcacatctgaagtttcccttgtcctattcaaccaattggttatttccagccaaatccataaggggacccacatgcttttaccatgctttgaattctgcaatgtacctgatcttccctagaagctgcggagtgagccctccgtgtttggcttgtttgcggcctgctccactagttagccagtttgccaatacacctgcttccaaaccacctcacaacaatttcccaacatgcttggctgtttagtggacaggctaccatggaatgccatgaaggacggcattgacactggggagatctttcggcactgacactaaggagatcctttatgtggagagggagcagttggggctgctatggaataaccaggagatttccagccacctgggagaaggaaagctgaggtgcaattcctgaatactcatgcttaacaattctaatctcattctaagggaagaagccaaaatgtgattcctgtggtatttgccaggaatattaatgcagacaaatggggtgtgactggttctgcttttggaaaatgcagcaagtgtgtcagtcactgaggactttagcagttattgttttacaagcatccccaaagtcctgacatcaaacacatcttaccacactgaacagagctgtggaaagcaagaagtacagttgagacacaaacatagctccactagagagagggaaattcgggacaggaaaggagaggcatttggattaaaggatgaggagatgtgtatgtacctaccatgttagtcaggttactgctaatagtttcacagactgggttcctttttgcagccctttttgtaaaagcacatagaagagaatggaaagttctgaggttgctcaatgagatatgcaatcttctggttctgcctcacaggcttaattctagcccaggctcacatttaaggtatcccccatcttcgagtcatcctgaaagatcttggctgtcaaagactcacaggaaggctcctcagagtctccattgctgggatgtgtacaccgtggccagcactgtaggattttcacaatctcggttgatatctgccaactgctgaaatacttctcagaatcaaattacagggctaagggggactcccaaatagtaacaggcagatggtaaatacagaggttgttggatggttacaattggggatactacaacgtaaatttctgatgattctttcaccccaactctcctaatatttcctagcctctgaccaagaatttggtaaagtgtggcaatttccaataaaaagtacagctattgagctttttctctgatttgcttcattatgcatgcaagttgaaaccttgtttcctgcagatgatgctaatatcaatgccaaactactcaacgaggtcaccagaaatttctgaactcactgtttcagggttccctcctgcctgtcttctgatctactcattcattcactcactcatccaccaaatatttcttgcatatttctatgttataaggcttgatatatattgatgacttgatatatattgatgtctcttcctttgtgatgcctgctataataactaaaagcagacatatcatgaaatcactactcatttggataagtgttacaaaggaccttcataaagattcagtgggctgggcacagtggcttacacctgtaatcccagcactttgggaggccgaggcgggcagatcacgaggtcaggagatcgagaccatcctggctaacatggtgaaaccctgtctctactaaaaatacaaaaaatcagatgggcgtggtggcgggcgcctgtagtcccagctactcgggaggctgaggcaggagaatcatttgaacccggaggcagaggttgcagtgagccgagattgcaccactgtactccagcctgggtgacagagtgagactccatctcaaaaaaaaaaaagagagagatgcagtgatggcaaatctactagaagagggtggaccagaaaaacctctctgaagaggtggctcttgatccaagacctataggataagaagaagtcaagcacacagagtatgggaaagggcaccccaggcagaaggaacagaacgtataaagccgagtggtggaaggtggttttgatgggctcagggggaaaggggccagtggaaatgatgcatggtgagtctgaggataactgaagctaaagaagtgagcacagagagctctgtcagctagggacagtgaatattctctaaatgcaatggggagatactcaaacggtttactggggaagacatgacctgatttgtatcagatggaatgtgaaaataaatcaaactagagtagaagtagaaagggaagcactctgtatggcaaaaactgcaaaattcttcctagtagccattctccactcctgccttattatgagaactccaattttactctggagagcagcaggcccagtcaaaaattatatttctcgcattctttgtagttaggcatggccaggtataataattctgcctaatgaaacctacatggaagttggctggggatggatttttgggcaagtttgctttcttgctataatgacgcaactccttcctgtgtctttccttctcttttcttatgtgatttcagctggaaaaagaagatgtgatggcaggcgaagcagcagcaaccatcgtagacaactatccaggtaaagcgaatagcaccagagagacctcagacctggcagccttgaaccactggaccagtaccaacaaaccccacatctggattttactgtgtccagagagaaacatcttctacttgtttcagataccgtttggcagaattttctgttactcacatgtggatgccgtgtctaactgacacatcaagtaaccaaagcctgacttgggtggtggcggttacaatgaagaagggtgggccgaatcggggtatatttttgaaggaagaaacaatgggacttcttgatgacctagaagtcagttgtggtggtgggagatggcagatatataaaaagtacaagactttggcttgagaatttatgagaatgggaaggaaaaaccagaagaggagcaggtttgaagattaaaagcaaggattccacttttgatatttcaaagttgaggtgcctaagaggcagtctccactcctgtggtttccaggagacaggatcttgctggtcctgccccaccccttcattcactccttctcagggagtgatgagccagcctgcccagggggagtgcctgttctgctcacccactcccttgtttaggcatccaaagtgtagcctccaggtaatgtggctggggccttcagtgctgcctgaggctggatgctcaacacaacgtccaacattcagaagccaattattgctgtaaatctccacgtcattttccaatttggtggtaataccaaaaagtatttgtagtcccacatactacacttttctgtccctctctcagttgcttcaaatatgggccaacttacacctatataatgacaggtagacattttgcgttctttcagccacatcacaggggcattttaataggtgcctctttcaatagttactgccaaagaaaacgaagttctcacctattcatggctgccctcttatctttattgttagagccaagggttgagtcttccttgctcattaggactataaactgcatggaaattagaacttatttaaaattgatgccagtgagcaaaagataaaaacatacagtaatcatttcactgttcaggcatatgacttcttaccataactctgaagaaagtgtattattagaattgttttactatgctctctctcatttttctctaccagttcactcttaccttccctccatccactgatccattctcttcttccctcctttaaaaactgctgtaaatattgctttttaaaaattctatccctaataaccttagagtttctagacatacactcttaagtaaagggccattcctcaaggctggtgaatctaggtaatgtggtctggtatcagtctgtgtgaagacagaagtcttatttttcctattccttttctttaaagacagattggtcttatactggatatttgatcacttatcggaatttacatttgggaatttgttatatcatatgctacgctgctgtaaaacctgtctttgataaagtcatgtaagatacttttacatttaagatctcagttttgccctctcttccatcctatcctgacagatacattattccttgtgtttgcactgatgaaagaggtgataggcattttggcacactatatcacagaaaatagtacttatcttcagaatggaaatatacatcccatatgtcactaccacatagggccctgcacctggtatggaatggagcatggcattgttacagtgtcattcaatggcttttaccaagcaagagaacatcggcagctgtgatgcatgatgccactgtgacattaactacagacacagatagagtgcccataaaaaaaatatacgccctttttttgaatagagccctgggtaattaccctgactattgttctaagagaaagccccacttacaccccttcatcatttagactctggacataaaaaaaaaatcactggcattgagtagttaaggcaatttgctttccaaatgaagaaaggacaaaaaaatctctactcttgagttgcccattttgacagccacagctcccccagataaaagatcctgaggagtttttctgatagtacccttttcctacacagagcccaaggaaaatgtgttcaagtttgctttctactgtcagcactaggaggacataggggtctgtgcggacagcctgcaggtgaacggtggcggccctgcagctatgatatgaaccatggtgggtccagcaggcacagatgcatctagctgccctgccctggtggccaggcttgctgttctgaggaaaagctacagaaacgttgctcaccttgagaagtaaactctcagggcagggtccgtgttcctccaagttgccacagaacatgaaataggttatgaagtttgccattcaatatggagtaaaaatgggaaattattgaactacttacccccaaatgaaaaagtaaaattaataaaaaagaaaaggcaaaatcacaacaaaagagatggcccccaaaattttacttacattgagtgagaatcccagttaaggcatttttaaaattctccttggcttcctccatctcttgctcatgggtggctttttcattcattagccggcggacgtggctgttggccgactgcaccatggaatagaactggtttgcagagcgccgattcacttcccctcgttcaatccaggaaagcagcactgtgatagcctctgaaaacttgctatcatctggaaatggaaaaccaccaagtacaaatcatgccaagatgagaaaatacactttattcttgttcctctcaaaagacagagcatagtccaacctagtggatatattttcagaactcagcaagttagctttcctgagactgactgccatatcatcacttaacttctcttttcccatctaacttcagggcaccacagaaccactcaggaggttcacactctcatctaccaactccatgagctcagctgtaggagatttgttctgggcattcttaggaataaggtacagcctcattcttccaccaaaccttgatttctctttcttaagatggacttgaaaaactgttactaacctacttggcctccacttcatttctttgttcctttatcaaaaatattatacagtgttaccagttttctcatttatagaatcagctgagttagtattaaaatgtggaagaaagattggatttttttaaaagtgtttgtaatgtatggtattgtccctaaggcaggtagtaggaataagtcaattcttgttctactgtagttcaaaactaattccattttagggctaataccatatatttaattaggctgaaaaatagaatatttcctaattttccacaaaagagaacatgtttcctgaagtgttccgtgtttgctttagatggctatggagagcccatctgaacccagtttgagatgtatgtgcatggtgtggcggggggataggaagtgggaaatgaagttccgcctgaaaataagtgataaagtctatttcaaagaaaacagacttgcctatttggggatggttactggaacaaacccgtgttgtatggcttggaggtggagaaaaagaaagtttgtgggtgattaagttaattagaactggaagttgtatgtcagttgttagaacattaaccaatctgactactgctgaaggctcattgcctactttccaggcaaacctgaggggagaagcttttcattgtgttctgcaatccctagaaaatgtgctttagggaaaaataccctacatttttacaagtaaactaggtagactctgaattctaaaaatcaggagcaaaattagattgaaagattcagattctcacccattcatttaaaaaatactgagtgcctactgtgtgccaggtactgtcccctccactggaggggcatcggagacatccttatgttgtttgcatataaacatacatacactccacatgaatagacagggggagatgcatgcttgagaaaaagatttcgtttcactcaccagattttaaaatcaatcattgagttcttattagtattttacacatcatacgaaaccttcccaccgttgagtgctttgtaaatttatagggtgctttacaaacatctttagtatcttttctcccaaagacctcctcccagaccaggagtacagcttccttagcatggctgctgcttgcccaggaggtgtgtgtcctgaatgaaggtggggctgaacctaattcaaggtcctacggctgaactctggaaacctctgccttccccaggaaagaaagcagcttttagggatgtacccatgctcaggcaccattctaagtcctctcctgctgcacagcagccttctagatttggggatcaaaggttttttttctgagcaaacctgcccccctgccctcacactttaaccagaggagataactggcctgggaatgcccacaaaacaccctgtgaatgacagactcaagtttccttgaaaatctcaacccataggcacagaacacacttactgagtatcgtagccacttataccattttgttaactctggaatttcagtctaagttcaaccctcagtgaactccagctgcaatggtttcttatctcatttcatggaccgaagcagcttgtgtaagataaaatctatcacacaacttaacattacgttcagcccatggagaggcccataatttagcatgatgtttgtgagaggcccactgcaaccgttactggcagaataaattgtgcctccctccacactctctacctctcttcccaccaatatatgttaggagaatggacctcagaacagacagcagaaataaacctaatgcttagaagaaatctttttttttttcctctgaaaagataacaacagaaaaagagaacactgacttcatgtactatttttcccctttgctgtgagtttcatgtctacataacacagagaaagaaaaatccttaacatttttgttatgagctttgcagggacagagtgtaatgctgttcacctctttctgtcatatacaggtagtttttccttctcttgcttgtggtcgcttagttcataaatagactaactttactatcaggaaaaaaaacacttcaattttaaaaatgcatgtttgctcaaatgctctgaaagccacattttattgcccttcacacctagacctagagcacaataagttcaccagcagattatagtttcagaaagaggaaacaatattcttaggattaagccactgaaaatacacaatttcaaaagtaagtagccaagagattttctaacatgttaacaagtactaggaagcagaattccattagcctaaaagaggaatatagtttcaaagactcccaatttcatcttcatttctgaactttctgaaactgacaggccgatatatgattgatgtactgacattcaaattaaattaaaaaaacattagttaaggcatgcttgataactccagtcaatatttgttgccatgtaagaagtgactttaatttatattaattaagactaagtcagtaactccctctggatggctacaggaggatattgggagcggtcattttcaatactcaactgtaaattcaattttgtattcagtggaaagatcactgagaaagcagaaaacaatataaactaatttaaacaggatttagattgcagcattattaaagctattcatgtggaaagaaattaacactgcttgtaaaaatcacatcaaacatgcacttataaaaattccaaatactttctgtgaacatgctcaggcataactctgaactggatgcagtttagaagctagaatgtgcagatgtgctttttccactataagaattgagaacgattggtatatgatggagtgaatataaatcatttgctcattagaaattacccaccgttttctaatcaggtcctcacaatgttaatgcacctgagttaatggacaggtccattcacgggtcttgcctttttcccttccatccgtccgtccccgcttcctttgccagagccctctttgttaaacagcacggcgtgcctccctgcatctgctcatgctgtgcacttatccttgggtctctcccactcctggtccccctggtcagctgttattcttccctcaagattcagcgtaagtgccctttaataaagaaatctcttctgcaactctaggatgaattaggtgtctctttgctatgtttccacaattccccgcatatcctgctattaaagcattagtcgcactgtatggtaattgttggtttacagatctgtctccagttttgaggggctaatatgagaataaaatttccaaagacatatttctagacatatttctgtcttctggttactctgagtttttccctttgtattttatattttattgcattctacagtagttcctccttatccacagtttcaccttctgaggtttcagttaccctaggtctcagttaactgtggtcaactgcagaccgaaaatagtaaatgcaaaattgcagatacaagcaattcatacattttaaattgcacactgttctgaatagcataatgaaatgtcacgctgtctcactctgacctgaccgggatatgaatcatccctttgtccagggtatccacgttgtctacactacctccctgtgaatcacttggtagccacctgggttatcagatccactgtaatggtacagcagtgtttgtgttcaagaaacccttatttggcttaataatagccccaaaatgcaagagtagtgatgctggcaatttggaaatgccaaagaaaagccaccaagtgcttcctttacgtgaaaaggtaaaagttcttcacaataaagaaagaaattgtatgctgaggttgctaaaatctaggataagaacaatttatctatgaaattgtgaagaagtaaaaagaagcttgtgcatagtatatatagtgttcagtactatccatggtttcaggcatccactggggatcttggaatgtatcccccaaaggtaaggggagactactgtattcctaatagatttgtagcaattaatactggaaagatacaaatgtaatggttaaaagttaggaaacatcagagttgataataaacatttaaatttcatgtcaaagagtattttcacacatgccattatctacgagagatagatgttctcatgacaattaagctgaatgatcccgttatacttcaggcttcagaagtcattatcactggcaatgaaagttaagagtgatgtcagataatcccacagaagcaaggccctctgcagtgaggcactaaacagtttatcaaataactcaaaaatgtttttgaaagcatttttaattctgggaacgtaattgctctttagctttgtgaggagtaaataatattataatgatactatcagatgtcaccactggaatccacgcccatctcatttcatttctggttatttcagactttgttaacccccttccttctccctctcttccacatttattgagtacttggcacatagtaggcattacaaaactgcatatgggagaactctttgctatattctaagaccaggtgcaggagcagcctttgtgagcttgttaaaaacacagactcagcctttctcacacctccagaattggaatctgcattttactccaggtgatttgtacgcacatggaggtttgagaaacactgaagaaaggactcagtgaaggccaggtaaactggttaggagctgaccaaagtaagagataatgaaatcctgaagtggaaagtagcagctgagatactagagactttcaaaaggaatagatgtgattcttaagagctttgtgagtctctatccctgtccccacgaccaattaaatccctgtccccacagctgtcacttctatccaggaaataaaaagggttcaagacttggaaatgggcatagagattactatagaccctttctatggaatgctgggcatgaattacctaattctacagggggtgggaaactttaattctttggctaatctctgactaggctattttacaactttgtaggagtagaacataaattgtggcaaactgataacaatacaaataattcgtctctgtaacaatgcaaattaatttttgttcagtagaaaatgtaaatctttataaagcgaattctccttcgaaacagttttaacattttcttggtctccttattaattagtgagttaaataaaatcattggcacatgttcattttatatttgtaagacagtcatgatttcaccgccacagtattctttaacaaaagacagggcccatgctacagtcatatctgaaagtccagggcatggcacaaagcgatgggtacctggtgaattttaattaaactgatacatagataatgatggggaaaataaaccaaattggtaagtgttttttgtttttgtttttgagatggagttttgctcttgttgcccaggctggagtgcaatggcatgatctcggctcactgcaacctccacctcctgggttcaagtgattctcctgcctcagcctcctgagtagctgggattacgggcatgcgccaccaggcccggctaattttgtatttttagtagagatggggtttctccatgttggtcaggctggtctcgaactcctgacctcaggtgatccacccatctcggcctcccaaagggctaggattacaggcgtgagccactacgcccggctggtgtttttttcctcccgctttgtgtgcacagggagaagcagccctgaatttcagaacaatagataggataagagccaagccgggagcactgaatacgaaacttaggtgggctatagtatccttatttacagctgggtctataaaggaacaatgaggagacagggattttatgtttgaacggaacgagggaaaacaaggaaggcattctaaaatgcttttctttccaaagaaatggagggacacacacatgtgtacacacatacacacacaaggaaaggtatgtctgtagttatcactgatttctggctccaaagatagctggaaattgctcacagtgtacagtcacagagtcatctaagcagatttggaatttcagtatggtcaaagcattgctgctatcacaatccccaaatttctgtacatgtccctaaagaagtctccttttcctggctgctcaattaaccccgcatcaactaaccagatcacagacagcataaaaggctaaacaaagagttaatgttcccttctacccccaaaacacacatgcaatctccttaactatttagtagctgtaaaaatgagaaaattaagggggcaatatgaaaatgcactgattattcctgctttagggtcgagcaaaatatttctttttattttatttatttattttatttatttatttatttattttttattatactttaagttttagggtacatgtgcacattgtgcaggttagttacatatgtatacatgtgccatgctggtgcgctgcacccactaactcgtcatctagccttaggtatatctcccaatgctatccctcccccctccccccaccccaccacagtccccagagtgtgatattccccttcatgtgtccatgtgatctcattgttcaattcccacctatgagtgagaatatgcggtgtttgcttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccaagcaaaatatttctaaataaaacggcctatcttgcctctatgaaggtcaataacacataaggaaataatttgcaaacaggctcctatgtttcatatttcccttactctatgaaggaagcctggcttttagctaatgggacatccacttggctcataacattattgatttttactttcatggaaccataaatactgacaaccatctcagcaaaatgctggtaccacatctgccccttcctccctctggcaggctgacatgaggctattctatatgcaaataagagtccagttctctggaaattatgaatgttgatcccaggaggatggtattcttgttgacacatcaggaaatcccaaaggccctgcctgcaaggctttgtcaggacgtcacctaattcagagagaaactcttcatttcatcacaaaatgaaagattatgtgaagctttctaagggggtacaaagtacgtaaaaacttttaaatgctcttgccaagagaaatcccggtgaattagaatataatccttcctcactgtctaatcaatctcttcctcccacagtccaaacacagggttcctccaggggtggatggtctgtgttagacacactgaaattcattatctcatctgcctggttgccactgtttccaataaagtgtaattatggtgttattgagctccttcccactttctcaaagccatgctataaactttgggtttctgagcagttacttcccagtcggtcttcattaagttgaattgtctcggaacaatgtctgtttaaccagcaggatgcttactaattttcttttttagaatttgtattaatgtaacaggcactgggtgactccatgtctcaggcactacacaaatacaacacagtgttacctctggtttcagaaggtcaagtagccagtgaatgggataacctggtcccagaagatcctccctctctcactccagcactgcccatccgggctggctatctcccctgtgacagcactgtgcacttcccacatataacaggaggattattatatttattataatagtgcactattataagtggcaaacgcaaggtgatttgttattgcctgtgtcactcaagacacctaaactctttgaggcaggggcttgttcaccgttgtcctttccaccactggctaggacagcgccagtcatatggtaaaatgctgattaacgaatacttcttgagtgattggaaggatggctgagcacacatcacatcatttccatgtacatctggtcatgcccagtagaaccactggacagaaattcaacgtgctcatagatccaaatagcagaagaagagagaaaataattatttttactgagcacctactatgtgcacagttttagcattggacaggacatggagagggccttgtgggtcataagaaagacttggtttgtacagattttgctaaataaagctgattttcaaagagaaaattgtaagaataaacaagtatgatataaaatagaggaaaagtatctgtaataaatctaagtaagatttctcaggggaggaaaaaaatcaaatccaattaggtattttcagattgcatttccatttcctttctgacacagatttctttaccttaggtattgactgtattttatgtccccacatcaatgaaatcatcttcagggaaacagtgtcctcagctcctcctgtctggctttgcaacattataaggagcatggagtggatttcctctctaaggcagccaatttcctaagcaattaaatgctgtttatattccaaactctatgcttgggttgaaattgtcaagcttgatattacctgactcttgcctaagatgtatccccagctagttcattctactgtaacagccatctattaaaatttccaatctgttctttcctcaagggatcacacagtacttggcaaaggtacagcttctgaattctgtaaattatactcatctatataaatatatacttttgaaatggcaaggcttgcaaattactttaccaaattgacatcccaatctgttatcctctaaaaggagcggcaaatgccacatacttcatacgtgcggagacacttctgtactgggttcttaaaaacaacataactagatgatacgcttttatgaaattcctccaggaggtcacagatcaaggtgcagtttttgtcacttctaggtgtggacaaactgaatacagttagtctgtgtagatcataatctgataccacaatacattggatattaaagaaaaattattgttccagtgaatactccttgttgagaacattgctgctgtatctcattttggccactccttatggtttctaggctggagggaaaagtgagatgatatctgtatctgcactgcatatgccctttattaaaggcacagccatggcctatgtatttacatcagtaagacatgttttctcaaagcagcagacacaccacaagagcatcagcaagaagcattccttggttacggtgcgggtatttcagtggcagctgcagttgattaaggattctcaagccctggatgggggatgaagattggaagcacagcacccccgctgccacctttttttttttttttttaaagcatagaatgtcaacttcctatcttcctaaaataggtgttaggcagcttttcatacattttttttagtgaaaacatccaatccactttatacactgccagcaatacaccagctatgttctaaaacacttgaaggatcaatcacatccctcttctcatcagaaatctgttaatggcttctccactgtttatggaataaaacccaaatccagcaatagccttcagggctctgccatctggcccagactgccattccagctttacctcactctagaaaggcagcttctatgctgaattcctttctgcttctgtgggtttttattcttaggtctccagcctctaactagaatgcctttatgcctctttttatcctggggaaaaaaatcttatttattctgcaaatttcaaattatgcctcctctataaagactttcttgacactttcatcaacattatttgcactggcccctgagtccccaaagcatattgcatttaccttggttgacaatcatgccattgacttggtattacagttaattgtttatctgtagacacctacatgtggccaccaactgtgacttacattctctcatcaaatcctgacagtgctcagtgacctcaggagggtctgaccatcatttgcctgtaaaatgcccatatgttgctcagctcacacaactttggtcagtaatagaactgaattcacatgtcatcctaacttcaaaatctggcatcactgtagttcacgggggcaggtaccagagccttcctatgtctttatttcccacagcataaaacaccagggagggcctcagaaaacattagaagaaataaaacatactctcttctcttgctagtcatcctgtaaatgttgcatgtgtcccttcaactgcatctctgaagacagggatcccattctatgtttcttttctatcctcgatggaccctagtaccatgtctgctgttttgcctgaagaaggctttaggagtctggtaaacatgcacactctatagagctggaggaacactaagaacgccccaccaatggcacaaatagttgctggctcattaaacactgggtcagaagataatagcctgctttggggacctttctgtcccctcattcagtgagttttgttgagtgactgtacatacacttttatggagaacatgggtgagcattctggaaaggggcaggggtctgtcccaggcagaagatgaagcccaggtgtctgcagcttccaggagaccccccagctaaccccaccccagctctgtaaagagtctgtgcttacaccagactcttacagccttcttaaggcatagcagacattgtgctgaagggacaatggtggacgcaggagaaacgcacagggttccgtgtctggggatccctgtggaggaagaaaagccagcgtgggtggcccatacctttcagcttttcagccagcagagcggcttcgtgctccgagtagtgcattatggcaggcggggatgggggcctgagccggtcctcctccagcttgcgccggtgccgctcctcccgggcacgcatcctctgcttgcattcccactcatagaagtcatccctggcctgggcaaagtccacatgaaggcggcctgaatcctttttgtcggtgctagaccctaatcgcatcctataacctgaaaccaatggaaactctggtcacaccataatgtaacaatggccacagttttggtccagaccttcaaggcacgcttaggcaaatgctcacttatttcttggctgtcactacggatacatttcccataggaagcgggaaacaattatccttttccccagcaatcttgaagctctgtaaagttaggcctattacaggtttggggataaacacaccttggagagctgtctcagagggctgcttacccatcttccaaaccagtatccccaagagaagatgatctcaggaactagggtcttatcatgatcattccttcttctccctggcttctaggaagctcagaaacaaatttggcatggagcattttttttctctacctttttatggccttggttttattatattttcagcttactataattctactgtataggtgaaatatgagtaaataaagagcatctatgatatttaaaaagatctacaaagtgaattccagacacctcactcacaggttattgctacattcccccagaaaatgctgctgctcaattctctctcagcagctgcaaaagccacaattaccaaggcaattttgcaatgctgttttatttccacttatcctctggggtgcgcaggagaatattttaccttcgatcaagaggcctcgccgctgcctgcctcacagccctgcagcacctcatctggtatgcagcaccacacaaattgttcatgtaatattttaaggccacagcagccccgtgcaagagcccagagctagacaaagaaaaaaatgggcctggaaatctttgggggattcactgtgagctacccaacttagataaagattatgagcagaaatttgatctgagagatcaacactaacagaactgaaaccagtcagccggcctaacttcaaatgaagaagagttgactttgaggttgctcttcagtttggggtactcagattttcagaacataaatccaggtcccagcagagacacagctgctgggggctgccagaggagagagcaacataagcacttttccagtatgggggctttgcaaatgagatacaactgtaaaatgctaggctgcactgtgctgatgttcaagatctcatggtagatttcaatggattattttagcacttggggataaacctcagctgaaaatctctgtagaggctggctcctccccaggatgccacttcacacctttgaaaagttacaaataagatattgacttcacatctggtttctgtgatgccttggaacccttctcactgctagattttcaagtgttatctgaaaatgggaagacataacaataccaatcaaaaacaaaaacatctaatcacagatgtgcagaattaatgcaaaagcaaaatgtatcttggttgtgggccatgggaacttaacaagtcagcaggccacagtgatacacgcataacagctgagcaggcaggactgtttaaactggccagctatcccaactggccaagcacctttcccctgctcatgtccagagaagcagttttcaaacatttctggctccagaaacaccctcactttcacagaaacatcatcattaaggacttaaaagagaccctgatgaggctgagtctaaaattagctaggccttcaaacgtgaatgtggtcctaaaattagacaggccttccagctgggcttgggcttgggcttgctggagcccacaaacaggaggggccgcctgacttccttcctgcctttccagttaattggccttgcagatcttcctgggactgacgctgcagcctctcaagggcagggaggcagagttaggaggctcctctgcacccaggtagggaagctggaggtgaggcctagctgtcttctcctcctacagtaatggggcagaccaaggagcaatcagagacttgctgagagaagcgggaccagcacccaggctggaaaatcataggatcaaggtataatcaaggagcacctttcatatgcctaaatttgggactgttcatctttgtcagtgtcttatgaggcttctgattgggtgtgaacattgtgttgtattagtgttgaaaagggcctctgatttactctaaccttctcatttaatcaagtagggtaaagaatacagttgacctgtgagcatgggtttaatctgtgcaggtccacttataggtggatttttttccaaccaaatgtgtatccaaaacacagcattcgagggatgtgaaacccacatatttggagggctgacttttcatatacatgagggttctgcaggatatacatggggcgggggcggggggtcctggaaccaatcctccaagtgtactgagggatgactgcagttttcttggtacagctgtgattagaagccaggtccccaggatagggttcttgagatagaaaaatccgtccttctttatcatcatcaggatatttgtgttaaaaacaaccatttcctgaatggtttctatgttgcaggtgccctgctaagcacttaatatccattatttgatttattcctcctcacagtcctacgaggtcatgctgttactatctttattttatagatgagaaaatggaggcaggctctaggccgtgaaacccagtgccacaaactcaccagaacccccgttgtctaacagcggattgtgtgttatgaaatgtcttcattctaggctttgtcttccttctccattttgtattgcttttagtttttattttctactttgtaaggttttactgaaataaggggttttaaagttctccatatcactgtctaccttaggaaagtctctgcagtattggaataacctcaagtcttctggagtttgcacagaatttcgtggcaatagaggtggactgcagaaattaagtaaaacctggcaggaatgctcagataggtccccctgcccctccccacccccacccgctactgttttcccacattcccccatcagctttgcctcaggaatagggaggtgaaatgcagagggacagactgaaaaatggaggtggggagtgtgagggaagggcagtgagttcagtctgagaatgtgtccttccaaagccagcccctaattcttgggtttggcaaaggccttgcggacagactccattcacttggcccaatacccacagatgggaaggcagcactaggcctaatctcagtatctgtaaaaatcgcctataaaaattgacaccagaggacaaggcttaatgaaccaccaacgaggcaatgatactgggccttctcctagggcccctaagctactttcctgcaaggaactgaccttgctttggtaccttggtgtccagaaagtgaatccacttccaaaaacctgaaattattctgagagagtactttactcctcctaaggattacatccagtaagaataatggtccttagtactcataatattgcttctcatctaataagcacttgagaacattaattagaaactcgatggaattcctaaagactggatggtgggaaattgctcctgcagtgaagtaccttcacaggcttagcgcagagcttctggcagccaaggaagaaggcagaattcctccttttccagccccaaactatgaagactttattttgcatgaaggccaaagggaataagctcatattaacatcacaaaacataacaaaatgcctagaaaactccttatgtaatgcaaagtaccagaaaggtaaatggctttatcaaccatgaattcctctgcaaagcgaatgtgacaaaaattcttcttgcttttccgaattgctgtaatatcaccgcactgttcaaagacttcttgaataatttcctcagtagcattttctggtaatcctccgacaaacacggtcttacacccaggaggtcgttctcttgtggaaggaggtggaagatctaataatcacaacaaaacagaaagttttatctttcatttatttgctttctctggttctcctggcaaaactaaagcttgcagagtaactttctccagactgagtgacggtaaatttctatgccaacttaacattgatcccaggctgtcttgtttctaagttcctctcccctcctgctcccaacctttactttctgtgttcattgctacacagagtggctatatgcttgtccatgaacaaagataaagcaaatgtttgcataatttcatttctcctttatactacagaagcccagaaaagggagggaaaaaacttcccaaagtacaaaacatgacgaaatgacaacatgatgaaaaacctcagcgtgttatctgctttgtcttgtttccagataaaggagcggcaaaacagaatacgggaagcataacctacaaaagcacgcacaatacttacttggctgtgaaacaccgggcctgaaaaaaaccactttgttattattcacatttaaatgagcaaactattaaattttgggaaggctgtataaaaagatacaatgtacactctcacaatattttacctagtttatatgtagattactaaagcaatctcctgaaaagtccacttaaaaaaggcaacactgattaatatgaatgacaaaaaaaaaaaaaagtcctagctcttttagcccataaacttagtatctgaggcaaaattaaaaaaataaaattctggcccatttacttcatcaaatgtatgtttccttcaagcaaatacaatttggtccagaaactctgagatgcaggcttccctctccccagcccccaaattgctaactgtcaaattaattccattttccatctagcaaaacatatttcagagtttttcacccacatttgtgaagatggatggaaatgctcacatatttcacactgtgttctccggcaaacactaggcttcactgcatgcaaaaagtcttaacgctggatacacatccctaaatcccacatactggctttatagtgtggattcagcttctggacagacacgtggccacatccctgtatatttattgtaacctagagacaaaaggccttctgtagaacggatccccactctgtgcatttacgtgtgagtcacatctgaaaatgactgcaatgccattttaaaatttaaaaagaaaaacatttaaaatgagcaaatatttctcataggcgttacttacttggattttgaggaaaaagagtacagcttttgcagtggattatttctttgacaacagccacttctgttggtggtgggggaggtaccagtccaaggcctggtatcattgggttaatgggggtgattccagtcatcatgttgaggcttggatcaaagcctgggacacagattgagtctgtaaagtatacaagataacattttgactggagattaaatccatttttgttgttgtttttgccattttcctgtggattatttgactttatactttctatttttcaggaatttctcctggcataagatataatattatagaaagctatgccagaagggtaaagagaaaaaaagtaaaagatgaacattaaactacatgaaaaggaaattatattacttaaaatattaacatggcagaaagaacacagcatattaaaatgtaaaagcatgcaccatgaagcttcactattactgtgaatgcaattttctatttcttaacgttggtgtattgtttataccaccttatgacccagaatatgggaagaatatcatttaacattgaagtgctctgtgaatctaattgtcaacgtggtttcatcaaaagagccttcttacccaagtgacctagatttaggaaagttcaatttatatgtgcatactttataatgatgtattcaggtcccacctaacctatttcccctggaataaaaaaaaaaaaaaaagcaaaacaaagagtgattacaattactatggctgggttagatacatgcaggcataaaattagctatatacatttctggcttctattggataattgcactttcttcctataatttagtcaacaaagaattgacccacccttttgaaatctttatgccctgtattacacacacacacacacacacacacacacacacacttgaaaatagaaagtgtgcaaaacaaatgggttttccagctttttttttttttagtgtgataatgaagcaagtgatttcaaaggtggcatacagacactaataagtaagacctttctaacagcaggggctatgaaaatactatactgagtagccacaaggggatcccgttcatgagggtttccctgttggcagaaaagtctcatgggtggcgtgaaaatgttcccagatagacaggccaggatagatcatggtgccctcctctactctgcaaggatgaaacttccttcttgtctcataccatcctatcttcttctccctcctcatcttacatcacttccagtcttccttcctgcccgccacccctgcccccgacaacccctttgtacagttctcctgtacagcctgtgccttaggcctccgcatggcctcactcttcgcttacctgtgctgaaaggctggaggagcccagaagcagatgtaagaataaccacacgctttgtttactaagaagctccagagaatacagaaggtctagcaaaagcgtttcctttctgggaaaaggtttacagattccgccagctactttggacatttccactcctcctctgggctgaacagaataaacaatgtgattctgatctataaccccaagaggactgctgtcccatttattaaaaactccatttaatttcatagtgtatcagtgtgacttcagtaaaaggaggatttttttttaaaagaaaagaaccctaaatataaatgacaaataagcattttctttcaaagtagtcaccctgacattctaggtacttcctctacaattatggctctcagtttcttcatctgtaatatggtactgtttgactggattatctcttggagtgctagaattccaagactccaggattccatgctgatgttgctcagtacaaactgacacacaaaagacttaaagttttataagtgacagagatgactctgtttattctgtcaatcatcagaaagtttcacaagtatgatttccattttacagaaaagaaagtaaggcttaaagtacttaagtaaaacttctaacattccaaatcaaacagatggcagagtcagaatgagggcccaggtctttgcctcagtatttaaacatgtattaaatgtgactatttcaaagtttccatctagaatgacccaacatgattactcatctaatacatgccactacttcttaaaatgtactttacccttaaaaaaatcaagatgggtcctgccgatcaattctaaagaagttccagaacagaatggttttcaacatcatcatcattaaaataacatattggcctccaaggtgaatatattagaaaaagaaatattggcaatgggaatattggcatgcttgtgcttttatttaatctcattccgtacatcggcttcatctgtttttttcctggcctggccctcgctattatttgccaacacaggatgatttaaggctgaaaccactcaggactgcaaaccctgaaatgagagccctgtgaattataatcagcagatgtttcccacaaatgagaagagaagcccagtgcttgcattctctttagttgttaacagacttctgttttctttctgaaggctaagtaaataaatatatgtccagaaatggggacagaagataccactcttgtacaacgtattttaatatacagcaagagttgctttgcttttttctgagacatcagtatgaggagactatgaggtttaatgaaatctgcatggcaagtgcagtagcttgaaaagagcttagaaaggaattaacacgtaaattatgttggacctgaaaggattggagattcagtatttgagaggagaaagtaaggaaggattagactttaagaaaaaaaaagaacccattacttttttaacaatatatgtaaagatggaaattgttttctctaacagcacaggagcatatgatgtactcgctcattaaagcaaacgcacaaactgaaaatcgaggaagacacaaacacaggaagacaaaggggagaaggcagcgcaacccgaagaatcagttccatgccctgttaggaaaagctgcccctgtgagcttcagagataatgagttgtaattctactcagcgcaaagaggaggactgcttaaatcacagcaagaaagaatccaattacgtatacagtagaactttatcacaactgtactgaaatgacaggaaggaagggttattcatcacagaccgtggccctgtctggctcctctctgtgttgccggctccaagcagagactggccacagccaaggctcggcaaaggtttctttttggttgtctgttcccagttggacgagatgaaaacaaacaaaaaaaaatcctgtttactgattcacaggccagtgttttatcaattggatgagcatttttcagaaggcaggttggggctttgtgttcaggattttagaggcatggcagttgaattaattaaagcactcattcatttgaattaaagatccattcagcatttcctgggcacgtatgactgccaggatctggagttacagaggtaacagtagtaagttccccacttgagtttgaggagaggataaaggatgggaaccaaactcagcaaaagagtcgggacacatgagctgaggctcagaggacacagagagagtccaggaagggaattgctgggagagagcctggtaggcctggggaattccaaacaatttttcatggctctttcatggtgtgcatctggcagtgtggccacaatgtctggagagactgcaggaattagatcagatcagagagaccctgctgttcaagctagtgaatttcaactttgctctccctggaactcagagtcagagatgcaccctgccaggccagggctccggtgcctgggccgcccttcctcacttcttctctctttgtctgctgcccgctagccatgccttgctccttttctgccctttctagtcaatgcctcagttaagagtctcatatttgagatgagaactagatttcatttgaaagaaaggcagttgaggcctcttgccaggcaaggctgggcatactaactaggttaggtgtgggcagggaggagggacagagagaagttgtcagtactaggaacaagtctggtctggaaggaagaacatagcgttttaagaaaataataagagaaagaggcagtaatcaggctaaatggctgcattacaggtgtagtcctgggctgagggtgtcctgacaaagtggctgaacacagagattattagcgcagataaaacacaggtccaggtggggcagctgcccagaggactctgtctacaggtcacagggcctgcaccccctggtccagggttcagacccagcccaggggaaataaagtttgcaggaacatcatggagtcataagttgagaaatactaggccaattggcaggttacctaagccaggattcaggcaggagaagcaagacaggattcagacaacaaaatagaagcctggggtttggggaaggagatagacccctcagttatcagatacggagcacaggtcacagcctgaccagcataaagcctgcttggatgctgagtcttagaatgcagggctccagagcccccttcctcccgcctgacgccagatggaccctcaagtccagggacagagtaagtgtgtggggccaggtcccaggacttgtgcagggcacagagacaggctggaagggctctaacaaacatgcaattgtgctgcttctttttccagaattactgggttaaaattactgacctatcatcactctgcagagaagccacgtgatacctgaagacattctgtttaccagaagtttccagtggagaaactttttcagaagtctcctattgcaattgacaagtcttgttgttctataatgtcattgaatttgtaaactattaaagtaatgctctttttcattccatgttttcttttttcaagcattcttaaaaaactgttttgtgaacagcagaggaaaagtgaacattttaaaaaaggtgatcttaaagtcaagggatctggcacagctggatgacctaaggctgaccagctttttttttttgacatgagtgttgcactgtcatccaggctggagtacaatggcacaatctcagctcactgcaagctccgcctcctgggttcatgccattctcctgcctcagcctcctgagtagctgggactacaggcgcccgccaccatgcctggctaattttttttgtatttttagtagagacggggtttcaccgtgttagccaggatggtctcgatctcctgacctcgtgatctgcctgccttggcctcccaaagtgctgggattacaggcataagccactgcacctggccagctgactggctttttaacctctctgggcttcagtgtcttcaccaggggaaggagaacatgaatactagatagacatactggtcttcatggtcatccaagaagaacacctgggtgaaggcagtatatcaaagtgtggagacctcaagtctgcagtcatgcactggctgtatgactttgggaaatttaactaatcattctaagcctcatttataatatctgtaaaatgaagagaataatatttaccttttaatgttcttgtgaggattaaatgggattaataaaacaaaaccaaagtgttcagcataatgtccagcacatggtaaatactcaataaatggtagcaattacatacagcattaataaacattaatattatatagaatatttacataaccttatataaatatgttagtaacatagcagacacacaatcataatgatgattacaaagtctttcatttgacaaacatatgagtgcctactaggtgttgagtgttttgctaggtactctgcattcaaagacattgcaatgttcttccttcacagatgtggaaatctagtgactgaaacaacttagcagaaaataccaatacagtaatgacacttattttgagacatttaaataaaaggtgctatgaaaacactgaaaaggggacatctaaacccgtctggcatagggtttgtaagagttgacttgtgtccccccaaaagatatgttaattattattatacttttaacataagtcctaatcccccatacctatgaatgtgactttatttagaaatactgtgtttgcagatgtaatcaagataagattaggtcatactggattagggtaggcatgatctaatatgactgctgtccttataagatgaggagaaaagacacagacacacagggagaatgcaatatgatgactggagagatgcacctgcaagtcaaggatcacccaggatagccggcaaacaccagaagctaagagaaagacatgaaactgattcttccctggatccttcagtgagaacaaggccctgccaacagcttaatttcagacttttggcccccagaactgcaagacaatatgtttctgttattttaattcacccagtgtgtggtactttgatacagcagccctacctagaaaacaaatggggttgagggtggggggtggggtgggtgccaggggagtgtcagggaaggaatcctggagggggtgacagctgaccaggttcttgaaaaggatgacatctgtatatgcaatgggcatgtaaaaaggtatccccaaaatacacttattgggatcctaaatacaaagatatttctaaatgttctcttaggagaaatgttcaaaaccagtctcctggaagcagaatagctcttaggttttccctttgtgaaataaacaaactctgaagatggttacatatttgttaagaacaaattaaccacacagattatgttaacataacagaatactttacaaggtgagtgaatgcctacaaaccagatctttaagaaagtgaaactgaaaatgcttttgtaatctttccaaagagtttcaaaggcagtgaggtatgtttttcatttaaacctaagatgtgtatccagagtgagttcctggtgcctgccgtgcacactttataaacaaagacttcattccatcaataaaaccctctgtctcctttgaccaggatgcaacgctggcagaactgaggaatgcagctgtcaacagctattctaagtattgttgacttgggtgaggagatttgtgtccatgtttgaaaatatgacatgacacgaagcaaagagaatttcaaaactcctgaccaaagctggtacagagaaaaactgactgctcaaagaactccatcagatctttccagcaatctgtgcatggagcgtgcacttgaaaagcaagtgtgttttgagtgagcaggaggtaagcgctcatcacaggttctgtaaaattcactcacactgtgggccaggaactcaagggcagagcggtttctgtgcagaggactgggctgacacagtcagagcaagctgctccatgttttctggacctgctgaaacacactcttaagacacagtgggcctcacagctgagccatgaaaaccatgctggcatatgacaaccaggtgtggaggggttcattttgacaagcaggcaatggacactggccctaaccaaagattaggaaatttcaaagcagaaagcaacctgggcattacctagtcctaccatcttgatttagagatgagaaagtggatgcccagagaagtgaagtgatttgcccaaagttacacagctagttaagaggagagctggaattagaatcaagagtcctgctgcatcttcactgtgcacctgagttctctgtctctccagcatgccttcctttggatgcctctagtgacactgcactcactagctcctgacattgcccattcttttttttttaacagttttcaaagtgagaaatttatccctaatatgttgacttcggacttgataacctgtagttaaatccattgtctttattcagtactcctgggttcctgtaacaagtctgattctctttcccactgttcctggtcaaatccataaagaaagcacacaacaatacctgaaccttctcccagtcagcctcagcaccctcttccttcagtccttccatgaactaaaatccaccttttctgacatctaaaaattctaaaaacccaccttttctgaggtccagggttatccacagaaagagaccaggaagaagctgatcaacctattaatggtggtctctatctttcttagttctgaacttgtatgtataaattttagtaagttgttacgttacgattaaaaagtaatggtcatgtttactccttgctttgtgacaggcctgtgctgaaagcttcatgtcatctcatgtcatctttttggcagtcccatcacaaagttgacaaatgctaagtgacctcattctactaaaacacacacgtcttgtctgtctgcagaaggatactctcatgcaactttgaagttgacattttgaaactaaatgaaatttgcattttccgttcagttttccaaaatctgtcttcttagttctcctcctgtcttgaatttctcctcccttgtcctcaatagctataatggctagacaaccctctcttaaagttcctgttccttctaattcaccagcaaatttcttcttgcaggacagattcagccacagagggcaaggagatcctcctgttgccacatttggaaggtgaaccattagctgccttcctggcagatgcctactgggggtctggagcttggaggtgacacatggagcatgtcctcctccacttcctccctctgtccaggtagttgttgttttgctctcaccacagcattatttctgttctttcccctctctaccttcaccccttggtgtgcaccaggttccctgcaccctcaggtttgtgaactgtagcacgtgcttacagaaatatcttcttgggccgggcgcggtggctcatgcctgtaatcccagcactttgggaggctgaggcaggtggatcacgaagtccagagatcgagaccaacctggctaacacggtgaaaccccatctctgctaaaagtacaaaaaattagctgggagtggtggcgggcacctgtagtcccagctactcgggaggctgaggcaggagaatggcatgaacctgggaggcggagcttgtagtgagccgagatcgcgccactgcagtccagcctgggcaacacagcgagactccatctcaagaaaaaaaaaaaatcttcttaagcaaatcttcttagactccctccccaacactgatttcttctgaatcctctgttgtaaatttccagttttacgggccattgccaggtctcagggatgtacacagggttaccgtcaattccttaggctggaagctcatgtgtactaagttattttccctgctccctctcactcatttctccatcttgtctgaatgtactccacagcaaactgcttacaggattctgggcatctggcctactctactcctgttagacacttttgggttaagtaactttagggcttggttgtttcttttaatggcaccactcctctcagtcctggtttaaaacctctataggtaaccacatctagtgacctgccaaaccctttcagatggagccactttagaaaggatttctatatcattgtcttttttgttcccattgctaatttaggtcctcattcgctctcatctggagtactgcaaaggactctttttgtccccacaaactgtagcttctatatcccccctgtccccaccccctcctgcccttcctccctccgcctcctccctgcatgcccttctcacacccctggaactgggatcagccagcgatgcacacgggggaaccatgagaacaggccctaattggggcctctaaattacttctttcagacttcttttcacatccctatctcattagccgatgattaattttctttctgtacgatgttatgtgactttgtacagcaggactgttatataatgatagggagggagaaaaggactgaattggctcttggtgttctctgctttgtcctagctgacaagcttatggtgcgggagcagacagtaggggcaaaaaattattaaatattgagaaatatttttgaacattcagtcaagcccctaagaagtcgctaatttttatacatctacttctatctttctgaggagtggggacactccaaatatatgttgaaagactaaataaattataatttctttctggcattcaatgcctccttgctctatagaacttcctctttatttgaagtcaggtaatagcctggtgacaccatatagatataaagcccactatagtcagtatttataacagcagagatggtaattcacagcatgtaaatgtctttataggaaacttccctttgaaacctgcatctttctgaggcaatatgcaagtgttaaccttttgattttatttatcaaccttcatttctgtttacaaaggcatgtgagagataggtaacgtctcataaattttaaaaagaacaaagaaaaacattcaatatttagtttcaaagaaaacattcacatcatattaaacaatttatgtaggtttcaatttaaacttactgcttgaagggactgaaacaacacagaactggtctgtttaaataatatcagtatatagctgtagactgggagagacaaaaatagagcctgttttaaaggtaaacacatcatgaatattcctaaagagaactgcaaattgtgtgtggtctgtaaatcatagactgatctaatattaatttaatttttctactagactgtgtgggcaaggagaacgggtaacataactatcacttatctcagggtccaacatggctcttggcatatagtatcctcttcaacaagtatcagttaaatgaaagaaagaaattataaaatttacagaatttacagagttcatcctaaagagacaagacaaagtagtatttggttgttgagtccacaatgtcacaacataaattcatatatgattctaagcaaatgacatgtggtattctttctatttgtcttattaagtgaatagtaagagccatgagggttcttgttagttattcctttattatagttggaaaattatggtgatgatgacttacatttcacagataatgaggctaagaggcacaaggaatgaaggtgtgttcacagaataaatggacagaattggtctttgaatgcttgttaatatggcatctggaaggcagacctcatgcttcccttcctttctagctacaagaaaccagacctgaaatcaaaggataacacagaggggcagtagggtaagtatggtctcatctaaatccacacaaggtcatctcataccacttagcttgggagtgcttgaaaaattcaggacaggaacagggacaggagaggacatcataatcccatgcctcaggggaatactacaacctaacaggaacataactgaaaggcaagctaaccaaaacaagtttacaaaagaggcaaaaataaaatttcactcatctgctattaaaattttaaataggaagcataaaccatatgaaataaactcaatcttcacttctatattatggtgaattagtgaattaagggaaaaaggaaatacaggaactgtagattctgagtagagattagaaataaaaggaagaaataaagttgaagatgaaaagaaaggaagtaagtcagagggagagacagcagcagacagatggagggaccgtccgagttctagttcaagggtagactaacagaaactgtgcctcggttcttcatctgcaaaaaaaaaaggactaaaaagagtatttaccctgacagcattgttctgaggattagtgttacgaattaaaatatgtacaaggcttcaaagactacctggtacagagtaagcactcaacacatattactatcactttgataaacattatatcatttgtgtgtgtgagtgtatgcatgtgtatattagagtgtacatgtgctacaagactgctttcatgtccttcctttaaaaaaaaaaagcatatcctacttctcggtggctttttaagttcatgttttattatctgtcctaacttctttgggtggaaaccagaaggccttctaggaaaacaactgaggagacagtgccatacagtttctctacaaaagaaacttctccaagggaaatcagaaacctcctctttcttctcccccaggacctaagatatttttcatgcctggaaatgagagttgcagcattgggacctgtttcctctctgctttttctgccaggaagattaggtgttgtacccgacacaccaactgcacttgttcctatgtttggcatacccactttccccttaaactgagttttccctttgtaattctattttattcatccaaatgattatgtctattttgagcttttttacccacacacatacacatacacacacgtgtgcataaacacacacacacgtgtctttttaataaattaaaactgagcagcaccagacttttaaaaatacttcattacatccgaggccctggccagatttacttatttacatgttgttttgcattttaatttagaaagcaccaatgccaacccatactcccccatagcttgtcatttctgacaacatcctgagtaattccaggggcgaatttttcagagggaataatttaactaacaaattgccatttaaaactaatttatccttttgagctgagtgcaatatacttggaggagcattccttaatgacttgtttggataatgtttttctccacagtgttgatccctcaacattagaaactcagagagttaattcctcacatgaaaaacataccccaaacttttcttctggaaaggtcaagatcaaaagcagagactatcccccagatttttcattttctcccttcccttcccctcccttgccttcccttcccttctctcccctcccttcccctcccttcccctcctttcctttcctttctttcgcagagactatcccccagatttttcattttctttccttccttcctccctccctccctttctttccttccttccttccttcttaatctttcttttatcttttcttttctttttttttttttggaaacagggtctcattctgtcacccaggctggagtgcagcagctccatcacagctcattgcagcctcaacctcctgggctggagtgattttcctgcctcagcctcccaaatagctgggactacaggtgtgtgccaccacacctggctaatctgtatattttttgtagagatggggtttcaccatgttgcccaggttggtctcaaactcctgggctcaagtgatcctcccgcctcagcctcccaaatgttgggattacaggcatgagccactgtgcccagaaaggatttttcattttcaattaagtattttctgcccagttataacttcaaagaacgttaggtacttcattcaggggtctatatttcattcttattcacagaagcatctagttttgaattgttactatgcttttatgcagtgctatgttttcaaaatccttttttagtcatttaaaaagctggtcctcattatatctccaccagattcttcctcctccacagatgaaaaaggaagttgaggtttggcagactgaagacatctgcccacagtgtcactggaatcacagggaaataggctgtggtttacactatcctgctggggatgaaaatctacttgtttgtagtctccagggtggtaaagagcagagggggaaaagcaggatgcacagtattcagggtttagctgaatgtcaagttcagcttcctcatctcagatgtgaggctgcaacctgcctatttacttcacgttgttattatgagtgccaaactgtatgatggacgtttatgtgccagcaatttacaaacaagcaatcaatacacaaatgtaaattatagtcagcattttttcctattttggtggcttctgagactctacaatggtgctaagtgcccaccttgtccagaaagagaattcaatatattcagtgtattactgtgttttaacaagtatacagaagtgtgacaggtgagagggacagagggagaaaaagaacggggcggggggtgagtgagagagagagagatagtgtctatgtatgtgtctatcctcgatgcttgcaatccatggttctcagcagaactatgccattctccatgttagggtcagccagtttttatagttggaaaaactgagaagcagagtggcatactgccctaggtccttctgagatatttgctcattcaacatgtattaattacgtacaagtttgctaggcaagacgctgggggcatagaggtaagtcaggatccctggccctaaggtgcccccagtccgtggtgatgcagatacctgggcacatagctgtgttagaaagtggcagtgttattagcaaggcacacaaagtacctatatcatcatcctgaaaaaagcctgaccatactctgaatagtatgtggacttcctcagtgaaagtatctatctagctaagccactgtatccccaaagccaagcacagagcattttgtaaatacatacccaggtcagagagtggctaccccatgggccccagccacactttcaatagcagtcatttttcctgcatttatcaaaagacattttggaggcagaggattgtttggtgttgtattatttatctttatctatattattatttacctttctcctcttcctaacacaggaacattccagatcggtaggcctcttgcaagctgagtctataccaaaagtgcacacgttgtggaagactgaggttataaaggataaatctgtcacagagacagagtacaagggctggctaatctatatttgcttgttgtaactgaacagggaatttacatttgccagaatagcagaaaagaaatattagcttggacattcatgcccttattcaattatttttttttactataaccaaaacagatcttcatgttttttcaaatacatttggtcagtcagtcaaaagaatttgaaaagcatatcacaagtatttaacttccttctatcagagagtgatgggacagagacatgagggaagtgaatcatttcagcataaagcttttgttaaacagagctaagttaaactgaactaaaatagaataaattggatgtatgaagtgtgtattatgggaacttatcctgagacctcttctgttcagtgtcttttcttgatgtcttgaacaaagattgctataatacactcactaaatactcaccatcatcaagttacttgtgttgaaggcatgtcaggtgctaagaacacagaaaggttgaagacaagtgtttaggcttcacgcttcaagagggacaggaactttcagagtaaattaaagtgacaaaaaagtactttaagttattgaaaaccttgctaaaatgaaattaaagagctgaaactctacccagagttatatgactgacacagtcacagcagattataacagaaagtcatacatgtaagaggtaaatcctaattccacaggataatgtcagagaaatcaggtcctatgaagcatccctcacactgttccccttggccaccatctgtcaagaagtggtaccaggccagctcttgttattaccataagaagcagagagatatgagttgggaggatccaggtcagatggactcctaccaacctcttccaattgaaatccgggcacttctaccctggcctcacccctccacaccttgcttggctggcctgccttgcactggcctcacctgtgaccatgcactccagctacctcttggacagactttataccagcctgaccagaaggttttcttagctatgatgttcactgcccaatttttccttttgtccctgctatagtctgtattataaatttcatggttagaaatttaatgttgccaagcattaagaggtgaggcttttcaaaggtgactaggctatgagggaggttatgccctcatgaagggattaatgcttttaccatgggagtggattagttattgtaggattgggttagttattgtgagagcgggctcctgataaaaagataaggtcagtccccactctctctctgtctcacatgcttacttgcttttctgctttctaccatggaatgatgcaacaagaaggccctcaccagatggctgagcagatgctggcaccatgcccttggacttcccaatctctagaaccatgagccaaataaatctcttttctttataaattacccagtctgtggtactctgttatagcagcataaatgaactaagatactccccacctcacatttgtgattgttttggatcgttttcccacgaacaaaactcctagatatgatccttttttttcttgagtgaattaccctctgagtaaaaatctagcctttgggactccagatgaattgtggaagaaggtatgggaaaaggtagagtaattattttaaccaagtattataggcgccaggcaaggtgctaggcatttttgcataccttatttaattttatcttcagtacaacaaagcaagggaagttaagatatggagaaagtcaagtgtcagctagaagcagaagagtaggaactcacactcaggtcagttctattgcaaagctttttttgtctcaccagagctgtcaatgataaaaccctaaattggatggattatagggtctggccagaacacaggacaagatggatctttagctggtaaacaccagtatggccatatcactgttttaggccagcatctgttctgcttggtcagtgcccaagacctatcatttgttaaatatttaggcatcattgttgcccatctcaaaatgaaatgtttgccaaataccaaatgtttgacttttactctggcaaggagagagtaacagtgactggatatggtctcccacctgaaacaactaaaaagccagataaagtatatgaaacatggttttcagatactgggcatgaggtaatgcaagacaatgattcatgaaagaagtaaaacaaagtgagccatatgattgccccagcttattgccaggagagtttccgggctacagcacagggaagaggaactctggaaaagtctgacagtctctctgagtaaagaaatagttggtagtttaggatggcagcttagagttcatagggtaaagtaccagagagaagagaatagcacacatgtgtgcacacaaacacatctctccctggagatataaagcaagtcttgagttgagaactaatcagtgtatgtgtgtgataaaactacactaagctaaagaaagaaacacccaaaaggtttagaaggaataatccataaagattacaaaagactattctcatcagttagagtagaaaagcctcataattcatgatgttattgggtagaatactcagaatggtatcacctttgtagtaggacaaaactagccctagacaaaaagctgctgtgatctctcataacaaaacttaaaagcaagcctcaaaaggttcaactgcttcccagtaacttaaatgggtcctaaaataaacttcacggatatgagaatacaaaaatacccagcacctagcaaggtaaaattcacaatgtctggtaaccaattaaaaattaccaggtatgacaggataattccaaaacctctgaatatattattttacatgtcaaaggaattaaggatacagatgacattaagattgctaatcagctaactttatgacagattattctggattattgatgggggcacaatataatcacaagagtcctaaaaaggggaagagggaggcagaagagaaggttggagtaatttgatgtatgaagaattcaaccctccattaccagttttgaagatggaagacagcaatgagccaaaaaacataggcaacatctagaggatggaaaaggcaaaaaaacagattctcctctggagcctccagaaagaaatgcagccccgatgacatattgattttagcccagtgagatttgcatgagatttccaaccacagtactacaagataataaatttgtgttgtttttaagccactaagtttgtggctacctgttatagcaatagtaaaaaatgaataaaaagagaaattacataccaggcatacaaagaagcaggaaaatgtgaccaataataatgagaaaaataaaacagtagaacaaaaaaataaataacacatagatgacagaattcgtagacaaaaatattaaatattcataactgtgttccatgtgttcaagaaggcagaagggagatttaacatattaaatagagagatggaagattaaaaacagactcagaatgtacttgtagggatgagaagtacaatgtatgagataaaaaatatactgtatgaaattaacagcagatttgatgatttatttaaaaagttagtaaactcaaagaaaagcaatagaaactattcaaatgaaacgtggagaaaaaagacaacaacaaaatgaacagaacataaaagggctgtgggacaactgcaaggagtctaagatatttgtaattaaattacttgatgagggtggggcaagaacaaatatttgaacaaataatggctgaagattatccaaatttgatagaaactataagctcacagatctaagaaactcgagaatagaaggcacaagaaacatgataaaagtatatgagggaacatcataatgaagttacttaaaatcaatgataaagacaaactcttaagagcatccaggaaaaaaagacatattacatacagaggaactaagataaaaataagagtatatttcttgttggaaacaatgtaagccagaagacactagaatagcacctttaaagaactgaaattaaaaaaaaatcttttctttaactttttctttacccagtaaaaatacctttcaaaatgaaagtgacagaaaaactttttctgacataataagctgaaacaatccatcaccagcagatctatactataagaaatattaaaaaggaattcctctaggcagagaaaaatgatgagctgtaaatcttgatctacacaatggaataaagaatatcggaaatggcaaatatatggttgaatagaaaaaaaaaatttttacttatttttgaactctttaaaaaataattgcctgaaaagagcaaaaatactcacaatgtattctgggtttatgatatatatagaagtaaaatataagacagcaaacataatacaaaagtatatagttcttacaatatatatgaagagataagccaacaaaggagataaaattgaaatcataaagatactaagtccaaaaggtggcagacaaatagaaaattggaataaaaaacagaataaataaaatcaattattaagattgattttaacccaatcacactgataatcatattaaatataaacagtctaaataaatatccaaaggcagagatcaatccaatatatcagattggatataaaaactatatgctacttataagaaactcacttttaatacgaagtcataaataagttaaaaataaaaggactgaaaaaaatacaccatgctaacattaatgaaaagaaagctggaaagggggcatgctaatattaggaaaagtgaatttcagataaaaaatataattatggataaatgagtcatttcataatgataaagaggtcaatttaacaagaaaatataacaatcccaaatatttattcactgaataacagaacttcaacatatatgaaataaaaactaataaaatggaaagctgaagtagatgaatccacaattaacagtcagaaatttcaacaaccctctcttaataattgctagaacaagtacatagaaaatcagtaaggatataaaaatctaaataatatcaaccaatttgacctaactgacatctatggagtacttcacccaacaaaaccagaaaacacattcttctcaagattacatgggtatatttatcaagattggccatattctgggcataaaccaaaccttaataaaattacaaaaacacaaatcatataaagtgtattctgagaccacaatagtattaaattataaaatagtgatgaaaaatatctagagagtcaccaaataattagaaaataaataacacatttctgaatagcctgtaggtcaaacaagaaaccaaaagggaaatttagaagtactgtgaattaaaataaaatttcatgatatgcagctaaaacagtactttaaaaatgtttaaggcactaaatgcttatattagaaaagaagaaaggtcttacatcaatgaccatggcttctatcttataaaaaaaaaaaaccttaaaaaaaaaagagcaaattgagcctgaaataagcagaaaaaaaaattaagaacaggaattagtgacatagaaaaactatagagaaaatcaatgaaaccaaatgctagttctttgtgaagatcaatgaaattgataaaactccagccagccttaggcaggaaagcagagaagatacaaactgctaatattagacataaggaatgtaacataactacagttcccatacataaatatcaaggcatattacaaaaattgtatgtcaataaatttaacaacttggaatagatttcttgaaaaacacaaattaccaaagctcattgaaagaaaaacaaataatctatatagctctgtatctattaaagaagtagactttgtagttacaattattcccacaaggaaacttcatgcctagatgactttgctagagaatcctactctagtagaggttaaatcttaaggaaaaaataatactaattctacacaaactcttccagaaaattaaagggtataccttccaatttgctttatgattccagcattacttttgttacttaaatcagataaaaacattagaagaaagaaaaactatagacaatattcagcatgaactttgatgcaaattctaaacaaaattttagcaaattgaatatagtataatgaataatacatcatgactgagtagtttatcccagagatacaaggttggtttaacattaaaaagtaattcacgtaatttaccaaagtagtagactaaaaaagagaaacacacacacacgatcatctcaatagatgcagaaaaagcgtctgatgaaaatctgacatccattctctcagtaaactaaaaatcaaaggaaatttcctcagtaaaggttatgtactttaaaactacacatatgatcatacttaaaatggtatttcttcataaggtcagaaacaaggcaaggatatccactctatttctattcagccatcaggatatatgacaacatgcgtgactttcagaataactatattgagtgaaagaaaccagaaactgagtacattctataggtttcatttacataaaattctggaaaatgcaaaataatttgtagagacagaagatcagtggttgtctcaggatggggatgagtaagaaagggggtctgagtaggtaggaggaagagataacaaagggaacaggaaatgttttggtgtggctgatatgtccattattttgattgtgatgatttcacaagtatatacatatgtcaaaacttatgaaattgtagaatttaaatatgtacaatttattgtatgtcaattcattaaagctataaaatataacagatactttaggtcataggtaaaaacgaaaacactgccacagtgaaccaagctatatccagccaaggtcttggtttcaactagggaatgcatgataggagggcatggttgtcctccctggcagcaacttaaaagcatcagatatgcatatataaagctttttagtttcctaacaagagatacttaatagatctcaaattaaacaaacacagccagttatatgccaattctatagttttagaagtcagcaagcagcatattggggattatggatgaactgaacaaaatctagcataaaacatggtaccagacctcaaagggttttgaagactgtcgatgatttggtagagtgatgctaattctcactctcaacacaatccaagcgaggaaatttctccaaaataagataaaaacttgcagggttttaggtgtcattgtatatctgaatttactccacagaaattcttctcccaacttgttaaatttcaagacttctccttggagccatgagcagaataagaaaaacacagatggctcaacttcacggtaataatgattcaaggcaagcaaaccttcagctgtttatatttcagattaaaatagaattgaggagagaaacatcattctgggtgctaaaatgaatattaagataaagctagtgtaagtattattaatattgcactattattattttgggtttgcaatccataggaaatccatgtatgcttctgtttgcttcccttacaactggtattttaaataaattctgcatgctcaataaatagggtctatttactcaaaggcgacagaccccatggtactctccacaaagacttccctcatggcctcctgctgctgttgtttatagggctgcaattacagaaaggattctcagcagaacgagcaatgacaccattaccatcaacaggaattctcctggcactgtggagattctttattgaaagaaatacaaagccagtatgttgctagtagaatgcatgaatttgttgggcaatggctttctccttctggacaccaccctgcaggttaatgactctcaattctgagcatccttcttctctccttccagcaggtgttttcacacctttctaagttaagtgtcccagaatgtaaaggctgccactacagggaggcagcaggacacaatgcatgagactgatcggcagtgaagccggactgcctgtgttcacatcccggctgcaccactcactaacagtgtgacttcaaacagattacttagcttctctgtgccctggtgtgcttattcctaaaaatgaagtaataacagcactgatttcactgggtgaggattagataaggactgagatgcttagaaaaatgcctggcacatacacaataaatgcaagcaattattattattaacacagctttgttgacacaataacatttgtagagaatgaatgacagcagctactctaagctgcctccttatggcaagcacagtaggaacaagaaatagaaatacttcctctaacaatgcagcaaaatcttctgggagagagaaccatacaagaccagcctattaaataacaataattatattaataccacccattactgagtaccttctacacactgcagtgtgtaaaatgcatctatatattatcttattcattcccataaccccatgaattagatgatataacttccattttccagataacaaaactgggactcagagaaattaaataatttccctcagttcacgtggctgagacaaacatttctgaatagaactacctggctcttagccaggtttttccgctatgccatgcaccttttcaacccaaaaggtagtggtgtgttctgagcaaaggcattcaggagaaaacaaacctgtcaggaggcagagtttccaacagcacactgtctttgaaactattaaaagaatagtcttaagtgctgctgggtgaaacaattaaaaggatagtcttaagtactgctgggtgaaacttgtcacacctgaacacagagatagcaatcctcattgctgggtcatctctcagtggcaggataatatacttgaaaggatgatcagttgtttcctggttttttccttggcccctactaggtaccctgattcaaacaaggctgttcattggttagtttctcagagaaggatattgtgtagaaagctcagggaaaaaaaagtgtgtggtatgttggcatcatggcactactggaactggaaggactgtggcactgggatctagtggtgggtgccccgctttctggatggcagggaaaggttctctgatgcttaaatgagtccttttttctgtacatttgggatatttcataattaaaaattaaaaagtaattatctataagcaggagaaaattttatcttataatatcaataaataactcttagaatactctcaagattaattttgagaggaaacttataatcattaacttttatattgagcaacaattctataaaaacacaacagcctaaatcaattcaaaccttaaagtaaaaatgtttgcaacatatatgacctattttgtaaaggggcagaatccacaacaaagaaccctagtaaatcaacaagaaaaaaaaatgtttcaacagataataagtaaaaaacaaaagggaaatttaaaagagaagaaatagatatggtaaattaagatttggaaaagttcaaataaaaacaagatatttttcacacattagcaaacatttaaagaaacaataatagtagttttggtgagaatttgagggctgggctaacaatatgtgtagctagcattcaaaaggtatttatttacatgagaaaattttgccattttttcttcactggtaagaaaaaatgataaacaaccatatatttggaatgatatcaactttttaggattaaacacattcgtttatacatttgtagaaaaagaaattggaaggaaatacatcaagacacatgtagtggttatttctgcatcttcaaatgacaatttttgctcatttatacctttgtgtattcaaatttttataataaaattacattattaaaactttccttggggccgggcaccgtggcccatacctgtaatcccagcactttgggaggccgaggcaggcagatcacttgaggtcaggagtttgagacgagcctggccaacatggtgaaaccccatctctactaaaaatacaaaaattagctgagtgtgggagccggtgcctgtaatcccagctactctggagcctgaggcaggagaatcaattgagccttggagatggaggatgcagtgagctgagactgttccactgcattccagcctgggcgacagaacaagattctgtctcaaaaacaaaacaaacaaacaaaactttccttggtacattctaggttctttaaacaacaacaacaaaaactctttgatggcaaatggaagagacaggattcatgttacacatccctctgtgtccttacagggatgtgctgaggatgtatgaaatttctttgtaataatgtcgttgttttcccaagagcattatttaaggagaatggacaggtctatgggaaaatttaactttgtatagaatgatttttaggtctaaaaagtctagttcagcctgggaacactcttctatgataaaggaatgaaaacaacacaaatcacaatatcatattaaggtgattttcctaaggaaataatgtgtttgacagctgctccccattcagtgtatctgtaagtgaagagagtcaattgaaactaatgttcaccaaagaccacttttagccacccattgttgacttggatgtaaaatggtaagcattgtgtttgaacgattaaaaaatcagaaataaaattactttttgatattagaatctaaatggtccaagaatatgattgtcttggggattctttttgagaaattaattttgacacttcactcactttataaatagaaatttctccttggttgttttcttaacatgtttagaattgatgctaacacactttagtttattcattgcagccaacttttgacaacaagctttcaaattctggagtttaaatatcaaaacttgacgtggtaacattatagaaaaaagctagtggaacacctttaaaaaaatggaatgttgaaaaacaactccaatgaatttagaaatggcagaggaaaattatatgagaagatttagagtcctctaaagcaaatgatttattgaaatattttttcccccagcaagtattaataagtaccttccatatgccaggcattgttttaggaactggagacgcaactttgaacaggacagacttgcttcttactttctggaagcttacctcccagtgaggattgatagacataatcaaaaggtaaagaaagaagttactttcagattgtgctaagtgccatttacagggatgtaggagagttacctggggtgagagaggagggaggaagccgtttgattggttaagatggtctgtctggaaaagaacttttgagttcagttcctaaaaacaaggagctggcctgtggtgggaagatatggaggacgagattataggcagagggaagagagggagcaaaggcctgaaggcaagagcaaacctagcatgtttcagaagtaaaaggaggccagtgtggacagagcctggtgggtaaggggtacagtgacagatatgagattcaacaggggattcccaagggcctcctcatccccactactcaactggataactactgtcttttatgcctattgactttctgcttgaacagtcatttaaaagtgttgaaaggtgaaaaagaaaggtttaaaaatctctgtagttttaattttattctgattgctagaggagatatataaacatacacatgcacacacacacatatataaacatatatacacatatatgcataaacatataaatatgtaaatgcacacatatatacatatgtaaatacatatatatacatatataaacatttatagatacatatgcaaaaacatagacagacatatacataactggtgttttcgaacatttgacaaggattcatactagagaatcagtggcatagaaattgcagtataggaggtaaaattggatattaatgtttggaagtacttcagactgctcaggaaaagttaaccataggtgggtggaagcttttccccagctggagaagctcagtatgtcaatgaaaccggaggttactaataaaaacacatgaatgacatgaacaggtctattctgaaaatagcagagttggaaaatgctaacgttagagacagagtcagtaacaacaatgaagcctgccagattggtgtcacttaagagacatgatctaaatagaaagaaactcaacccattgcatgaggatgcttaagttattttgtttgaagagaaatttatcttgctcagtggaataagccagaagactaaacaggaaaagaccattagggaaagatacccaacgagcaaatcagaacaatatgaaaaaagtaatatcttaaagccacctatattaataaatttggtttgcctgttcagagttctaaaaatgacttgtgaggggagagtacagtgtttctttgtactccattactctttggggtaaaacctgtttgacaactcagttcaacatgactgacagtattaatcatgcacctatatgtggctagcactgcactaggaagtgtctctgctcataaacagtgaaacctactaaagagaaaaggcatgatgttaacaccacctgggatgtggagtgtatccatttcacaaaatcctatcagcagagcaaataatgggaacaaattgactacaggccagggtcaaatcctaaggtaaaagcagtaactgccctcgggtgggtaggagagagcatctctgaaattggccagagctaccagggaaggctattagaatgaagtgggacttgaggctgcccttggaggagctggtaaaattttgataggtggagaggcagaggaaggtgtctctgaatcattaacagctgaacaagagctgttcaatcttatccaactgtgagtctggaaacactgcctaattattaactagcaggtgaaaagaacagaaaaaaaaccactggtgccactgccaggcttccatctggctgtggtatcatcaggaggcccttaaagttatagttcttgggcaataagaaggcagcatcttttactaaattaacaaaattaacttactaaataacaaaagtaattttaattacacccagatttagcagggaaactaaatagcaaacattcaagtaagtgtctctgttgataagcatataactagaaacactcttttggaagtaattttgtgatgtctcaacagtaactaaacgaccatgtcatctgttgacctggcaattgaccttaaagaaatagtccaaatgggaaataagaagtcaaagatactaactgcagagttattgatactattgaaaaactggaaacagctcaaagactaccaacagagtagtcaaagtaatggaagcagatgtgtgatatcattcacccatggagttagtaaaagttaaaattattttaaatagcccctgttggtgtgagtgtaaaatgggtttaaattttatacagggcaattttggaaatatcaaaatttaaaatatgcattcctctgaatcagctccagaaacgctgagaagggatcaacagttaaaatacttaatccacgtagagggctttactgactccaaaacatctccttatttccttttttaaaaatgacattatccacaatacatatgatctttgaaagaaaaggaagaaagaaagatagatattattgatagtcccattttctaatgaggaaactgaaggtcaaagaggtaaaggaatttaactttctctagccctaagttcatatgcctgaaaaatcatgatgcaactggttggaatttcacaaggctaaatacagtcatcttgtttaagtgaaaatatctcttgatttagatatagaaccccatttcatggagccaagacagtagggtctacggaaacaatggctgtcctattcttccctggagatgataacactgcttctactacacttgacagagggggagaaggggagaacaaaaaaaattttttggtcttctgacctagcctgtatgaaagaacaaataacttatgtgcaaatataagatacagtgtgagtgctgaaaacgaggtaaggattatgagaggtctattatctacatgtgttgtatatacttggagaacacgtttgaatgggggaggtgcggcattatttcacagcaggagaaataatcattctcatcatttctaaaagccaagcagccttcagtcagtttcacaataatcaattaattagctaaagtaaatatttagaatgagttacggcacaaagatatgaaatcatggcatataaatgagctttagacatgtaaactgactctttaggaggagaaattactcaagagggagaagtggtattgcaccagatggctgtgtctaataataacttcaatggacacatatgatacttgtttaattatttatcaaggagaatgcctgcaaaaatttagtaagtttataaaatttttggcaagtacaagactgtgtcagccaataatgcattttgagtttaaaatgctccctcttggtggcttatgataatacttaatcctagaccaaggattcaccatttttctgtctcagtttcaccatctgtattaagaactgaaaaacctttacccaaatcagggagtttgggactctttaggactttactttttatattatcccctgaatcaaatacttcttcctacttaaaccatttccaaaagtgtactgtcatatcctaattgtcttaattctgtctcattgccatttcccccttaagttgcctcacaatctatctgcctgacttctagacaaataacttcaaagagttgtctatagaaggtttctagttttctttttcatttctcattattctctttcatttctttctccctgcctcccttccctttttcggttttgtttttgcttttcgaaggagggccaatttaaaaacaaaatgaaaaaagcacatccattactatctgaaggcactggctactacgaatcccttttctttgtgcagcccttttggctttttgcaagacctccctatgtaccatctcacccgtttcttatgatattgttcaacctttaacccactgacctgacttctatccccacagctcccccagaacggcccttgtgaaggtcaccaatgaacccggcccccattgcagtcttttaactttgcccctcagaagaaatcaatcatgccggctactacttggctgaatatgtgacttggatcccgtaacgttgcacacttctctttttcttctaattttctgactactcatttcctctcaaccccctttgctggcttatcaccttcttcctaaactataactgctggaagttttcaaagcctactgctgttccctctattctctttatgccatttccctcatgcccatggtgccagtcatgctgatgaacacagatctctctggatgtgattatcactggcccacccatctcttactccagacccatatatccctgtgtctactcaatatcaccacttaagatatcccacaggagctccaacccgggaagtaccaatctgagtgcatgatttctccctctatttgttcctcctgtgtttctcacttcataaacccatttacccagttgcttaagctagaaacttggcattcatcttgattctctctctctcactcccctgtcatctaatccatcacaaaatcctaaggcttctaccacaaaagcttattccaatttgtccttatctctccaacttcactatcatgccccaagtcaaagccctactcacctgggacctggacatgtgtggcctcttaactgattctcttgcttctattcctaccccacttcccaaatccattctcttttaacattaaattcaatcatagaatccctctgtttcagggaatgaataaataaatcaccttcaatcaattaattttagaattaagatcaaaccctttcccaggacctgcagggcctctaacaaccactttgagctcttcacataaccagttccacctcaaccaccaagctggttgtccaggacttctccaagcgagtcaagctccttctgcctctggggtcctcttctatgctcttccttctccactttccagagctggctccttctcatacctcagaatctcagtttaaatttagtctccacaaagacactgttcgtggttacctgaagattcatggtaagttcccccttatggtctattattgcagcattgtattatttcctttatagtaatcattaccatttctaatgatacgttcatcaatcagtttacttgtttactacctgtctccacaatcagaatatgagctccatgacagcaggaataactttaggtattcacaataaaacatggttaataaatatgggagtgaaggagggatactactaaactatgacattaaaactagtatgaggccgggtgcactggctcacgcctgtaatcccagcactttgggagggcgaggcgggtggatcccctgaggtcaggagttcaagaccagcctggccaatgtggtgaaacactgtctctactaaaaatacaaaaaatataaataaaaaaaattagccaggcgcagtggcaggtgcctgtagtcccagctactcaggaggctgaggcaggagaatcatttgaacccaggaggtggaggttgcagtgagccaagatcacgccattgcactccagcctgggcaacaagagctaaactctggagggggaatgtaatattaattcaaacacccattttttttcttgagaataaaattttagtttcaatattttctatatattttggtttcatgtttacaaacacatttaaaatcattaatatgtttttctttaaaagctactgatttccttatgaatttgtttttttcattcaaagtgtaaaatgaatgactctcattagatgtgttttgaagaaatatctttgctgtgttcttttctctgtgttcagccacgagaaattggtgtgaggctgctggagtgggatgggtccctatcctgacaattataagtcagtataaaaaagtctgaggcaaaagcaggcatagctctgtgggcatttctgatattttacgttagtcattagaaataattcatataaaaaaggaagatgaccaataataagagaaaataatgtgaagcattgtattttttaattgctgcttgaagagagttcattttcagccaaaacacaatagtactttgctcctttggctagaagtacaagtgattccaagaaacttaagtattctcagagctacctgctatgggtatttaggcctaagtcctgataaaaggtaatcacaagcttttaagaaaggtattttttaatttcttcttttcaaattggaaagaaagtgggcaaatggtttgtagtgttctaataaaatagattagataaaaggggcaagaaatcacaggctgaagtttttttattcaatacatatttattgaatatcaatgcataacaagaatggttccaggaggcataagaaacacaaagatgaataaaatatagttcttcccattaagaggctcatcattaggcagaacatacagattagatagatggatggatggatggactaacgacaggtgggtggatggatggatggatggatgggtgaaaggacaaatagatacagcataaagagaggatgaatgattaagcatggtcttctagcacaaagaaagttacaagaattatacatgaaacaaggaataattgagactctatgaatgtaaagaaatgaatgtagttcattaatttgatccatatctcagttgccttactgatatggtttggatgtgtgtcccctccaaatctcatgtcgaaatatgatctccagtgttggaggtggggcctggtgggaggtgtttgggtcatgggagttgatccctcatggatagccccttcctgtggtaatgaatgagttctcactgttattcacaggagagttggttgtttaaaagatcttggcaccacctcctctctctcttgttccctctcttgctatgtgggcatacctactgctttctaccatgattgtaagcttcctgagacctcatcacaagcctagaagatgcaggtgctgtgcttgtatagcctgaagaactgagacaaatgaacatcttttctttataaactgcctagtctcagggattcttttacagcaatacataatgaactaatacacttgtgcaatatcaataggcttttcctttaatatctacaaaattcttacagagaatgaatgaaaaatgaagtctcctcttgaacagcccaaggttaggctgctcctgtatgactagccaatttcattgagtgaaaattcaatggcatcccgaacttggcatgttcttcattaggcaaggaaaggaataagcaagagtgcctggagtatttctctcaaatctatcaaaagcagagaaaccagtcaagacacactgttctgtagaactaaacaagataatctccagacctctgtctccttgtccataatatgaaagtgctgtggcagccaatgatgagcagcagccatggctctgcattactccggggccctgggcctcaaacaagggccacgaggtgaccaagaacacaagcaagccgaggcatagccgctggcacgaacatcccaccaagcacaccaagttcatgggagatgtgatctgagaggtatgtggctttgccccacgcaacatgccatggagctgccacaggtctccaaagacaaacaggccctcaaattcatcaagaaaaggccaaggaggaggaagagagaggagctgagcaacattctggtcatggcttccatgaggaaagtggctgccaagaaggacgaattcctcccctccccacataataaaacctttacaggaaaaaaaaaaaaatgcaagggctggaccagatcagtgttagcagaaagattagcagatagatttcttcacatatgaattggtgttggctccttggagtgctatgttgcaatggaagcacacattctacctcagtagcaagaaggccctctgatggactagcaacatctgccatgagcatgggaatagcgtgacacattcactactgtggggcagatcactaaggtttaacatttaaaccttaatctacctcagtagcaagaaggccctctgatggactagcaacatctgccatgagcatgggaatagcgtgacacattcactactgtggggcagatcactaacatttaaatgaaatgttatctccagggccgggtgcagtggctcacacctataatcctggaactttgggaggccaaggcgggcagaccacttaagctcaggagttcaagaccagcctggcaacatggtggaaccccatctctactaaaaatataaaaattagtcaagtgtggtcgtgtgtgtttgtagtcccagttactcaggagactgaggtaggaggatcacttggatagcttgagcctgggaggtcaagactgcagtgagccgagattgcaccactgcactccagcctgggcaccagagtaagactttgcctccaaacaaaacaaaaccagcgtgagatattattatctaaagtcctttcaaactctcaaatcttatgatttccactaacattgagttggtgtgattatcttcctatatagtggacaacatatcacaataaattcttaattatccatactttcgttatttttgccccaatgttgctttcattctcatgaatgtgatccgaagaaacacagccttatccacaagcatggagcccagcaggaagctgtttaaagcagaatacttcgtttactcattcaaagaagcccatgccacgtaggctgcgatgggctcaggaatagcaagaggtttgccaaggtgatgcaggtgagaaaatacgcatttcttgttctttcctgctcatatttccacaaagtttctttacagaactgtaaattcagaaatcagatagagccatgatgaaaacaattacaaataaaaacaaacgatggccacttatttgagatttcagatagcatgtaccccggttacctcttactgataagaaaatctctacttgtgctgctcttttccaaagattgcttgaactgagaccatctaatcgctagcatctaaattactattcattttcgtgtttatcctctggtactggttactcagcagatgccactgctacgtcaaaagcccggaaactggcaggagaatgtccttccttttcttgctccttgtttcttcaaagtctagcaagatttgagttccttacaatgattctcctgcatcactcacatggctgtatgtgtgactgactcggtaggagctctctgcatccattaaagaccagatatacaaacaaacaacatcatctccaccaaaaagattaccttaatttttttcttttttgagacagttttgctcttgtagcccaggctggagggcagtggcaccatctcggctcactgcaacctccgccttccgggttcaagtgattctcctgtgtcagcctcctgagtagctgggattacagacacgcaccaccatgcctggctaattttttgtatttttagtagagacacggtttcaccatgttggccaggctggtctcgaactcctgacctcaggggatctgcccacctcagcctcccaaagtgctgggattacaggcatgagccaccagtcccggccaagattaccttaaccacaggagatactcttcctgtggttcctgtcaaaagttaccatgttgctttattccttccagatattaaccagatgttagtcattttagcattgtgcatattaatgtcttatgttcttgatttttaagattttccctctaagtcttagaaagtcagagctttaagggagcctgaatacctgcctttgacagctaggcaccacaagggcctcgaaatctgtgcaacttgcccatggccactttgccaccgtgtgatagagcagggtaggagcaataccacctctccagggcccatggccctgtgctttcctcttgccatactgagtggcttttcctgcactttcatgcccttcccagtcttctccggtgggtgaggcctgcggcacactgggctcttctggtgcccctgcagaatctctggcatgcccctctcttggcgaagccccagcaaggatgacatagaaaattcagacaaggatgaaatcatcgttttcctctattatttttctaaattgcctttttcctacccatgactaggcagtatttcctcacagctggggatgaacaaattcaaaaagatgttctcaaatacatggtttccaagagaggccactaagtgttgaaagtataaaatgaacatttttgagtgattgcacagttcatgaaaatgtctctggttagaacctcatcagcagtgattcactctgtgcatagggtccccatggagactggagtcacctcacattagggtattgaggctcatttttcctgctgagatggaataaatggctaggatgcattaactgatggcggtcacaatggtcccatccagtgaagtgaggaatatttctttaaagatgcccttgtggtcagaaagacttactgaactttaagactaccatatttctccttccctttaaagaaaaagagtacttttgccctataggcataaacattcagaagtaaagcctcaaggtcaaaattatatcttctatgatagatagcaagataatgtccctgttaaagaggaaaatatagtttattacagttcaatcatgtttttcttgatgcccaaaacatctttttcaagataataaccaattaaatgagattatatactgtgtgtcttagtctatggggagcttctgtaacaaatactacagactaggtagcttataaacaacagaagcttatgttttggaggctaagaagtccaagaccaaggcacttggaagatgtgccatctggtgaggacccactttctggttcaaagacagcctcttctcatttcgtctttacatggtggaagcagtgagggggctctcttgggtctcatttaaaagggcactgatctcactcatgaaggctctgcctttatgacttaattaccacccaaagtccccatgtcctaatatcatcaccttgggggttaggatttcaacatatgaatttgggggtatgcaaacattcagaccacagcacagtgctggagcatagcagatactcaatacacgagttttaatttgtatatgcaactatgttttaggtactttacagctcagctacttttatttaaaaatttttcagttttaaaactgcatcgtaagtaagaccacagaaatgtagcatcagacaagcttccctacccattccaaggccaaatgaggatttttttgtttgtttctccaccagccaagaacctggggtgcttcagggactcaaactttagttgcagtttccaggcctcatggtttagaaggtctaaaataggcccagaaatctactttccagaggatgctgaaacagatgacctgcagcaaatactctaatgtaattgactcttgaagaacatgtgtttgaattttgaaggtccacttatcaccaattttcttcaataaaagttatactaagtatgcctgcctctcctgcctccccttccatctccttcatttcttccacctctgacacccctgagacagcaagatcaactttgccttttcctcctcctcccagcctacccaacgtgaagacgaggagcatggagacctttatgatgatccacttctgcttgatgaatagtaaatgtattttcccttatcatttcttcttcttttttttttttttgagacagggtctctgtcacccaggctggagtacactagcacgatcatggttcactgtagcctcaatctcccaggctcaagtgattcacctgcctcagcctcctgagtagctgggactacaggtgcatgccaccatgcccccactaattttttttttcagaggtaggttttaccaccatgttggttagactgatttcaaactcctggactcaagcaatccacctgtctcggcctcccaaagtgctgggattgtaggcactgggcccagccccttccttatcatttcttaataacatttatttttcttctagcttactttactgtgagaatatagcatataatacacataaatataaaatatatgttaatcaactgtttacgctattataaggcttttggataacatcaggctactggtagttaagtcttgggggagtcaaaacttatatgtaagttttttactgtgtgggggtgagcagctctaatcctggctttgtccaagggtcagctatagtgtcacagagctatgatttgtgggtgtgcattgggtacatgtgggtgcttccacgtggcttgcagagaatggttgtcacttctcctccaataggagatgtcaggacaaggggatcattttctacaggggccaagtcttctcttttcattcccttaaaatagaaagtcatccaaggtcactcttctccccttccccgtgccttcctaaactgctctccaatgagggtaacacaaactaacacatttgatccctataatatgtaccacacttcaccgattctagaaaaggtaacaattctctgatgatgattattccctccttctttacagacaaactcagagaagttaactaacttgcccaagtttacgcagctaagggaacaagcctggattcaaacctaagacctcaggctctaaagccaccatctgtctcttgcagagacagttcctcaatgttgaaggaaaaattttttctcctgaaagaccacagaaaggatccccacatactgctgtaataggctaacgcccctctgtccttgcactttcccatctttccaaccctctgcttgccatcctcagctctgcccatccagccacccctccactttcttgcctcatcagcccaccccttttttcatggctccactgccactcttgtaggagtgtgtagtccagctctgaaattactctcctgaaaatgctcatgccttctttgtgcccttgtcctttcattctcaccacctgttaaaatccaaccttggataaacccacagagaacttccttctctgtgcctgcctactgggaggacacaacagtgctggagaaaaccacgcagggctctcaaagagtgtccagacattttaccatatttttctggtcagcttcctgtctctcccccagtgaaaccttcaagggttctcccttctcttccaaccttccattcctcatcagcccacttatcctcagcagatgcctgtccttttctgagaaatggaatccattagccaggaactccctccacctgagttaccaaatcagcaatcccacctgctctgcattctggacttcccatgcaggatgtacataggttgactcaagtccatctcatttgtgttaaactttaaaaattccaagtttctgttttctttgagagagtgttacttgctttcagactgcaatgtatatattctctcccatactgatgatcactttttggttattgtcataaacctgagtgcatgaccaccatagtgttattcatagaagtctacttgatgttactaagttgttcctggttcaactttagtacaatatctagatcacaggacccaggttcgaaaatggaaatctgcagcattcaaggacaacaaaaagtgatgtgcataataattacataattgaaatctttaaatttcaatgtaatacaaataaatctctatgattctcccctacccccaccacgaatgatgtctttccacccaaggtatttatttttaaaaacaaaagtgtaaagatagagctggccttaggcaaaaaacgtaggagactttgctttaatcatttgcccccaaatcctaatacagtagaaacactttaggcagatagacctggttatcaattccagcactgtttccttccagctgagtaaccttgggtgagttaactcacatcacctaaactcagttccctcatctataaaatggggttaataatatttagctagcagaggattcaatgatgcaagatattagagtatttggcacatattaggtgccaaataattataggttttattattattctttttagtgttcctagtaaagtcactcatatcatagccccagatctttaacttcttatatccctaggcaatacatacattcactttaaaaagactttgtctgtaaacttctgcttccagccaccagaaagtaacaaggatagaatttattctcctactttaaacaactcaaaaatcaaacaaaatatatgaaatgacggttttcagatactgtacaacaaaaagtacaggatagtgatcattgagagacgggaaataaatgaagtgaaacttatgatagtcccagccactgtctagaaggtttccagggcttaatgcaaggaagagaaaccagaacagagcctgaggtctgtctgaattagacatctggggaaaccaatgcccctggaaatttcagggcagagtacaagagaggaaggagccaatcagagagagagagctttggagatcttcagaggtcccctcagagtctgtggctgcatgttgattaggagagacggagagggaagtgcaaaggctggggcaaaagccacagatggaacctttctgaagctcacaaaggacagggagtagctcaagttctcgagatccagagagaagcaacctcgcaatatgccaggaaagagttcccagaagtgttttgcctcagaaaccggatgaaattatctccagtctaaaggctgcttagatccattaacccaagtataaaatcaaagccttgagagaatcaaactgtttccaaggaacttgactgcatctcaaaacaaacaaacaaacaaacaaaaacttaaaaatattttaaagaagacaaaaaaggaaagaaaaaaaaatccagcacctgacaacataaaattcacaacgtctggcaaccaataataaattagtaggcatgcaaagaaacagaaaaataagacctatcataaagataaaaatcaatcaagacagagattcagaaatgtcacagataatagaatcagtagataagcacactaaaacagctattataaatatactccatctgtgcaagaaggtagatgaaagcataaccatgataaagaaagacagggaagatacatttttaaaaaagaaggaatctgaaaatataatgctcaattatgagaaaaataaatcatggatgtcaaataagggggctggaggtcatagttactcttcatatctaactgattgaagacagaaaatctatagtttagacagtctaaggaccaagtataaaagtgacttttccaggtattatgcattttatgtaattatttatataaatgaaccaaattacatattcattcaactatatagttaccaagcacccagctttaatgatagaggaaatacaaagatgattagctacagttctttcccatagaagaagtccagcacagtctgttagacagatgatagaataattatattagcacataaatgacatgtgcttacaattcaagaatgcagtatgtaacacactgtaaactagaaggcaggctgcagaataataaaaggaaataaaagcaaacagtggatctggagcagaagtcccctacgcaattaatccatagttacaaataaaagactttgacattaacccaatgcaaaaatccaatatacaataattcacatgcatgcacacacatatatacacacacttatatcagtatagaaacactcaaactcattctaatatgggaatttaattgtctggcttttctttctactctctgctgaattagaatgtccactctgagcagaggatgcatttcctagtgtggaatgcaaatattttccctcagcttattgggctgttaaagatactgaagcttctctactccagaggaaatcaagaaaattagggaatgtatgtatttgtgatatatacacatacaaaaattatatattatagattatatatttaatacatgtacatatgtcaatatgcatgcaattatttaaaaatatttctctagttttagtctagtgagtaagaatgtggccaccatagttctaaaggctaatgagtggtacatataccagagtacaacagagcaaataaagattaagctaatcaagaggtgcaaactggaataaaatttaaatatatatgtatttgttgtagtatacataggatgaaaaaatttttatattaataattcagaagaggtcgatctaatgctaagcaagtaaatttatcttattcattccatggaatagaaaagtgactatattatattaagcatttaacaaaagtttgtaacatctctagctaacaaggatataggcttttgtcatttgtggagaacaatctttgatttgctttaagtgatgtcagttaccttatatagtacatgggataggccaaagcaaatcttttttggaaacagattttacacattctcttatctctagaaatactgtagacaggctgggtgcagtggctcacacctgtaatcctaccactttgggaggctgaggcgggcagattgcttgatcaagcccaggagttagagcccagcctgggcaacatggtgtgaattcccatctttcctaaacatacaaaaaattagctggcacacatctgtggtcccagctactcgagaagctgaggtggagaatcacctgagcccgggaagttgaagctgtagtgagctgtgatcaggccattgcactctggcctggatgacagagtaaaatcttgtctcaaaaaaaaaaataaataaataaaaagaaagaaaaagaaacaaaagaaatattgtagacacacacacatcagcttagcactaggatgcaagttgcaggacagcatgtgtagcgtctatggcagtgcctgcacatggcaggtgctccatattccagtcccattggatgtatctaggccatctacctctgccccatctacctctgccatccctttttggacagcagccttctagatacaaacccagcctccctcccctcttgccattcttcaatgcagtctctataaaacaagtcagatgcttttttgttagcagaaataaagaaacaaaacacacgagtcacaggtcacttatctccttaaaacttcagtagtttgcacttcaaataaagtctgtactccaagctttggaaggcatggtctggccccagcctatcctaccagacttgagttaagcaccaacctgccaatcccactccatcccaaccaccacctctggcccacatacacccacttttctcttctttgaagaggataagctcctttcatctcaggtctttgaacaggacattttctgcttttagaactttctcatcttttcaaattctccatttctttctgctcttccttcctgctaactagataagtctaatttatcctttaggtcttagtttgaatattactactttaggggaaccttttctgaagcttctccaatacctccaaacaaagttagcctcccaattcctctttgtaacatcccacaattataattagtcatttgtataattatttgataacatcttctttagagatacgtgttctccataagagcatcactggtcggtcaggccaattgctgttcctctagtgccttgtaaaaaatgctgtaatactgtggtgagtaaataaatataccaatgtaatgtcctaatgtcctggggaagaaagggtaagtaaatgcatagagtgtaacagaactgtcacaagtacatgaaatcaggtacataaattgtgaaacataagtcaagggcctatttgttttctgacacttgatagtgagaaatctttcaacaagatggaaaataaaaacaaaagagaactctgagcatcatcctttagagacccccactggtacccgccaggctgtctgtatccccttcatcatggctgtgtcagagaatgccaccattaatatctgaagggactaaagaaagaaactttgctggtataagtatgattttcattttaaaaacaagcatgtggggtggtttatcaacagacagtcctgagtgtatttgtaagctgaagagacagtttcaggcaggatttccagattctatttttttatctctgaccacttctctcatttcaaatcttggagccctgaaatagtaggaatgtagtgggacacaagagagggatctggagacctggctgcagggtaggctgaaacttgaaggagcatctgagagcttcttcctaatttcacagcagaggtgcgtctgggcgttacggtccccagggcgtcaacaaccatccctatgttgtggccaccaaagccatacctccatcaggccttccttcctgcttgccaggcccataaatctccctgctcaacacaggttttctttcaacaggttcctcaaactcaacatatccaaaaggaaatgagccatcttacccatccttctctttcagccttccccaccttctaagcaaatggctctatggttaaccccacttgcaagtctagaagcctaggagtcactgttgattcttcactctccttatgttccatgtggtcttagtcatccattcctgtggtttctacaatgaaatgtctcatgaatcccttcaggttactccatctgtactgctcaggataatcgctggcattactgccatcactgtctcttatctgggtaactcctgtctggttgccaacctttccacacccccatcagtcctctataggggttacaaacatgctctgtaaaaatataattctgatcctgctactcccctgcttaactttcttcagtgacatcctatagcaccctttatctattagtagcataaccacttatcatgttaatttgtttttgtgtatttactcttttctgtttctcccgccactctaaagcatgacagtaaggtctatgtcctgtattcccagtatttagcataacatctggctcaataaatctcagttaaaagagtgatgcttgaggagatgaaaggatttaacaaatccctcttcatatctgggcatattaaagaggataaaggtgttcctgtgaggattaaacaacccaagaaggaaattagaaaaaagtactctgaggaagcagagaagaatgaaaataagtggaaacaccagtgaatgggagagggtagtgaaggggacggagaaggacttgcaacctatcttggcgttccatgagatagaaagctaagttcttctcagaatggcaggaaacagaagcagtgacagtgaacccagagcttctgaaaaagaaacagcaaggtatgagccaaggaacacttaagggtgctgatagacccttacaagtgtgaagaagtcttttgttggctccaaattagtcactgataaaggatgtggctctatgtagttaattgggaagtatgttgtcttttttttttttttttttgagacagagtctcactctgtcacccaggctggagtgcagtggcgccatctcggctcactgcaagctccgcctcccgggttcacgccattctcctgcctcagcctcccgagtagctgggactacaggtgcccgccaccatgccctgctaatttttttgtatttttagtagagatggggtttcaccgtgttagccaggatagtctcaatctcctgacctcttgatccgcctgcctcagcctcccaaagtgctgggattacaggagtgagccaccgcgcccggccaagtatgatgtctttttggaacatgtgtttaaaatagcacaaatggcatgctaagaagcttggagtaaaagatgtgcatcaccccagagtcaataatggctaaagaaatattgttgacaataggaaaggagatttcaaaaagtttatagaaaagcaaggtattatctcacggccagagaatatccagaaagcactattagttcccatgcaggcctgggcaagaaacttaaaacctgggtactcagctcctgcttttcagctctccttccagttgatgattataactttggaaaagaaattaagttatacaggaagagagcagctggtcacacaagaggtgccaaagcttgggatttgatattctagatttcaacttgtgacaccagaggtggggccttctgaaaagggacaacgtgtgccacagaaaactgagaagaaggtttcaggcaacacctgacccaaattttgaaatttgagattagggagtgacactgttcagcacaaacataaacaaaattgtgaactagatcatgcagaggatatcatatgaggcatagaaggatggatggtagtggagaaggatctccacagtgaatattctagcgtctcacgagaggctcacaggtttgttttttaattaatttttaaattttactttaagttctgggatacagaatgtacaggtttgttacataggtatacatgtgcgatggtggtttgctgtacctatcaacccatcatctaggttttaagccccgcatgcattaggtatttgtcctaatgcaggcattttttaaaggctaaattaagttaggaattgtacgtagtagatcccactctttgagaactacttattgcacattagcatagtaaaggccttgggaaaacctacaaagaaagcaatttatctacgtttaacccagagtttgccaccattgttaggccacctaagtataatacttatgtgacctccactctaccttacaacagtggaacacgaatgttccaacagattggtttaaaaaacctagatctacaccaatgcacaaagtattgacaacaaacacaaatcaaaggcaacaaaaaaacttcacaaaaccaaaacaaagtatggggaataaaacaaacaagaaacaataatggaggtaagtatcatctcacagaacagccaggactttggagtatgggatttaggattggggtataactgtgtaatggtatatttgggataaaaggaacaaattcaatgtaatgatctcaagtagcacttcctgtgaagaaggtaaacagagaagttcataaaggtgggagcagaatcacggtgagaggaacatttggtgatgatgaaaggggagggaagtggaagaggcgtcactgtggaagtgcacgacagcacatctgaaaggtgtgctaccacagtaatgagggatttgatttcctgggaaatccttttgataaaatcagaggatataaaaatcttacgccttgctttactgataattttaatctctcaataaattgaagaagcagtgaggaaagggatttagtgtcagtttaatttcaacaaatatgggaagagtggttggtcatttagaaatatcagaaactttgggagaaagccaagtactcataaaatccagcctctccataatcctgtcagaaatgttttaaagaggatttcttggaaggaaggttacactaaataatctttaagtcccttctgaaacattaaaggctgcctctaacattctgcattcacagttgaagaactccagaggtggccagcatgacacctgagcaagcagtggcatccgtggctctatggctacgtggaaaagaaacatagtgctgcacaccaggtacagtaaaaagggcatcagatatgtcatgtaaacataccatagaaccataagaactgaaacaatgtggtcttggaataaaaatagataaatcagtagtaaagaatagatatttcagaaatagacaaaaatatgcataagaatttaatttccaataaaaggcagaattaagtcactgggggcatggaaaatagggaatataacaacttccagagtgggcaaacctttctgcatttagaaatggaataaagaactcataaatgaaaaattaaatataaaaaccataaaaaagaaccaacattaagaggcaaaacatggagtagataaatatttttaggaaatatgaagtccaaggattaaaatgtttaacaaatgcccaaatataaaccaaaaaaaaaaaaaaaaaattaccaggaaccctatttgataaatggatacagtgtgagaataattatttacaaaagagaaaatgtgaatagaaaatgaaggagaataaggaaataaacaagggtagttatagaataatttaagataaaataataggatgccatttttgcatatcaaattagtaaatattaagtccatatgtatagtttgggaattaattgaccagtacttaacaagaaacttgaaaatgctcatttcttttgatgtactagttccacatgtaggagtctatccaatggaaataattctaacagctaaaaagccccatgcataaaaatgtccactgcaatgttttaaagcaaaatattatttgctttaaaaaaagcagaaaggagaaagaaagaaataagaacaaaggagtaagaagaatatttaatgtatgcttaccatatggaggttatataaattatcccatttaaatctcacagcagttccatgaagtagatatgatcaccattttatagaaaaggtaagatgtttttgcatgctcagggagactaagttctttaaagaaacttggctagtaacagtgaaaaaatggaaacagcctaaatgtaaatagtagaatggttaagtaatctagagatttgatgaattatttttaaatttttaatataaaagaatacaatggaaaaatagtttaggataagatgttaaaaatgcataatagaaaatgttatattcagtatgattgaaatacacagaaaaaagactggaataaaataaataagcactaaccaaacacaacagaacctgaccctgagattgtatcaaggaatgtagtcggctggtggccctgagaacaaagcaaagtgcagttaaattatcaggccgtgtaaatgatgaagggaagcccagaaagaccctgaaaggctcaaaaacagtttaagcaatttggctaacacaggagatagaaaaagtaatttggggcagatacggtaaatcttctataacgcgtagggctgtaattcttttcatggcaagttgctgggaaaatcataaattggtcatggttaaaacgtcagaagactcaaaattacaagaaaaaataatgaattatgaaggttttggcttactctagaagtcgtactacattttctgagagaagtaggaggtgagacgagagtaagtaacttctgctctctgaatatttcaattaggcagctggggaaatgtgggtggaaaaatagaaatctttactttcaagttattagaagaaagtatctgtctatgtaagctttagggaaaaggggcctgggataaacacatgttcaagccatagaaaatgtcatttatgtacacctacctccctagagcagactaatcttcaattgtatgaatttgatagcattttgaagaacttaataaatatcctaaatataatgttttaaaactcagcctttgtatttcctttgtctcctactttccctggtctcttatccattttcatattctttcttattatattaaaaaagaaaccatatatattatatatatgtgtatacacatatacacatacacacatgtacacacacacacacacacacacacacatattactacagttaatttggaatttttcatttatggccactattgaccaaaaagaaacacaacaaaaaacaaatgcttggtcaactcagcatgaagtgcacaggtatgtgggagtagaacttagcacattccaaatgcgattggtttctatttaatgaacaccatctaccctcacctactttgatggccaaaaagtgaatttttcttctgccactgtaacaatgactactgcataatacctggttgtcacctctccactataaattctgagagggcagaccatacttgtcttgtttactgcgggagcccctgcaccagacagcggctcaatgagtatttgttgaatgaatgaatgagtgagtgaatatacaaatcctactcatctctccagacttagctcaagccccaccttcctgataacatctttcctcaaagccccagtgaccgatctgattattatattaccagtgtgcaccactacttaacacacctgactctacacatcatttttatcattgtttttcaggtgttggtgttttgttttgtttttttcaatttagagagaaaggctcttcaaagacacttatatacatatatatttattctatttctcaaagcactttttacaggacacatgtaaaatcctcagcaaacacctgttaaattcaatggttaaatcttttagatgacttttgactttgtggtatttctaaacattttctctgctgaatgcatgcattgtattaggatttcaccacgtggtggacagaaaacagggaatttagtgtcagctgagctgagtttatagctctgccatttcaatgctggaaaagtcaccgaaactctgctcttctgtttctctatttgtaaaatggaaacattaacaagagcaataacaaaaagaaatatctacctatcataaagggaagacagtgcaatcaaatgggataatgtaggtgaatgagttttgcaaattggaaagcaaatattagccattctatttaccaattttaaaaaacgcaattgatgttgcaagactgtgtatagcaataacagttagtgtggctttttctgagaacaaggctattaggcagaagagaaaggtgatgaggaaaagaatctcaagtacaacttgccaaacatgccccagtcataaataaaagactgtgtccaacactcgcggtacagagagattaccaggcacctgtcacctacacccttcggcactgctgcaagcatctctgaaaccaggagaaagcttaccagacacgagctgctgtccaggcaaccctacgggaaccatgcccaggttattcatggctgtagcccaggctgtgggatctgtcacggacatgttgagctgggtcgtgtctatcgctatactccccaaaccatcggctgctgtggggaaaaacaaaccatgatttagagtccataggcaagggtgtttgttttaaagaaaatcacatttctagatatgtgaggcttcatttagcacattcccaaactacaaaaaaaaaataaagaactataatctgcagcaatgttttctctagacataaacacaaagtgtttccaaatactttctgggagaaaacttaatgacatgtagtttatattatacacagcatgctattaaggaggtacccctggaaaaaaatcgaagaattgtttccttctcccagtgaaacaacgttagttaagtcacaaggctgagaggcaaagcagtaatactctcttggtaaaacaagttaattggcttactgtttctaggtgtaattcttgagcaggcaggccttctatctaataagaaaatagttgtcaagcagtagaactggtcctgactgaatttattaagtgttacctcgtaatctattccttcctttacaaacttttacattattacactaagaaaatacaggtgtctacctaacgtgacttttctgaaggatttctaaataaataaatcaaatttaaaaacaggtagcacaaagcttaagaaaacacaaaacaaaacagaagaatgtgtcaaatttgacttagtgctctttcattttcactagttctacagactgatttctttatgggcccaggctcctggttcaatgcatatttttcaaggtggggcaagcttttccactaagaactcaaaaaatccttgtttgtgtcctgtgctggccactggcatttacctgcagccatcatctgaggaagctcctggggaagctgggtgatgttctcaactccacctgcatctaccattgaattatgagtgtccagaggggcaggaacactttgatggctgagtgcagggtcccctcggaggtcatcagattctgcaaaacgggacagaagtgtggtgagaaaccttaatagttaactgagataaaacgtcaaggaacaaactgttatctattcaaaatcaaaaacaaagaccgatttccagtctcaggcacagaagaaatgctgcttcccatcgctcagcggctgtcttgtggctcagttaaaaccttagagccctgtgagatgtgtgggtcaactcatcgactcaccaggagcctgggctggctgaataaacagccccatttgtgagtacctcaaaggccttgcttcctactgaagcaccttcacaaatgggggcttatcagtccctgcacagccttttccacacacactacacatcaatggagagggcagagtcagggctaaagaagatttttttaagttaaaaaattaattgatgctgttactttggaagatggtcgtctgtggaatgtattcagagagggaaaaaagttgggaggaggaaggaaaaaggaagaacccattcaccatgcagctggaaaaggagggtacctaaattacaatagtcaggaaaggcagaagagaagaatggcatgctgtccataaaggaagatctagagggtgttagggaggcaaaggaagagcatttggttttttcagctcattggaaagataatttaactggccacaactttttggtttgaattttccttagaattgcccagcttatatatatatatatttttatatatttatatatatttatatatatatatttatatatagtcttttaatgcacttatctaataaatataacaattaaacattaaagttacaaagttcttctcaatctcacactatttataaaatgctatgccttctctccacccttagaaatgcaaaaacagagctttcacatgtattttaagtgcactttcaccatttcaaaactcagatgagtggcatgacaagtttgatcttaagtagattagatataacaactaagtctaaatatttatttttattttagtataaatttagaagtttttctaaaccatgttcctgttaatgatgattttagaattagatcttatggtttgacagtgtatctaatgtgaagttcgaaccttttatggcatgtctttttgtttctttcattcttaggtataagaatcagtaattccttgagcactgcactgtcaaaaagaacttctgatcagttgagcagaagtttaattcaaatggaagctaagggttcaattctcaacaacaggtgaataatgagcaaatagtttttatggtctcaacaaatccctagccctcaactagaggggtatgtaagatagtgtggaatttttttccaattgtctgtcaggaagatgaatcatcatcatcatccaacagtgaatgattctaactttggaagcaaattgtactgagaataaatattttattccttcccactatactatccaaatgaactcagaacctgcatgtgtattgtgcatcaattatcttaggctatgggtgccatcagacaaagagattctcaccatagaaaataaattcaacagcataagaaatgcatagctaacctaaatgtctggtctattcaccaacgatctttctacgatgaaatctcaaagcacttctctctccacttccaaccatttcagagtagcaaggcagagtcaggctagaatgtgttcattcttttgttcaaatggccctgtagcagagctgtttcagatctttgcaacgtcactatttgtcttacttatctccccaaatgaagtttagtggctagcctccttctacctcagattcttcccaaatgggcattaatcacacatttttttctcgagtctgcagttctggaacactatatcagagaacatccctctactttgtaggctcatgacttgtgcctgacccaccacatttcaccttgactttttgctacactgttttagggatggctttagttttccttggctctgtaacagtctgctccaatggcagttctcactttagtggttacagtcgtataaaggggcatcaagtgtcctggagacccatcgtttctacctaatactttcatggccatcttaacagactgcaagtgtttcattgaaaacagtaagcaactgctactgttccactgaaaaaaagcattgttctgttggcaagatgtggtgtataaacctagatttatcccccaatgaaactcttgtgacattcaatgtattacatctcttcagtctcccaatccaatgtttttttttttttttttttttttttttagtatttattgatcattcttgggtgtttctcggagagggggatgtggcagggtcacaggataatagtggagagaaggtcagcagataaacacatgaacaaaggtctctggttttcctaggcagaggtccctgcggccttccgcagtgtttgtgtccctgggtacttgagattagggagtggtgatgactcttaacgaacatgctgccttcaagcatctgtttaacaaagcacatcttgcaccacccttaatccatttaaccctgagttgacacagcacatgtttcagagagcacagggttgggggtaaggttatagattaacagcatcccaaggcagaagaatttttcttagttcagaacaaaatggagcctcctatgtctaattctttctacacagacatagtaacaatctgatctctctttcttttcctcacatttcccccttttctttttgacaaaaccgccattgtcatcatggcccattctcgatggtcgctatctcttcggagctgttgggtacacctcccagatggggcggccgggcagaagcgctcctcacttcccagacggggtggccgggcagagacgctccccacttcccagacggggcggccgggcagagatgctccccacttcccagacggggcggccgggcagaggcgctcctcagttcccagatggggtggccggacagaagcgctcctcacaccccagacagggcggccaggcagaggcgctccccatctcccagacggggcagccgggcagaggcgctcctcacttcccagatgatgggtggccgggcagaggcgctccccatctcccagacggggcggatgggcagagatgctccccacttcccagacggggtggccaggcagaggcgctcctcagttcccagatggggcagccggacagaagcgctcctcacatcccagacggggcggctgggcagaggcgctcctcacttcccagatgatgggtggccgggcagaggtgctccccatctcccagacggggcggccgggcagagatgctccccacttcccagacggggcggccgggcagaggcgctcctcagttcccagatggggcggccggacagaagcgctcctcacatcccagacggggcggccggacagaagcgctcctcacatcccagacggggcggccgggcagaggcgctcctcacatcccagatggggtggccgggcagaggcgctcctcacttcccagatgatgggtggccgggcagaggcgctcctcacttcccagacagggcggccaggtagcagcgatcctcacttcccagacagggcagccgggcagaggcgctcctcacttcctagacggggtggccaggcagagacgctcctcacatcccagaccgggtggtggcggggcagaggcactcctcacttcccagatggggtggcggccaggcagaggcgctcctcacttcccagacagggcggccgggcagaggggctcctcacatcccagacaatgggcagccaggcagagacgctccccacttcctagatggggtggcggccgggcagaggctgtaatcttagcacttttggaggccaaggcaggccgctgggaggtggaggttgtagcaagccgagatcacgccactgcactccagcctgggcaacattgagcattgagtgagtgagactccgtcttcaatcccagcacctcgggaggccggggcgggcagatcactcgaggtcaagagctggagaccagcccggtcaacagggtgaaaccctgtctccaccaaaaatacaaaaaccagtcaggcgtggtggcgtgcgcctgcaatcccaggcactcggcaggccgaggcaggagaatcaggggagcccgaggcagggaggttgcagcgagctgagatcacagcagtacagtccagcctcagcaacagagggagacgggagacgggagacgggagacgggagacgggagacgggagacgggagagggagagggagagggagagggccaatctaatggttttaatgacatacaacttactgtggctaccatgtgcctgggatggtgattctaaagtaagctctgtcacatcttaggaatttccaatagtctcaaggctgccgtgacattgttcacaaaatttaagttgattcggtcactcattttggaagaaaggtaatacttttaattaattaccaactagtaatttatgaatagttgcaagaatgattttggtactttgttagcatctattgttcctattgaatacctgcctctttaaatgattcaagaccataatgcctaatttatcattcacatcaatttctctgccttagttttattatttctaaactatagaaaagattaatcttcttagcgatgtttatttacacacagagatgtggggagttaaaaattatagctaataaagcactctgaatacagtaggtgataattattactattttatttggaaatgtagtgtttccattaagataccctgggatctttgtgttctggtagataattatgtaattaattctaaaacagtgagtaacacttgatatttctaaaagtaagtgttgccctagttttctgtgccacacctcagttggagcacaatatttcattttccaccattcctttataaaattatatgaggtaggccaggtgcggtgactcacacctgtaatcccagcactttgggaggccgaggcgggtggatcatctgaggtcaggaatttgagaccagcctgaccaaaatggtgaaaccctgtctctactaaaaatacaaaaattagccagcaatggtggcgcatgcctgtagtcccagctactcaggaggctacgacaggagaattgcttgaacccgggaggcagaggttgtagagccgagatcacaccactgcactccagcctagttgccagagtgagactccatctctaaaaaagtaaatacataaaataatataatgtaatttaaggctgggcgcagtggctcaagcctgtaatcccagcactttgggaggtggaggcgggccaatcacctgaggtcaggtgttcgagactggcctggccaacgtggtgaaaccctatctctactaaaaatataaaaattagctgggtgtggtggtgcatgcttgtaatcccagctacttgggaagctgaggcaggagaatcgcttgaacccagaaggcagaggttgcagtgagctgagattgtgccactgcactccagcctgggcaacagcaagactctgtctcaaaaaaataaaaataaataaaaataaataatacgatgtaacttaaaagatgtataaatattttctctctaggttttttctgcctatgcaactacaaaaactttcaagagattcatgaccaattatgaaattggcagtttctacttacagctttaatgaagtatgagcaccacaaaacaatctgatacacaaaatgccaaggataaaagtacagctttgtttggccttaacagatatctaacttgtttcctgttaagatatattcaagtataaaatctcataccaatttcataactgttcaacaaaatatatttatgttcagtatttcattgggctagataatggggcaaatattttttgaaacttatcaagtctatgaaaatactatttggcttaaaaaatggcacaggtttgggaggctgaggtggcaggatcacaagatcaggaatttgagaccagcctggccaatatagtgaaaccccgtctctactaaaaatacaaaacttagctgggtatggtggcgggtgcctgtagtcccagctacacgggaggctgaggcaggagaatcgcttgaacaatttctataggtatcagcgatgcacacatcatgaataataaaacctacctgtaattgtccacaaaacacagattcctgttaaaggagggtagagatcagctaggtattgaaaaatccttcttattgaaaaaaagaaaaaggctgggtgtggtggctcatatctacaaccccagataggagctaatatctataatccactttgggagaccaaggtgggaggattggttgaacccaggagtttgagaccaggctgggcaacatagggcgatttcatctctacaataaccttaaacagttagtcaagcatggtagtgccctcctgtcgtcccagctgctcaggacgctggggtgggaggattgcttgagctggggagtgaggggtgcagaggttccagtgagctgagattgtgccactgcactctagcctgggcaacagattgagtccctgtcttaaaaaaagacaaaacaaaaccaaaaaaaagcatgattttgtttggtctaagtccttaggtttatacctacttcaataacaaaataattgtggtgaaagaatcagatttcttaatgtcttgtaaacagttgataccaggccaggcacggtggctcatgcctgtaatgccagcactttgggaggccgaggtgggtggatcacttgaggccaggatttgagaccaacctggccaacatggtaaaacctcatctctactgaaaatacaagaattagccgggcgtggtgacgtgcacctgtagtcccagctacctgggaggctgaggcaggagaatggcttgaacctgggaggcaaaggttgcagtgagccaagaccaagccactgcactacagcctaggcaacagagtgaaactccatctcaaaaagaaaagagctgataccaaaggaagcttatttcatatggtatcagcaaatttcttattttataagaactctccattagcattatcatggtatatatttacagtaaaaagaaagatacatttccttccaaagttcactctccttttccatcactaaggaaatacctaacttcgatcttcacatagtcagtgccatactctcgaggttatggaaatgttccacggtttaaaacaatatagataattgtgaagtaggtatgcttatgtattaactctttgattctttaagcaattatgaatagtaggggagatacttctgcttcctgtaatgataaactatgtaactgtagatcaatcttcccactgaggaacaactaaaaatcttaatatcttccatcagttttgtaaaattctcactatcatcttttcatatacaaaagcagttcaaaggacattctctgattattgtagtgggttactaatctggcttctaaggagaatgggtcctgttaactactgggtgtttcatcttattgttaagggaggtgagtggaatctgcaagtttaggggcagagtaggaattgctctgtaaagtgtggtaaaagaaaacataaaagctgaatgttctgaggggaaagaaaggagggatctttggtgcccacccatgaagaaaagatgactacagagaagatcaatgacttaagcagaatttcaggtggtttcactgggaagcatacagtgtaaatctctcctcagcccctccccagaaatgtcagctaaatctgttactccttatttcttagataggagtaagttttggggtattggggagcacttagaggagagtttcaagaaaagaatgaaaaggtagctaatgggattatataacatcctacatgataacgcatgataaagactcaaatctgttaaatatagaggatggtgattatttgttaatgatcaatgtcagctgattaatgggaaataataggattaaggttttgaggaatagatttagattaggcatatcatggggaatttctgatgagatgactgtaaagtaggagtattatatcaaataacacttaaaagctctttctcagtgatggagagaaaagccatttcttggaaacagtatgggcagaaaatggagttggacaaagatcaattcagataggggagaaccctatagcacttagtgtcaaacccatgaaatcaaaaggtcttctttagtatctaactagttattcatatacagatgctcctcaatttatgataaggttacattctgataaatccattaagttgaaaaaatagtaagatgaaaatgtatttaatgctggcaatacaacagacagtcctcaaatgacgatggtttaatttacaattttttaactttacgatggtgagaaagcactgtgcattcagtagaaaccataaccccatcacaagttgtaaggagcttcttgacttggagttacatcccaatggagttatgtcccaaaagcataagttgaaccatcctaaatcagggaccatctgtgtttataaaatcactgaactttttcctgaagtgtcacatcacactacattgcacctaaggagagatgccactcctactctttttccagttttctgttaaggcagaaagataaaggagatatatactctttctcccatgctctcatagcactctgtaccttgctctatcccagcactttcactcatattctagttagtttatctctatcatgtctctaataaactataagcttaggatgatcaaggaaactagtcatctgtgcataccctgcagctagcaagcaaagtacctgaaatgtggtaggtgttaaatatatatataatatagttataaatttataaaatatattttacgttttatataaaatataaatattttacatgtaatttcaaatgaattcatgcaaggaggaaagaagagaggaaagtaaaaaatgaagaaaaaaaaggaaaagaaggaaataataaaggaaccaagaaaaaaaaaaatctcagttccagaatttagtcccaaagcttggaagtttaaagctaaagaacacaatgagggtggagggatttttcttgtatactagaatacagatgaattcaaagtgtcaaagaatgacaattaaaaaaaaatctgtcagatctttcaagataagctttagatgcacttaacaagtcaccctctaagctttaagattccacacctccctggcaaccaatgtaggatcacaagcaggttacagtgatgttctccttttgtgagacttcttgcagctgctctttgaatgagctgaaatctataaataactgcatctccagacccattaagcagtacattagtgtaacaaaggcatatatgtacagtactaaagaagtgaaattgttggaagaaaggaaaagtttccatttggcatgcaccacagaggatgaaaagcagacccaaccatttctcaaacatgaaattccattattggtttgtgattacatcctccacttttctactttgtatagcagccaattttaaactacaaatcatcatctttccatcttagagaggacatggtttctaaatgggtaaggttttacccacagcatgtctatctttgaagaactctatattgagagaaagagacagaaagagagatgacctgaaggcccccctctaaaaacatgcaatcaaacaaaatgaccaaatttgccaaggagacaactcaactagcatgtgcaggacagcagagaagaacaattttcttttggcacaaagaaaaatatcactcggcattacaaatataagtgtagagacatgacaagtaaaattatttttctcaggaaaactttgcttttggaaaaaaatatgctttatatatctaaattgaacaaataacaaaaaaaatcttgagaccttatgtataaagtgcccctctttccattaaaaacagaaaagaaaagaaaacaggccttgatgctactatggtaatatgtagggattggtaccatcggaggtttccagaagccactggagatcttgccacatatcctctgtggggaagggaggctactgtatgcagttttaaagtctttgtataggcaggttttaaagtgtaggacctttcacatttagacttctagagattttctgaaaagggcaacattagacttgaagacagtttatgaaatacgtaatggctcaactccttcccctcattcatggatatcaatcaaccacatacacaacctgctgtcatatgttgttgttttctactttccaaaatacacagaccataaaaaaaaaagtgatcaccgctagactttgctggtgagtaaattattcaagaaagcaatattatcagtaaacataagcctggatccattaaagctagaagagtcccattttacgcaaagcttttctaagcccctgggattcagggcaaacacatacaggttcatagagtaattcatcaaggtttgaagaatcaggtaaaacctgagtttatcaattcctacttctcccagataaacatgtctccaaaatgtttctgacaggcaactatccagcctcagctagtgatgggtgtggcagctcactgtgccagatagtcctaagagttcaccgttctctctcctgagcacctatctgaagaacaggagatctaaatctaaattctgtcctcaaaccctacctctgcagtgatatgtggtcttggaaagtgactcttctatccctggaatagggatactgaggcttaactaccatcttacctagccacagataaatttatgaaagtaactaaggacatatcagataattcttgcctccccctggtcaaattttttctgtgtttgcactcttgtgttcttttcacattcacattctaaaagttctaaagagtagacaatgtaaacagaatgttgtaactaaataaaagcctcaattaaaatggcaaagctatggactcctgagacagagcaagagagacaggaaagagtcgtcttgaggaagggataaggcctctgggacaagatttcaggtggatgtcaggcttcaaagatatagccatcaaaagaggtgaattctataaaccatacacatggcaacaaatcaaagcataattttgtatgcatacacagtacagaaaggcaatgttggtcacatcccggcctcttcagctgcactgatacacagaaagcaatttctgtaaacattattgtcttcttacataaaggaaatcagacaatatataattctataatttgtgctgttttgtgctcagctttttcattatgtactcattttacaccttgacccaaccgtggaaaacatattaagctagaaagtggaacattttaattgtagtggataaataactgacccttaaatggtggcaaactggcaaattagttatctattttccaaaaagccctggttagagccctttaatttatggaaatctacctgcaataaaacccagatcagaccaagaccagcctgagccagttgctcatcctgtttaacatttctcccagtagggtgacaaataacatattagttactctttaaacaaatgtgctcttaatgatgccactgccgcatgatgaataaagcattagccctgcagtcatgatcgccctgggacagggagcgttagcagaacacacccaccttgcatggattgccctgggtgagagactttgctttatctttctctaaatgaccacccatagcccttgctcatgctctgtaaccagtgagcaagaacagtggagccttgggtcccctgtgatggtcctttttgcttctcagggcctcataaatggtatggctatatcactgggagtaacccagaaggcatgatggggtagttaggggagggctatgggggcacaggagcctgatgcaaatgactgcacagcagcacatccagttggaaagttccagttcagcagtgagcattctgaggaaatgggtcaaacctttagtgctgctggttatatccagcaagatttaaatgaaggtgctcagaagagaaaaaggcctgagtgtccaaaaggtattcaggctcctgaggctagaggcagattagggggcacagaaaggtggttccaacctccaggaacatacatgattcagaagctgaatcctggttatttcttggtaaaaggtctttatgttctagctgcttttggaggtcaggcatcatcaaaagcaggaattggctacacctggttatctcagcaggccctcataacccagaaaacctccatggaggctcccacccccatcaaaagagatgagagaataaatgctgatggaaaggctccagctctgaaggcaaagttgaagggcactacaaaacactgttgctacagacccaaggcctttaccctctgtctgtcttggtcacagatttgcattaaaatgtcctccacccctaccgtcccccattaacacattctccttttcaataggaggagatatttgcctcttaagaatgccacataaaaatccttccttacaaggagatggcatttggaggactatgttcctcaaatagtctctttttctactacagtcttacagaccaaaggacccatctgcctctgagcaactagtctatttttttaactagggctgtgttctcaactaggcactagaggcataaggtctacaataatgatgaagacctgaaaatattttgtgtcaacatgcaatgaaaagcacactatctaaaacaaatatttaactaaatgtttataaattccatattatgacaattctaattatcaaatttagtattcacatgaaagtcattatagttgaaaaccatttgtaactgggctatctcactttgcagaaattactgagtgtgcaccattatggagaaattagagctggttttaaatgaaagaaataacttgcaggcaaataatttcaaaagcaaaatgatttaaaaaatcatctccaaagttcctataaacaaacttatactaaacatcagatgtgaacacacttgttatgtttgatctgatatggagtaagtaaatctgctgctgcctagaaaggttttaaatggttgtgttctgaggcactgtctccttcctgcctactgtgtgtaagataaagctatacttcctctcaaatttgccaaactcagttcaggatcgaatgccattccgttatttattcatggattacataaataattgtggaaaagaagaaggaggcatgagcaaaaattgaccttaaagaatacagatgagagagaaaaatatctggctcatggtaccgaatgcaatttcatgttagcttagagtcatcgtatgtatttaggttttattatttataaaaaagaaatcgtgctgaatgttctttgtgggaactgcaatatattgctattgctacgatggtttactattttcacagctagatggcttaaacccaaactaaacaaatattttaaaagaattcccaccagcattattacttttttttcgtttctagtgttaatgaaaaagatcttctgcttttcaagtcctctgatatctttactcttgagcaattctcaattttatggcttatgatgagataatgtttattgaaaaataacaacttaagaaaataaccagcaactagtggtggttaagcagtgcagtgtctgaagtgagggcatttgagaactgcagtggctgtcaactccaaatattcaccaggtcttgactattacggcaattaggatgatgattttattacttgcacactgaagtagacatatttttgtgtactcatccaagatatcaacttgacagtgtctactacacacagaattttgctaataagataaaaataaggtagatgtgacagtgagacacataatcaacataaaacaaaatgcaccatcatgtccagacttctcactgtatgaccaaacccttactttaataggggtcaccaccttcattcaaatgcactccccaaactcttgctatcattcttaactactggctaattcaccatccttttctctagggataaaatttgcacagaaatgcaatgacacagttctcttcaatctgagagtaaatatcaatatacactagagaggtggggatttttttgttttaaaaatattattgctgatacatgtaatgagttcaaacaaagctaaagtctataaagtaaaaggggaatgccattccgttactccttatctgccagccaacacactccccagatggaaccgctgggaaaatagctccctatacagcagtcactgtggcaagaaactcacatcctcgatctcatgaaaaagactcacaacaacctatgagatagatgttattccaactttttacaaaagaaaataaactaaggtccagaaggctattcctttggatttttacccaaggtcagaaagccaatgaatggcagagcccaggactcaatgtaccctagcctggatgtctgttgttacagatttggggaactccaactttctcccacaaagagtcagactagaaggttcctctgggtttaactggctctaaagagagaaagaagtctagggtaaaggttagttccatccctgggggtagatttatttatgcaacatatctttataagatgttgactgtatgtagcactgtgcttgataccaagaacgtaatagtgaacaagacatagaccctgtcttcaaaaagtttgcaataatacagtcaggtaactaaacaaactaaaaagtaccagcagacatgaacttgctatagcatggcaaattagatattcttaggaacatgcctcttataagaaaacaacaactagattctggataagaccacttatttatgtattactaggctttctactaggcttggtaaaggaaaccctgctagacatctgcttctaaaaagaaagaaaacaaaaaaagttggctgaaaccagaaggatgagccaggagtagtaagttgcttggagggaaagtgccaacatcagcaatgcaccaggagatagcctgtcatggcaaggtcaagccctggtctgaggtttccatggcaatcaggacctgaagatttgttgcacctttacatggcccttaccccagtcagccttctcaaactctcgacttcagttttagaagtaggcaagtgaaagaatctgggcaaaccagcagaaatcactgctgaaagacaactcaagacccatgctttattgagaggcacatttttcttaaataagtcagaataataattgtgtacttagagaaagagagagagagaacaaacatataaagtttctacctagggttgatctgtaatccaaattgggcttaactcagtccaaatatatatattgagggcaaactgatggtttaagctgagagcttgggataaagaaggtataaacatcatcattatcaaggactgtccaggtccattctccccatgtcaacagcttctatttgcaatctctaaatcatccacaccctcaccacaactgtactgcctgatagaatgcactagtgagtgaggcggatggcaaagtagaaaggctggtcccagctttatatatagaaaggctgggaggtggagtcaggttactattactttttcttacctcatcccctttctgccagaaccttcttctgttctacttctcttacttgtaccaaatacactctctctaacacgagctatctcatcatgttggcagctagctacaaggaagaggcctggaatgcagttctcctttctacctgtcattgggaataggagctacagaaactagggttggtgaggcgggtggggggtactgtggaggtgggtaaagccacaagctggataaaccagaaaacccaacttctaactcctattccaagggatagctgacattctagaggtgctgaaagagtgaggatctatgtcagttatcatgtgggacactgaaatcaaagtccctctgcatgctgattagaatcatcacccattgtggcggctattttttcattctcagtagagacaaactgaaaccctgagaactgatctgggcaagtcgctttctctgactctcctaagaaacgtgcacagcagtttggcagcacaatttgcataccagaggagagctcctgtcacaagtaccctgtgggccagtttcctgagcttttccacttgatgctttcaagcctcatctcacgagtcattggagaggctaacgtataatgccttttggaggagctgaaaggaataaaacattactagcaaaacggtcatatattttgagagttaaaatctagatccctttagataggccctctgaaagaaatgctttcgactacgatggcagcagcaaaaactctgttaaggacagcttcatgagcacaacttcccagccactattcccacctgaaaagtacatattctggtctgcatttttttttctacaagtattttgctttgattcattgttgatacacatgacagcagaataataaactaggtagtttgagcctgtgtgtgactgggattcggcataagcatcacaattttggtttgtaaattcctttggttcagtagatcaaatggggaaagacttgtgtaatgtgaaattcaatgaccagcaatggcagggatcttttggatatgtaatctgctgttggagccatgcttggggaccaaatagatgagcaggccatgttaggaagggcagcaaggaaaagagaaaacatgaattaatattaaaaatgtgatgcaaaataaaatggaggttatagtcatatccttccaattgtattgagctgaaattgtttctggatttggaagctccttgctaagctaaattgcaaaaataagattatatgaggagaaaaggtaatttccaaaatataataaacataatacaattactgcacacttatatatgaaatccagaaaggtatatttctttcacgccatgtgatcacagttttgttacagttttatgttcttattttatgctttccactagttttcttgactttgcatattcttgatgcaaatcagtgaatgcatataaagtgtaaacaataggctctcaacatggagcctacccaaatgatttaactgtgtagcattgattatcttgtccactgtgtgagcaacgtgcacaaaatatgcattttgtatgttacggaggtcttgctgatgtggatgaagaagtgtgagaactaggatggagaagaagctaacttcaacagtctactctttagtgtcctccctttacataaaacaaaacaaacaactgatcagctactagtaatcaacaaacttaaatttgctgagaggaagtagttaaatagcaataccaagatgtagaggttagggaaggttgttttgcccctgcctattgacctacatatactgaagcaaaattggaaaactgcagcatatttggtcacaaggtctttctatttccattcataatttcttttctttattccctctttttttttgttcttcagagaacacctttcttgatatgggtgttttaaaattctgatcagaactggcagtgggaaaagagctgaggaaataacggagactcatacttatgtgacacattcacaaaccctatgaatttttaatgaaggcacaatgtccacaattagatttgaaatgaggttttctttgtaggcgctcttacagtaagtggagtgcaagcgaattttactttatattcagtaaatgataccaagtgcaaaaaacactacaatttaatagaaaataaaaacaaattgttgattgttcatagctcctttttcatctcttagatttacaaaagtgtagcagttaaaaaaattgcatttcgttttatttaaataccacatggatgccaaggcaactcaaaggtatagaaagtcattttcagtcatgacctgaagctgtccttttgcattgtgtggagaagtttttgtttgttttaaactgtaaaaatgacttctaaatgtagatctttggggagaaagatattaagcttccctatttgcaaactaagccatttcaaatgaacataaaaaaaaaatctaatagtgtagaaaataaggaaatagagtgggctgatggctacttcgtttgcattttgattttaaagcttaactcttgtcttcatagggcttaggttttcagcttcgcagaaacagacacagtttcccatccttcttaggtggtttccaaagtccttcagtttctggctcctggtcaccttggcaacatcatttcctaaagctgcttcttctcttggagctcccgcaacacagatgcttttactcttccttgagcctagcaagtgtgatcttctcttagtgactctgcacttgtggttcctccaggtaactgcgcaaccaccctgctccctcacctgggcccttctctgacgaaatgtcatccctgacctctacctaaaatagcaactgcgtcaccttctgtccttctactagccttattttctttctctctaggatttcttggcatctgaggttatattacatagttatttctttgataaattagtcatccatgagggcacacttatttttaaccttttaaaaatgtttttcttggtaaattgccatcagccaaaacagtgcctagtacttagtagacacacacccttccctcccacatacgcaaattcattgattaaatattatgagtgggtgtatatatacatacacacataaatatgtataaacacaccgtattaatcattactgtttgattttctatattcctgatgctttgacatatgggtccttgctgacattggagggatctcccctcccagggctagccaatccaagagagcaaacgcctcacctgggagcacacacgtcataggcaaaccaaccaatccagatcccagaccctcgaacacctcctttactggctctcagatgctgaaccactattcctctggcctaatcaccccggagccaagtataggccttataccccagagcttaaattattcaaactagcccatcctacgcctgtttattccaccttgccttgcctcctgttttgcagaaatcacaataaaggcgctctcacttcctctcccttctgactgaccctggcgcctccctgtgtggctcctcgttgtgtggtgtggcaagcttccttctctttggaactgtgaataacaaactatcttttctatggcagtcgtctcctgatctgttggccttaccacaccctataataataaaaactgcattttcaaatgcaaacaaataaacactcaaataaaattcactgtattttcaaggacaatgaaatatagtaatcgccagaagttatgatttttctggactcataagaaataaaatcaggcagggtacagtggctaacacctgtaatcccagcactttgggaggccgaggcaggtggatcaatttgacgccagttcgagaccagcctggccaacatggtgaaaccccatctctactaaaaatagaaaaaaaaatgaggtgggcgtggtggcgcatgtttgtaatcccagctccttgggaggctgaggcacgagaattgcttgagcctgggaggcagaggttgcagtgagctgagattgtaccactgcactccagcctgggcaacagagtgagactctgtctcaaaaaatgaataaatacataaataaaaatagaaagaaagaaaatgactttgacattttaaagatctgtgtacagtttcaactccgtctcagccctgagattcatttatgaattgcttttgtggttattattgttgctttctactttcgccctttaagtttttttgtttatttatttcttttttttaagggggattcagacactattacctcaaaggagcagcgctgccttattctttttgctagatacaaatcgttaaccctattcaccaaacagcaattaattgtcaataaaacacatccacactgtgaactctggtgtcaacgtaggcttatcaattgtaacaactctgagggggatgttgatatgggggagaccatgcatgtctgaggtctggggctatctcttagtctgtttagggttgctataacagaatacccgaggccaagtactttataaagatttagctcatggttctgcaggctgtacaaaaggcatggtgccaacatctgcttggcttctggtgaggccgtttcatgctgcatcatagcatggcagagaaaatcaagggggaagtgaacatgtgtgaagaggcaaaacctcaggggcatcctttttataataacccactctcatgagaacattcctcagtgaactaatccagtcttccttgagcgagaactcactcgctacttcaagaacaacaccaagccattcatgagggatctaatcccatgacccaaacacctcctattagacccacctcccaacactgtcacactggggatcaagtttcaacatgagtgttggtggggacaaactcaaaccatagcagatatatgggaaatttctgtaccttctgctcaaaattgctgtgaatctaatagtgctctaaaagaattgtcttaaaaaaatacatacacatatatgtttattctctttaaatataagaaaataataaatcctatccataatttcctaaattatagttagctctaaatgtaataagaacacatttctatgacgtgatgcactctgagttttttcaacacatttgttccttttttattccaaaaactatggttcatgttgttccatggccaatttgccagatgcttcaacattccctgctggaacgcacctcagacagggctaagtcagggccttccaggggcatggcaaccatgaaaactgatcctgggaaactgacctttaatatattttcatagtaagctcagaggaatgtgctgggtgattacccattacttgtacctggtaaggacacaggcctgaagctagagtctttgcacagtagagatgggccagcaagatataaagatgtccacagaagtggccaaggaaaccactagaatgcactggagggagcctcaatccagtcagttgctaacactggcagtagggccttccctgggatttgatagcctatgcagctgtcttcatgcagttcagattcatgcctcctttacttaccttacagagctcttgccaacatggtcaccctggtgacaaccatgtgctctctaacagaaatacctgaccctgctcaaggtattagaaacaataagagaataatttttaggagacttgagagaggtcttaaaactgtgctcatatgctttttttgaaaacatggttttcaaataaaagcaagggttgagacatccaaggagctagtcgctctccctctagtccttcggccttcctttctgcctggtgttgcacattgcctcccacacgccagtgctcacagctgctccactgtgggtgtggctgttccttctcttctctatgcttctctctttttaggctcatataaaggcccacctcctccaagacaccatgtaagatcaattttctacaaccacttgctcctctgaaccccagagttccccaagggtggtatgtcagaggatttaatgtgggacccaacaccattattttaatttttaatagctatatttgctttgagtcatgtgaaattgatgtttctgtggatttaaaaaatggtcaaatattggcagtttcatgtagttcaacctaatatgtgtcagggaaaaaatattaaaagaaaaccagacatcattgtttaggatgaggctaaaatgagtactttattgaactgtgtaaaaatgaataagtaaataaacgttttgatggtacagatacagcaaaaattattaagcttgtatccactactgaaccactgaccaaatgtattttgacaatcactgttctacgtgtccttttaacgtgtcttattattgtgtgtgtgtggtttttttttttttttttttttttttgtatatctatgtatttgtgttttctcttccattagtttcctggatatttgtacacaagaggcaaggagagattacaaacctcttagcataatacccggcacgcagaagacggacttgacatagggatttgtctggtcacttatgatgagatcttaccaggaaacaccatttgttttccttatggtcattctaaaactggaaactgatgggccacgcaatggagtatgccattccagccaggaaacctacaacctggagcaaatgaaaacacaggactcctatggagcactccacgctgggagctaacctcaccactgggaagcattaaggggtagtgtggcctgttggtcagaacatgaccatctggactcattctcagcagtgtgattgtacattacatcctccacttctccattccaactgacaatgccaccaatagctgagaaagtggaggccatgggaagctggtacctactaggatatcctattggctcctgtcctctctgcccagttactgaccacggcaccaagcttcagattctgtttaatactgtcctttacacaatggtgcctgggtcttttgaaatggatagggataattatgattcatatgcttcaagaaataaaccacggtactcacacaacctacatatttcatttctattttaaaaacacaaaatacttacatgctgttggtgttttgaaagcttttgccacttatgcttttttaaatataatggttcagaaacaaaattctgcctgctaatcagtctttatttccattcataaaaaattatgtctccataatacctaagaggtcaataactagatgttgaaacaaataatattaaagaaaaatatttattgtagaagtctgtggttgaggcagaagaaaggtgttattttcatctggggtatcaagaaaacaccatgaatggagaagaatatggtctgagtctcaaaggattaaaaaaaaaaaaaaaccaacctatgtgggaagagagacagagagaaagtgcgcaggcagctcaggcaggaaatggtaaactcaaatgtgtgaaatcgggagcgttggaggctgctgaaaggacatagctgcctctttactattttacatttaagtcaagttattcagattatattggtctctgtatgtatataatgacaatagtagttttattctctaaaaagttgctttgagaaaaatgtcaagggatttaaatgcatgcttccaaagtacaatgttttcctacataaagatgctggtttatcaactagaaaactaaagtgggcttctttataaaagatagactgaaaagattaggaaagtcttgacaatataaacatacatttactcaccaactcatgaaatactaaaactaggttttactgctcaaagaaagcataaaatagatcatttcagtagaaagaaaataaagcacattttttacaacatagaaagtaatctcagaattcattaaccaagagaccaaaaacaatacctaaaatattatatatgttaagggagctttaaataaagtcatggagagcagatttacaatgctttaattgaaccaggataggaatggcaggagtctgttcacaacctttcatggcagagaagagttatataacagccttgatattggccagctgcaaaaaaagtcaataacaatatgaagatgacaggacttttggaagaaagttactatacagcttggagttcataatattatgtgaggatagagaacattaattctaatcagatccacatcattatttacagaaaacttttttttttaaggttcagagaaaatacaagtgtgatataaacacacaggtatcagggctaataagtgtaagagagatttagaaaaataaaattttgattctataactggatagtcataatcctagtgaaacaaaaagagatgccactgtagaaatcactatggcttacaataatttctctgatgaattttgattctaaaatgacaagtaataaatggaaccaaggacacgagggtaaagacaaacaccagtgtgtgggaataattcctagaagaatgctgaagaggcctaaatacaggactgggatcgaacattttgaaaaaacataccaaagggatgtttatagaacatattttttaaagtcttcaaaagaagaacaaggaaaaatagcaatacttttggggaaggccattaacaataaatagcaaagatgacagaactgttcaactcccattttgtgaatccacccctgcaagcaaaataatccgcacattgggaagggtagaataaacaaaatacgcatggaatttcagcctgacgtggtgatggggggatttactcaccaacccagagctagcatcagacattcacagaacaagccagtaagacccaatcctgcaaccaacataatatgacactaggttaaatgcttccactttcctttcccgaaaatctgagcttgtggcaactttatcgggattcaatcatttgaccttgagaacttagtgcaactatggaaatgacccataatgactaccggaattccaaagagttggtgccagttttagaatgacaacttactaggtttgtgacctggggcaaaagatacaggatgagactgattttcacatattagaagtaaagcggatatagaaggtgaactagattagttaagcaatacgccaaagaatggacttagtgccaatggttagggtttatggcggaccgatttcagggtcatccattctttttcccattcattcagtgaatatttagtaacttccactgtgtgcagcaccattttaaattctaggtgaacaagaaactcactccaaagaagggagacctggaaaaataggtcagtataaagcagataaatgggtaaatgcattaaaacgcaggttaacagaaacaacacagaagaaaaaacaattaactttgaaggtaattttagattttctccaaggttaaatagaggaaaaaattggtggggagggataataaaacaccttaaaatgtgtttcaggcatgacaacactatgatcaaaaatacttctgtgtgaaaagtatgtggcatgatacagaaaatgagtatttttgtttggctgtagtttaaagggaacatggtgaaaaagtggagaacgatgctaacaatgtaggcaggggtcatgctaaggagtttaattcctacaggcaatggagaccaaatggaatattttaaatggggagtgacagggtcaaatttgtaatttagagcaataattcttagagaagtacagagtaagctctacaggaagacaagcctgaggagggtaaatctatttggaggtaattatgggagaccagacaagatgaggcagtggcagcggagatgaagagagggaacagatttaagaggtacttctggagacagaagagatagcaattggaatgtggaagtgagagggagtgagtgacatgtgtgagggcccaagaaggtaacattcaaaaatgaatcccaggtttccacctcaaaggaattgttggataaaaatagggatttccatggcacaagaacacttaaaggattagtttagttcaggaggaaaatgtaagttttccacagagcaatcaaatgcttcaatattaaacttacaaaccatacaaaaatgtatctgtcccctggatggctatttgcttccctcagtagccacaaagctatgttgtatgcctggcacacagtggctctcaacctctgatgggcattggacttgaatcaaattgcctgaggagacttttccaaatgcatatgcttggtcttcacccccaggagattctgatttagtggatctgatgtgaggtgcaggcattttttaaaacagctccaaaggagattctgatatgcatccaaatctgacagccactgtagtatacagtcgatccatagctctttgagtgattagttaaaaggaggaagggaaggagagggcttcttgaaatttttgaagaagcagctggttgactttctatgctcaacagtgtattattgtgtgagaaatttactaaatgaactttcctgtcttttaatctttttttttttttttttttgagcggagtttcatgcttattgcccaagctggagtgcagtggtgcaatctcggctcattgcaacctctgcctcccacctcccgggttcaagcaattctcctgcctcagcctcccgagtagctgggattacaggcacccgtgggtcacacctggctaatttttttgtattttttttttcacttttttttttgagacggagtctcactctgtcacccaggctggagtgcaatggtgagatcttggctcactgcaacctctgcctcccaggttcaagtgattctctgacctcagccaccacgcctggctaatttttgtatttttaatagagacagggtttcaccatgctcgtcaggctggtctcgagctcctgacctcgtgatctgcccacctcagcctcgcaaagtgctgggattacaggcgtgagccaccgtccctggccttcctatcttctaatcttaagggtccacaaatgtgatgttatagtgttcctggcttcaacttgcagacagaacactggctgagagattactggactcactcaaattcaatcttttcttatatttttttacattattgatgaacatcccttcttatagcaactcgttctttaacattttttgtgtgcttttacatatttttcatttacttttttctcaatgtctattcctcctactagactgatgttctatgaaagcaagcattctgtttcttttgttcactatcgtgtatgtaagcactgacctagcaaaacacacacgttcagtcaataaatgagcaacgagccagatttttctggtgaaacatttgaagccacaatgcattattttcaatatgcctataggtacatccatgagtgtattatagattcagaaaatggtttcagaaataatcaaaagcatacagctataggcaaaacatgtttatatatatgtatattttttacctcgaggaaacctttgactcccaaaatttttatgttatgtaagacagccccttacatcagcaaataaaattaaaaatagggaataaatatctaaaagggtgaattaggcacagaggtgtagcctgagaaatagaagctaaacctcgttcctgttccttatctattaatagatctcagaagcctgaaccttgaagtctgataaatctagagctttcctgtcatttatatctaatgatcaattctaacagttagacaaaaaaccactaaatgaatgaaaagatgaattattgagaaacttagagggtcttttagcatggcaattaaagaagtagaaacaagtggctaacttgaagagccagaaatgttaaaaatctctgtattaatagtgattactgaagtgtttttaggttccaagttaaacatttgctgacactgcttactacaatatgtaggtaactcacgacatttttaaagacattttactgccctgagattgaatgtgagtttttttaacaaaaaaattatcaaaatcagaattctactttacctaaaatttgccaagcaactactatctgctactactttcgcatgtatcatctcatgtagtttccataaaaactgtactttaccaatcagaaaactaaaaataagagcaaccttagatgaatgcctaaaactagaatgctataaaaagtgttaattataatacaaatcactgaagtatcattttatccaggtaaatttatacatatgtataaaagtgtatttttaaaaatactaaatatgaacctcaatcataagaatgatacaagaatactatgttttgattaatgataaatttggctaactggagaaaacattgtttcaactgatgttatcaaacaggttttgaaagcagtaataagacacattgacatgatatgcttgatacacttgagaaggttacaccacctctgtggtattcttgccaaaattttataacctcaatttaatcatgaaagaacatcacacaaacccaaatcaaggatattctataagataaccagtacgcttcaaaaatttcacagccatgaaagacaaaaaaagactgaagatctgtcctactgatttctgatatttctaatgtaagatcagtagtcattacatactattggttgtataaatataggcctaagaaattggaatgattccatgttgcatccagcgtattaactaagtgttatgatgcaaagttgtttgtatattagctgcaatttcccccatgacttataagaaaaaaaattccttattaactaatgactccagttaactgattgaaattacattctactaagctaaatatacatgtcatttcttacaagggctgtatgtttttataaatcagtatctcagctcgaattgttggaattatcatggttacttccattgttcagacaggaaaaaagacaggagtagtaaaacaaagggagaggggccatttgcagcaaggagaaaggaaacacgattctaaaacacattcattaacccagggctactactagatgctctaggctagaaatgaccaggctgcttctaaacagattttaatttttaattcagtagaataggtcagatacagctctcccacctggaggtcctgccctagaacctacctgcccgaaggcggcactgcgggtctgctggtaatcatcatctttgggcaaatgaaatctccagtcagctacacccgctctgtatgttgtgatcccaagaaccagtaataaaagttggacaagatctcacaatgaagtggaggttttctccttcgattttttttttttaggagcaagaaagaacacttttttttttaagccattagaaatgtttttaaaggtagaggtagaaggagggatgttggtgtttgaaataaaattctaataaataaagatcagttttactacttaattaaaattgggtagaggcatatatgtgggtccaaatttgatgctcaccatacaaatgcccagacacgagagagatctcctgggaaattaaaacgcctacacgtagggagaattgaacagaccagggccccagagcctccgcacatggagctaaaacaagcatagaggagccgagtcggactgattccccagctcttcacagcccccagattagctgggtattagtgcaggctggtctcagctgcccatgaaaatgagaacacattttaaaacctgcatttgaattttaaaggtactcaacatttctagtattgtttactgaaaaaggtcaacactcaagtgttttatttatgcacggcagaacctcagtctaaaagcactaggctttccatatggcatagcctgagaatgtgttaaatatgtagttccagagccaagaatattatttttcaacttagcgaatgcattattaaaagacctctgctgtgcccaccactgggagatagggcaagaggcagcagtgaccctgcattctgaatgcacagagacactgacagtcactcactctaaataccaatgacaatatccccaaacccacaccaccctaacccatgccttgctctgaatttgggcagtctggaaaaaatgaaaatggaaacctttaaataaaactcataaaacttcagttccaagcacaatatttttggttctttggacaataagtgtttcactgagatttatgcctagggtccttttccatatcccggctctgtgtcagcgttcacatcagccctcagttcttcttgcaaatcaagggtataatatactgattccttcaaataatatttgtgttaaaatcattaaatgcccatgcaagtaattttttattaatgggatgagaaataatacataatacataccaattttatgacagcgagaggagttattaactttagaatatctgttgtataaattaaaaatcttaagaataagtccagtgttttaaatatactatggaaaaacaaaattaatgccaggagaattttgactggaatatagaaatgcctttatcattctgggaaaaatactaccctataaaagccacatcctctgataagttcagaaattatcctttttatataaatattattcacttggaaaaatgttttctataaacagctcccttagtgcattttaacacatacttttatttacagacattagatttacacatgtttccagtataaatctttcgtatatagcaaagagaatctgtgaccaaaaattctgttcaattcggatgtggggagcaaataaatgaccaatgttcccatatacatagtaatatatggctaattttatataacatgttcacattaaaaataagaacataaaaatttttaaatcttcaggaactgtcttcaggaaatttcagaagactatgacttttaaattacgcttttacttgatccaccttccaaaagctcagaatccttatattaaaagagctggcactgacataatttgatttaatcctgtaaatatgcatggaagtcccgatgtacatcatctactatgctctgcctgcgtgatgcaaggtgaatcaggcaccatccactgtccctcttgttaaggagtccacaactgtgctggcaggacagacacgtatataactgattataatgtacttgagataactggtatatcccggtggtgggaataagaggctttggcagcacacggagtaaagagcgaggatcctggaaggcaacctgcatgtagggagagtggaagctcacccgaggaggtgacatttgagctggttgtaaaggaagaataggatcagaccaggcgaaggagaggcattccaagtgaagaaaaaacaattatccacacatgccaagtttttcagatttgacttttagaagcgttttacttcaaaaaggtttaagtgtgcaatgtctaacaagaagcaaaaattacaatctagattgtttctttatgactagcctgctcttctcccacggatcctagctgtttaggaagtacaggtagtaagaagaggatgtgaagtactttggtagccacagagaaagtgagaacgctgcagtaactgaactaaagattagaattagcactgtaggcctgtgagtggggtcgggggagctaccagtgaattgaggaaaagcaaaagtgttttaagcagactgcaatagcaccccttttcagtctgcttaaaacataagccttaaccttcttaagaaagagtctgctaaaacacagtctgccaggcctatcaactacagggtctgcgaggaatttgctctgagctgggacctgttagtcatcagcaaggagagcaaggagagcggatcattttctttcaataatttaatcacactggtgtgagtggaggtgaaggctgagctgcaggcttcatattctacttctttcacagacggcaaaggaagagtagaaaagcaaggtcccctgggtggacctggagagagaaaaaagttctgggacatcccttgtcttcagctgggttctaggaaaaggccaggggtgacaatagctcaaatgaagatggccggtaaatggctgagaagaccaagaagacagactgtgacccgtttcacagtgcctaactaaaccagaatttcaaattcttaagttagctagaaacatatttcatttattcacattttaaaaaaatcaagttaattcattcatattggcatttaaaaaacgtgtataagagaggtacaaaaactgaattgtgttcattgttcacctttctttgagttctacatacagagtcaagttgtaggagggatgtattcaggaggacaagccttggggatttcactcttttattattctctgtataaaagaagatggtttgttggatccacgtgccacccgtacctcttccctgggcatgtggccacgaggcagggggcagaagctgccctgggctagggagacctgggttctggcttccagttctgggtctgccactgacccactatgtgaactcgggctggtcacagttttctcaagtaagaatgagaagcaaggactggactggactcttttcctggctgttttctgctccagtgctttctgattctatagaacaatactatgttctagagaaatgtttccttctttctgggttttttttttttttttgatacggagtcttgctttgttgcccaggctggggcacagtggcacgatctcggctcactgcaagctccacctcctgggttcacaccattctcctgcctcagcctcccaagtagctgggactacaggcacccaccaccacgcctggctaattttttgtatttttagtagagatggggtttcaccgtgttagccaggatggtcttgatctcctgacctcgtgatctgcccgccttggcctcccaaagtgctgggattacaggtgtgagccactgcccccggcccactttctgggtcttatacatttcttttttttaaaaaagccactgcaataacaacaatgtcccatctagtgttaaaacagggaacatggtccaggactgcagaatgaggaatggcgctcaggtctttcctggcttgggggttctgaatggcgattgaagggcatggatcctgctcaggtggtttttgttggatctcaatgacccaactttttcaaagagggcattttttaaaagactgtgttttacaacttttatgtgtgatgtacaacaccagcataataggaccattaccaagggcacatggaacaatctttcctattatttttactggcagctatcaccaaaagcaaaagagcctcctgggatgcaggtcatcaggcagccccttcctgggagataagaagagattctgggtgtgacgcaagcaattcagctaagctctggctcctcactgaaatcttcacagacataaacctgggagttctgcagggtttaatcagttcagccttcccttttcattgctttctttctgaaagctcccacgaggaaaacatctccaatctgggtaatagctaaccacacactcagaactttccaggttccacagtagtctgtctcccttcttcctaaatgccaacccacaagaaaagaaatcaagggagggaacaaatgtaaatactgagacaatgcaggtatctttgaaacaaatgatcatcttccttcttgtgggtttgtcctgtgccttgttttttttttttcattaagtgccaagacaatttaatttgtaaactgccatataaaaatggcctcattttggaatctgcctcccttttggaacccaggtcagttccgtggaatatttgtggagtgactacagcatgccagacactgtcttaatgatgtctgggctgagagaacaaaatgagcctggactcagaaattctccatctcactgcctattgctcagagctttgtggcccagattaccagaattttcagtggcaaggatttcctttttttttttcttcttaaacctgagtttcttgatggttgaatacatcccagtggctccttatcttctagaatgcttaaatgcctactgggctgatggctctaactcacccgcttgttaacctgcgttgatctctcctaactggctacctctctatgccctccatggctattctgccttctgggcttaccttctagtcaaatacttggaattctcctgtttataagccccatctaacttctgcccaaccttcagccttggcttgccagtttaatctgtctctactgtgatccacatccccaaatcagcttggttctcatgtgccccaaattgtccttaactccctcatccaacaatcccatattcctattccacagtctccatgcccatcctgggggcacagtactctttgactaaagtttagaatgatagtctctggtcagtcctgtcctaccagtcaaaccctaatctcaatccaggtctggaagctgcgataatcttgagtacaatacgaactggtaatcagcaagtggggtagctcaaacagaatactggcaaatgaaatttgccttagagggccatgagaacatagtggcctctgattaataccaaagaaagaaaacatctagaatatttcttgaacacctagagtaatgcctggtacaaaataggagctcaaaaaattggcaaattatagaaagatgtcttttaaataacacattgcaaatgttgaggatatgactgtctattgtaagattcttctggataaactgtctgattcgtgtgtatatcccaagggcccagcacagtgcctgacatatagtaggcttgataaatatttgctgaactgaaatgactttgttgagaaaagtatgtcgatgtcacttggtggaggatatctacttttccagcagtgtggatgagcaggacatcttaggatgtctaaactaaaggatcagcttggttgggcccctaaatttacatgccaaggtgttcttaaggcactagagtatggaagtctatcagatggacagggaccacaataggagaggggtaggaaccctgcaagatagtctgtgccctgacttacattccctgtctactggaattctctggacctttgggttttatccagaatgcaggagatctttttgacacctttttcactcattcatatgcaaaagcagaaatctgggtctggccaagcatctctgatgcatacatgaaatgtacatgagcataaaacagccagctatagcccttctaatggagaccttcatagctgccataacagctgatggattggtgtaaggctagtagttttgaagttatattttgtatttattgttgaagctatcagaaatgtagagaacactgaggtcaatcaagagtatatgattttccaagtatattaaaatgtgtttgtgttcctttcatacaaaacataaagcatccatctttaaaatgttcacagcaatcaatgcctttaattgagcagaaaagcatatacagatatagaaatgtttagtcctagccgtggttcctgacaatcatcttcagagataaatttccacaatggatgtttcaattaagacagtaatatttattgaaaggtaaaccataaatgtatagccactggaaacattattgaacagaagtaatttatgctgcagctggtgcactgcatttttgcactgctttgattttatcagcatttgtcaattaatcaacatgaaccttgtaaaacatgttctcttattagttggaacaggcaattgcttgcaaactttgcaggagaggtcatttaataatttgctaattgtgcaaagacagatttaaaataaaaataaaaaaggttaactctcattaccattgtacctaaataggactttgtttaagcttaggcttgccaatttaaatattgtcaatggtttaatttttaaaaaaacttcaaacggcaaataaagattaagatgaagatcaacttagctctaggtttttaaaatttaagagcattttttgtttgcatctttgccatttcaaagagttactagccttgaggctatagttataagacaaattgactatattttattgggagaaaagtgaagagaaaaaagaaaaagcaaaagaaacaggaaatgcagcagcacaaagagcaatccagtagtacagttcttttttttctcccccttttttgcctcaactcattcttcattgatctagatgagatgtcacctccctacttttgactgctggttcattttcagttcagtaagtgagaaagaagctgagtcaagccctctctttgggtaattcatgcatcagcacactcgccaactctcctggcaaccaagaaagcactttaactcagagcggcatcgccaccaacaagcattctgcagccatctaaaaggacgcaactgagtttaaaacgggtaacataccttggagagcaatttctacactggggtctgcagggctgaatcgagaaatccgcaccatcttagaagtgtaagtgaaacttaaaatgaaatggcatgccttaaggcatttataagagtaagaattttgcacagagttcacagagacaatgtttgttgaatgaagatgggccttgccagatacagtctaggcaaagtgctttgctgcagagctccttttataagagtttagaggcccaagttgctctctgcctgttcaaactggcttatcaatccattccattccattctgttctcagttctaaataagtcattatttcacgcacatttccctaagcagacgcaaacactgttttccagtgtgagactcccttgggcaaattaggtttcttggaaaagggtcaaggagcgatcaaacaaaatacctcctagaaacaagtggtttcaggggacattgtgatttatgcaggctacaagtcaaattttagacactggttgggcagtaatgttgaatctgatagggctagttatggggagcaaaatcctgctacctgcagtttctttttaaggtaataataaatgggcgtatttcttatggaaacaaaactgatgatcataaaacaatcaatagaaagtttccttttctaatattttgaattaaaaggtgttaaacaaattttaatttcttaataaaattgtagtaaagtaactttcataaggcaaaagttcatatcttctattctcacagtcttacctaacaaacatgaaatacttctaaaatagatacttcttattgttttttttttgtttgtttgagtcacagggagaaaagtcccttttatgttcttttaatacttgcttttattaacctcagcttcagttagctcacttccatatatcaagattctttctacaaccgaagagacaagaggtaaatgcaaatgtgggaagggaagctgcttggtaacacactagctgctccctggcagcagttatttctatctaaagcatatataccatattaagaggccatagtgaaaaatgaaaggatggaacggcaggttttcatttgtttttaacattttagaatgctgtaaataagtttgtgtgtttcaattcaaatggttccattacctcggaggccttaatcatttgtaatagcaatttcggaagcgtccaaagcttgtgcttaaggagtattattggcattcaatatagtcatatgatattaagcagatttacaacgttctatgtggttatccctgatcatctttatttaaaagtaagttctggctgatgaggtggcttagtatcctcatggattttggcttgttagccgtcccctgccagaaaatctggctctgctggacaccctcacacctctccaaataaaccttaaatttgcaaggtgaagtggggggcagcagatggcaggaagagttcaactaagaaagaagtttacaaaggcagctttttaagaaaatgtacctggggttttggttttattcaagtacgacgaggccaacagatcaggaggtgactgtcattgagaggatagtttgtcacagttccaagaagagcaggcatgccagaccacactgggctacctggggaggcaccagggtcagtaggaggcagaggaaatacggggaaaatgtggggaagggcctttattatggtttccatggaaagaacaggcaagacagagtaagcagctttaggatagctaatttaaataatttcagcaggctctgtggtatagggacggttcctagttatgcagtacctggccctggagtgattcagggcaggtaaatagtgttctggattgcaggagcctgataaaaggaagcaggtagtggcgtggactcaggattggttggtttgaatatcaaaggcgagctcatgggcaagatgtttgctatctctaggtatcagctgacccaggaaggtttagcatcccaagtccacaaggccccaagatgtcaaagcactgtaaaatacagaaaatttttaaaaacaacaacataattaatagaagcctgtctgaaacactgctataagaaacatgaaaacagagcttctgaaacttcactgtccacagggatcacccgggtattttgttaaactgcagattttgattcattaaatcaggtaaacgttgagaccttgcatttctcataaacttcttggtgatgttgggaccacattttgagtagttagaagtaaaaatatcatgaagggtcttctctctggctcatcttcggtcaggaaaggggaaggaccttacataccgagtcttaccttggaccagacgctgcaaggcactgaatatatatacttggtcttattttgctttaagagcaaactttgctagtgggaaaattatcccaattttataggtaagggaactcaggctggttaagtaacctgctctaggtcatttagttaaaaggtagtagatataaatgtatctggcctaaaaatccatttttctcccaccacaatgtaagtacacagggcactcctctgatggaaaatgaaaagtctgttggtaaaggcttcataaaatataaagcccatgaacttcaatagtggcccatttacaacttgacttatggaaagaagagaaatcagaatggtacttattgtctcacaattagaaataaatggtgtttattaataagtgattattttatcatagccttcacaaaacactttaaatgggagtccctataaaactagtgtttttattaaaaaagatacgtacatgtacatggtaagatatatacaataaaaagttagtcttgctcctagtctcctacttctactgctcacaggtaactactgtgaagtttgtatagccttgcagtactgtttctatgcaaataataaacctttctcatataaattcattcatttggttattctaggtacttggggaaaagcagtaaataaaacagacaaaatcccttatgtaggttatattccagtatgaagatagatcacaaataaacaaataagttatagattatatcagatggggataaatgctaacagagaaaaaggggagagcagacaaaacgttttcaagtacgaattcagtggttaaggaaggcctcattggaaaggtgacagttgagtagagacctgaaggaggtaatcttattccacacttactttttcctttaacagtacgtattaaatgcttcaccacagcagggcttacagatctacctctttctttcttttttttattatactttaagttctggggtacatgtgcagaatgtgcaggtttgttacacaggtatacacgtgccacggtggtttgctgcatccatcatcccatcatctacattaggtatttctcctaatgctatccctcctcctgccccacaccccttgacgggccctggtgtgtgatattcccctccctgtgtccatgtgttctcattgttcaactcccacttatgagtaaaaacatgcagtgtttggttttctgttcttgtgttagttcactgagaatgatactttccagcttcatccatgtccctgcaaagaacatgaactcatcctttttatggctgcattgtattccatggtgtatatgtgccacattttctttatcctgtccatcattgtatctaactatttattttgagacggagtctctctctgtcacccaggatggtgtgcagtggcatgatctcagctcactgcaacctctgtctcctgggttcaagccatttttctgcctcagcctcccaagtagctgggattacaggtgcccgccaccacacctggctaatttttgtattcttagtagagattgggtttccctatgttgaccaggctggtctcaaactcctgacctcaagtgatccgcctgcctaattctcccaaagtgctgggattacaggcatgagccaccaacctggcctaccttattctttttaaagactccattgtaccccattgtttgcatgtatcataatattgctgggcttttgttattgccacaggtggatgttttagattaatcctgttatagtctgttagatgatcatttgaatggttataaaagagacttggggcttgtggtataaagcctgattaaatagaaagaaacctgaactaagcatgggaagctatgaatgcaagtccaagctgtgctatgcttgctatatcattatttgtggacttccttttttattttcctgttctggcctcatgacagggtttccattttcctggcatgtcttgggctgttcaccagccccagggtcatgtctaggtgattcttcagttggagacctaactgacatccttcccacagcaacatcagtgccaggctacctgtaaccctgcagagtcaaattaaaacttacaagctttccacattccccacgaaggaagtactagcaaacttttagggagcagtacctctgggctctgtgcacactctccgtgcttaggaggaaagcacatgagcttccttaaaacaaaaacaaaaacaaaaagccatacattctagtgatgtttatttttgcagatagagatgtttagcactgggtcatgacagagtggatttcacctttaatggaagattaatttgcccatttgattaatatctgcggcaatccctggaatatgccagcactctgcctggcactataggaggaacaaataccagtgtaatatggttcctgtcctctggtgttaaaggcaatacagcaggaatgaaaagaaaggggagaacactattatccggggtccctcaaagatccctcagagagctttttgagctaatatgtaaacaggtagggaagtgttcaagggatggaggtgctgcaaggggaccttggtaagggataagtgtatgtgagtgtgtgtgttaggaatatgtgtgaatggaaggtgaacaataattgcactacaagcaaaggaacagataaaggaaaatataggtgttgtacaggaaacatgaagtagctctgtttagtttaaagaaagaatgtggggagtaggtgtagatgatgggaaatgttggttagagtaagactggcagagggtcctgagttctactttgctattagacatgagatagataaatgagttttgaaagattaaaaaatcaccatcagcttcttcctctcttgtttttgctttatttggggtgtgggagcattgtccatgttggttttataatttctacttcttattccagtaatttttaaaaatcagcttagtatttattaaagtaatatatgcctatagtttaaaaaggtgaatagtattataaggcctataattaaaaagagtactcccttcccccactttgcctaccactcctccttcctgcttctcaggggaaactattttttttttttgcttttattatgaaagatgtttattttccagagtgtgtaacctcatatataggtaagacttttgctgcaatcaattgttcttggtttggttaatctatagtcttgtccagcgcaggaaaactagcactgtccagcaactgtaaccagggagattgaatttcaccatgggagaggaaaccacttttaactatgctatttacatccctatacttaagtactgtgtatatactgatatttattaacttattcttagagattatctgccttactactatgcaaaataaggaaaatttagcactctgatactatcacacgctcccaagttttctttcctgatctttccagtgggttaaatggcaacttggggttaaattgatattccagtttaccttactatgaccatgtaatattgtttactaccaagacaagtagtaaaagagtatgcgttcgatgttgttcaacatcttatttttcctggtgttgtcttttattttgctcacctcttttgtgtatctatcattaaccattcatgaactacccaaaagaactatagaacttatattgaaaccatttttttttttttttttacacaattagcccactggttagtctactggatctctttttccctggaggagcctcccgtccagcccctctggtctaggggttttccaggccagctgcccacctgttgtcctggggcttctttttaacaccattttgtgaaatccctatgcctctttcctgtgttggagcccccatttcctggatcccatgatttcctctttgttggtttacatcctcatttttgtagagcacattctctagtagcttcctgagaaaaggtacatgggaggtgaatttgttgagacctcatgtgtctgaaaatgtcttaattctactctcatactgagttaaacttgtaattgaattttaagtaaaatgtaattttccctcataatgtttaggctgtacttcattgtcttctagcttccagtattgcagtctcaggccactactattccttttaccaggtatgatcttttacatgtgacctgtgttactcctctggaaggttttggaatcttctttttaatcctggtattctgaagtcttagagtaaagaaccctaatgagctaatgagaatcttttcttacccatcattttgggcactttatggtctctgaaaatctggaaaatagcattgttccattttgacaattcttcttctattattctttagtacttgtctctgaatcatttttttcttgttttctccttctggcatgcttatggtaaaatatggaacctcatggattaatccactatatttctcacctccacctcaccccacgtccgtctgatatggttggctgtgttcccatccaaaactcatcttaaattgtagctcccataattcccattgttgtgggagggacccagtgggagacacttgaatcatggggggtggtttcctccatactgttctcatgggaatggataagtctcatgagatctgacggttttataaggggaaaccccgtttgcttgcttctcattctgtctttgcctgccaccctgtaagatgtgactttgttctttccttgccttctgccatgattgtgaggtctccccagccatgtgaaactgtgagtccattaaacttctttttttaagtaaattactcaatcttgggtgtgtctttatcagcagtgtgaaaacgtttggactatctactttctagaaagtttgacttctatacctctgaatcattttatattcttctataagtttaatttccaatacctccttcttattttctaattgttcctgttctatagaatgctttttattttatagatataacagtatctctcatctttctgaagttactataggtttttaaaggctttcatttgcttcctgaaatatctatatcttctctgagctcctttagcccctttctctgttttgatctctatattttattctatattttatgtcagtggatatcctcaaatatctgatggcccttcattactcatttatatttaagaaatatatatgtttatttcatatatatacattatatatgaaacaaacgattcatttatatttaaaaacagtgggtctagtttccaagggaaaccctgagtgtagacagggtgtgctttttccttgactggcatccctccgaggtaacagagtggggaatctaaccatttcaacagggactctgccaatcagtcattttttggactgagtttctgcagataagaatctccaaacccctgcctaaggagccagtccctagctgtaggttccctgggagctatgtcagggaatagtccaggagggtttcacctgttctctctgtggagtttcatcctctctcctgggcccaatccctgagtctagagtatctctgattcaatgtagcctaagactatccctgatacctcacatagggttggggaattggtagagtcagtgtgagctagggagggcagggcctaactactccatatactctgttggtctgaagctcctggcaatcaattctcctttttccagtctcatgactcctaagcctccacagcatcccgtgcatgaatctgaaggctttgctcagtgcacctcagctattcctcctccatcactctgctgtcttccacaaattgcctgatatctcacattcagtagcctctcctctgttctctcatttgctttgtgtccctgctttgtggtttttaaaattctttactaatttcagtgagatttattttttgttctttactaattttaatgagatttattttttattctttactaattttagtgagatttctggaacaggaagatatgaaagcatgtgttcaatctaataaaaccagaagtttctagtgttatacattttactttgtagttatatgtacttatgtattttgttttggtctagtttgtttgtccagagaactttatgagttacttggacaaactagtaaccacctcacaactactgttaaggagggtattgacaaaatcattttacttctttgttattttttagggattatcaggcaaggtcaagttgactttccataaatgttatctttatccagataacagcattttgttatcttggctccagaagtttggacaaataatcaatttgaggtagacgcatatcaatttatcaataagaaggaaggaagactataaggaggagggaagaaagaaagcagaaagggagggagggggaaggagaaaaaggaaacagacataaaagattttaaaacagaacagcaggaagactggcccaactaaataactatactaagaaaagctatgtatgttcactaaataagaagataaatttcggaaaatcatctggctttaagataattccaaacaatgatcactgacttggaaggcagttaagcaatttatgtcactgaatgttaatggtcaaactacgttttatcagtcaacaaaatgtacccaaaatgcatatgaaaagcagtatagcctgcaacagaacctatcacataatgatttttcacaattacatgtccagaccaacttctaactatatactgactcttaccactctgaaatatatctattttttggctcaagaatatatgtgtatatgtatgtaccaaggtatatatgtgtgtattcctcccctcatctcccaaagaaatttatgttagcttgcaggtaatccttttacttgaatatatgtttattttcctgcttatatttcttataaatttgtctagctcaaattatgtagtcctctatcctctgtcatactcaattatggaccaataacttttttaaaaaagttaactatgttgtcaacaacatcacttccaatgtagccatcatcatatctttgagcttaacaaaaagcttgactttacagtcagattgaccttattttaaatcccctgtcttccatttactaaataaactccccgataggaaaatggacatattctctattttgcaggattttatgagaattaaatcatacaatgcatataaagcacctggcatactgtaggtacccaattaaaaaaagctattcaagtcagaatatgagatgatattgaaaccttaagctgtctaaaagtacatcttttccaactgactaatttttcatttccattttttaggcatcgcatcactggtaagctggtcacctggaagcaacgcatcagttagccactgaaaaggggtgtgcagagctcttacagaaaattgagaaaatcattatattgatatattgattatattaagaaaatcattatattgctatctacttttatataagtaggggaaagggaggactggacaaaaacaataaaggaaaatatttggcccagcatcagtttcttgacccctttagaattctatttaactacaaaattaggaggttatatgaagtccctccaagtgttcaggacaaagagttctgtggttagatgattttgaaacacacctcgatcgtctcacacctccccctccccattcttgaagctttgaaacacatatgagtttattcaaggtatctgtcccattttgttttaccttccgttatacaaacttacttgactacagactctcccccttttttcttttctttcaggtaatatttattgacatactttggaaaagactggatgagttgctctgcgacttcccactctaacatatgtttctctgagtttctacaacttcagctaaatgttttaaggaagaaaagaacaacagaatatgtgctaattttgattgattgatgctccctcctatagcagcatacaaattttagagtgggagaaaaatctattacgatttcaatgaaatgagctattttatcttgtccctatgtggtaccatcaacattttagacagatgaacaccaaaccattgactgaattgctgcatagtggatttgccttgattataaagacagttgaatgaccagggtacctctggcaattttggcaatcaataagtaacatgaatcaactatgtagtggtcagactggctacccagtgctcaatcaaaacagaaaataacagagataagttaatccttaggttgcaggactataccatgataccagcataaaactcaaatggacattcatgatgaaaaaatgttaatgctatcattatacaataaactgctaaaagtatttttattagtaaaatactttcatttttctatcaatctaacaacacttatttttatctgaaaggagggtactatgctaaacgtcactgggactaaaaggatgtagagtaggaaaagggccaaagatcctaccagaaaatgatctaggagccatatgttagttctgtcagtaattttctatgtagctgtcaataatcctttgttttctctttgtaaaaataactatcctctgctgggtgcggtggctcccacctgtaatcccagcactttgggaggctgagacgggtggatcacgaggtcaggagtctgaggccagcctgaccaacatcgtgaaaccccatctctactaacactacaaaaaaattagctgggtgtggtggcacgcgcctgtagtcccagctactcaggatgctgaggcaggagaattgcttgaatctgggaggcagaggttgcagtgagccgagattgcaccatcgcactccagcctgggtgacaaagcgagactctgtctcaaaaaacaaacaacgacaacaacaacaaaaaaccaaaaccaaaaaataacaacaagaaaaaactatcctcaaggggcttattgtttagttaattatatttacaagtttgggatttttgctccatgccttcttttgttacaaaattatccttaatttacctacataacagagacaaaagtgagtgaatattttgatgttctttaattaattacatgccataatacccctccttcatcttaactgcagaaattctgtgagaacctattgcaatgttttccctttttctcttgatatgtctctttcccctcaaggctgctaaggttttaaagtgttctgtttctatttttttcattaaaaattctatcagaaaccccacttcctctcaagaggaaatttatccaaaaccacctctgtggtatccaagtcataagtgtgttggtagtaggatggccaactgtcctggtttgcccagtaataaggagtttcctactatgtggaactttctgtgttaaaaagtgggatagctgccgggctcagtggctcacgcctgtaatcctagcactttgggaggctgagggatcacgaggtcaggagatcgacaccatcccggctaacacggtaaaaccctgtctctactaaaaatacaaaaaattagctgggcatggtggcgggcacctgtagttccagctactcgggaggctgaggcaggagaatggcgtgaacccgggaagcggagcttgcagtgggcagagatcgcaccactgcactccagcccgggcgacagagcgagactccatctcaaaaaaaaaaaaaaaaaaaaaaaaaaaaaaaaaaaaatagggatagctctctacaaaccaagggagtaggtcgccttgggtgttagcttgagagaaggattggatatggcacggaaacctgcaccagagagctgcaattttgatcctattagaaacactcttctttcactgctaagcagctatgtacaacaatcaaacaccagatggatatatgaatttaatgacctttaagtttcctttacactggtggttctcaattctggtttcttactaaaatcatctggttagctttttaaaaagtgctccctgatttaactgatttgaaggtgagtctttgccatgggcatacatgtttgaagttccccagccaattctcatgtaagtcagagttaagaaacactactttatacacattctgagattcaaactataggcctagcaagagctgtttaaagcaaggagaaatctactttgtgatctctgacttgttaattattacatgcaagtttctacttcaactttaaaacaaatgagaacctgcaaactgactttatgtattcatctacattcatttattcacctagggttcatgatctataagcatctcccttgtcatgtttgtattctgaacatcaatcaccaccatctattgatatatatatttttttcttacaagaaactgtattaggcaccgtggggtataatgatttaaattgcaaggtctctgtcctcacggactctataagtagaatatatgaaaggtgactacatgatcaaggcaaatgaccccaccgccaaccaaggaggacgtggtcatggcctgggatggttaggaaatcttcatagagcaggtatgatttttaaggggctttgaggactgggtggaattttaattagagagccataaataaaaactacaaaaagggagaaaagcagtttgagaatgagtagggaggaatcagtttaccaaagttaagtatgtatacaaataatacagttcaccttttgagccatgcaaactgtatctaaggaggcacagaaccttgtatgagaccaactgctgagcaaggaaatgtaattagcgcaatcacttttttggtgctaattacttaagacattgaaaaagaggattagactgaccaatgaaacaattggttctggataaacatacaaagcttggtctgtaatgtggagaacaagccactgaatagcaatagccaagccccttccctctggtgctgggcccactcaagagacctgatcacacagacagtgaggcaggtgctgcatagatcactgcaagaaccccgagggacccactctatctgatccagtgagatgatttagggttgaagaaataaatttagaacacaagtcatgtaaaaagtacatgttactttatatgtgatgttatgtgattatcagtcattgattttcaattacttttataatgcaagagcttttcttctggatttcagaatttaagaatttctgcgccatttgtctttgcctacgaaaatagttaattctcatatttattccaatagctggtcttcatgtaagatattaactaaatgcccattaatagtctgggtatgcaactcaggaagtcagttggcaaaattaacatttagaagtaggcaccactggttatttcacacattattaacttatattacaattcaaataagcttacagctggcaaaaaaatctcttctgtaaagcgatctcaaacataataggcttaatcagagataaattaaattaggcagccatgcatactacagcatattaattctgagtagttattactacattttctgttatcactggtgtgaacaacattatgtgcaaacaaattcttcgagagggtagcaaataaagtttatgtttgggatgccatgtgcctagcattttcccatgttttcttaaaatgttaaataatcttttctgctaataatggcactaggttaagtccccataaacgagtcaacctcactcccaggaaattaaacaaatgaacatcagacgaaactgctaagtgtggtttggatttttccaaagggaacttctcaactttctctggcaattaaaaaaaaatttgttaatgagtcatagctagagcaaaattgtccaaaatgtaaggtagtgcatagtcgttacgttaaaaatcggtgcctctcattctctgttttggatgaactatgttgccttagaatactcaaagaagaaaattattcaggtagaatgctattttctaaataagatcctgccattatctctctctttctttaaacggtagtaatctaagccagcaaactagcactcagatcccacacgctagcaaatgatgcttttgtgaaagaaaatgaaaagatgcatctaacctttatacacacacacactcatgttgccttttttgatgcacttttgtcagattatctgattctttgttaatgaaccaggccctttaatttctgtatccaggagtaattcaagttactaggcatgacagccactaccgcccccaagtctgagaaacatgtttcacattctttgcgctttgcacatttaaaactcaatgtaaggtgacaagaacattaagctgcccagtgagtaaaatgtgaaactaatcactatctgttctacagatagtgggtacaataattggcaaattaaagtgcctgggaagagctgggccacctgcatcaaaaagcatcaccttggaatggctaatgaagataaatgtatgcagctagctttactgacaactacttcaaacaccagcagactgaaaaagcaacactacagtacttatttcatttactgtaaagtacgcaccatgtgaaatttttgttatttaaaggaaaaaatacccaacccctctcaatatgttgtacacatgccggctgaatcgaggctagtacttactcctaaaaagccaatgcttttcttttaaactggcaaactgggatcaatttgcttattaaaacgttgaatttgtattttcatgacaactagattcaaataaattagaagactacaaaaaagaaaataatccaatttcaataaaattgctactcttattcatccattcatttatttgacagttattgaatacctactatgtgcaggtactgtgcttgacatttggcagagagagacgaatgacatctccttaaggaggttgtggactatttgcaggcaagaggcatgcttacaggcacacacacaggcaactagaaccatgtgctattgtagaaacatttcagaaaggtgtccctttcccttagagtctttcaagagaaggctcactcttaagctgaattctaagatgatttctgaagagtttttgagggtgagtaagcttgagaatggtcttccaagctgaaaaaagtagcatgttcaaaatcaacaagaaggtcaggatctgcttgaggaaaaaaagtgccttcaaaatatatgaaggaaataaatacagaaataaatataggaggcaagaggtcaacagatgatgaagatgaaagctagacaagggtaagaatatgaagggccccagaagatatgttgaggagcttgcatttagttctgcagggcagtacttttcagaatatgtgacagagaaccctggggacctggggaaggagggaggcagcctggaagggagtgaggagtgagaagaggctgagcagtcaggactcaggccctgtacctctactcataccacaagagctttgccaatatctgtttcaccttttgggccttcttattattagtgtttttgacaattttttatactggaataatcttaaatttgcagaaaaaattgcaaagataatagaaagagttcctacatactcctcccccactttcccccactgttaacatctcacattaccatggcctggtacgtttgtgacaactaagaagccaacattggtgcatcactactaactcaactccagacttcatttggattttaccagtctttctattaatgtcctttctctgttccaggatccagtccagtctaggatatcacattgcattgtgtcatcatgtctcttcagtcttttttggtctgtgacagtttctcagttttttcttgcttcccatgacattgacggtcttgatgtgtattagccaagtatttttaaagcatgccctcacttttggctgattagggttattgggaagaatatcaccgaggtaaggtaaacttctcatcacatcacatcagggggcaggcaaatgacatcagcctgatttatcatggtgatgttaaccttgatcacctggttaagataatgtttaccaggctttttcactgtgaagttactatttcccctctttggaagccagtcataaatccagcccacatttaagggggagggtaagcttcactatctgaaggtggatatatctacctgtactatttggaattcttttagaagaaagactctatttatttatttgttcgattgtttatttatattaggatgaactcagacatttattttatactttcggttataatcaaataccatgttatttattttgtggctcaaattgttccagctttggtctctgggagctctattaaattggttcctgtatgcctttcacatgcctacatctttttgttttttgagcacttatttttttagggcataccatgtgctccaagatcttgtatttttactgtcccagccacaaactcagtcatttctctgaggatccctagttcctattattggaggataatatttagaaaccacggtctgggcactgcatgtgcttgatgctactgaggtatcactgctcccaggccccctcagcagaaagagccaagaagtataaatacatattcaaacccagttatatgcacatgtctataattgtttctgtgtctgtccgtatgcatatttatcaaattaaatagtagttaagctaacatgaagttagctgatatgtccaactctaatccagcattacagggtttgttgcagccccctctcctagcttatggaaattgtcctgacaatgagaaacctggcttgcaccacctaccatccattcatttatttgttcagcctcagtatttgggtcttcttttgaagagatttctgttactttaaaataataatatataaaagggctttatttttattcattaccatcactccaattgctctgttttcatcaaatcatttcatgtttctcctaggcacccaggaagactataattctcatgatcccttgtatttaggtccagttccagttaaaggaatgtgggtagaagtgatactgaccacttgtagccctaggctctataatctgttgtgggattctctacatatattgtctatttttttgataccaggtataagacacagtggaaaattccaataataaaagagaaaaactatatgacgattcaatggaaacagaaaaaaatcttgaaaaaagtaaaaatccactaaggatttaaaaacaaacactcatcaattagaaatgaaagagaacttccctaatacaataaaatgcatctctgaaaattctacagtgaaaattatacttgattgttaatataataaaaaattcctcataaaatcaggatcaagacaaagatgtccactctcaccacttgtactcagcatttactcctcaaatgggaagtctgagtcattataataaagaaaaagaacaactacaaaaaatagaaaggaacaaaactttctgaatggtatattttgtataaaaaatcccattaaacctaccaaacaactatcagaactagtaagtagatttacaaaaattatagagtacaactttatttttttattggagatataatttatataatgtatagttcactcttttaaggtgtacagttcaatgctttctagtacattcacaaagttgtgtgaccattcttcttatctaattccggaaactttcatcacacaaaatgaagtcttgtacccattaacagtcactccccattccccccagcccagtcccttataaccactactcaactttctgtccctgtgaagttgcccattctggacttttcatataaatggaatcagacaatatgtagtctgtgtgtctggcttaatgtgctcaaggtttatccattttgtagcatgtaaatgtattccattctgattttaggttgaataatattctgctgcatgcgtatatcacattttgttcatccattcatcagctgatggctatttgggttgtctattattttggttattaggaataaaattgctatgaacactcacatacaatttttgtgtgaatgtatgttttcagttctcttaggtctatacctaggagcgagataactctatgattaactttttaagaaaatgtcaaggtgttttatcaaagtggttacagcactttacaatcccatcaaaatgcatgaaggctccaaatttaccacatctctgtcaacactgttattgtctgtcaattttagacaattactacattactatatactatattactatatttactgtctaaaaatgatagactatagtaattcgacagacagttaaaatagtaacccaagtgggtatgaagtggtaccacgttgtggttttgatttacatgtcttaagggctaataatgttgggcatttcttcatgtgcttattggccatttatagtatcttctttggacaaatgttattttaaaattttaaaattttaaattttaaaatttctttatatatctggtatactctttatcaaatataaaatttgcaaatattttcttccatctttgagttctcttttcactttcttgctagtgtcctttgaagcacaaaagtttaaaattttgataaagtctgatttatctatatttttcttttgctgtacatgcttttggtgtttcactcaagaaactattgcctaatccaaggtcataaagatttatacctatgtttccttataagaatttcatagttttagcttttacatttaaatcttggatcatttttaatttttgtatatggtgtgacacaagcatccaaattcataattttgtattattaatacatgtggaaatccagttgtcccagaaccatttgttgaaaagactattctttcttccattgaattgctctggaacccttttgaaaatcaactggccacagatataaggtttattcatggattctctattccattccatttatctatctgtctatccttctgccagtaccaaagactcttgattactctagctttgtaataagttttgaaattgggagctgtgagtcctctaacattgttctttttcaagattgttttggctattttgggtctttatatttccatatgaagttcaggatcataaattcctttttttttctttttttgagacagagtttcactctgtcgccagctggagtgcagtggtgtgatctcggctcactgcaacctccgcctcctgggttcaagcaattctcctgcctcagtctcctaaatagctgggactacaggcgcatgccaccacacccagctaattttttatatttttagtagagatggggtttcaccatgctggccagcatggtctcgacctcttgacctcgtgatctgcccgcctcggcctcccaaagtgctgggattacaggtgtgggtcaccatggctgccctataaatttcttttaaaaagccagtcaaagcaggcgcagtggctcacatctgtaatcctagctcttagggaggcagaatcaggaggatagcttgagcccaggagttcaagatctgcctgggcaatatagtgagaccccattctccacaaaaaagaaaaaaaaaaaaaaacaaagccagataagattttcatagggatggcactgaatctgtagatatatttggggagtactgacattttgctaacttaagctttctatgattatggtgtgtttcaccattatttaggtcatgattaatctctttcaatgatgctttgcagttttcagcgtgcatgtcttacactgcttttgttaagtttattcctaagcattttttattgatgctattatgaataaaattgttttcttaatttcattttaaattgctccttgctagtgtatacaaatataactggtctttgtatattgattttatacgttgcaacctcacagaactcatttattagctcatagtcaatagtacattattgactagaagtgggtagagtagaaatgtttgtcttgttcctaatcttaggtggaaaactttcagtctttcactaataactgtaatgttagttgtgggttttccatagatgttctttagctggttaaaaagtttccttatattcctagtttgttgagcatatttatcatgaaacggattttgtcaaatattatttctaagtttactaagatgattgtatgtttttcttttattctattaatatggagtttataccgattaattttcaaatgtttaagtaaccttttattagtgggataaattatatttggttctggtgtatagtcttttttatatgttgctgtatacaatttgctagtatcttgctgagaatttttctacctgtattaataaagaatagtggtctacagtttcctttcctcttatgtatttgtcaggttttgctatcagggtaatattacaattgtagtttcatctattaacaggaaactttgaaaaataaaaattttaaattctatctgaaatatttaaaaataaaattctgagtaataaatataatagtaggtatttaagatgtttatataaaatattactgagaggttttaaagaagatctatataaatgcagagatagtgtatgttcatatattggaaggcttgatattggtgagaagtcaattcttcccaaactgatccctagaataaatatattcccaatcataatcccatttggctaatttcttagaaaccaggaacataattctaagataaatctaaaattttacaggaactaggatatacaaaccaattttgtaaaaaacaaaaaaagaacaaagatggaaggcttataccatctgacttgaagacttactataaagctacagaaatcagtgtagtctggtacactgatatataaagagctacaaaaccaatggaacagagcagagagctcagaaatagatgcatatttatgtggtcatttgatctttaagaataacattaagaaattccagtgggggaaaggaacgtcttcaagtagtgctggaagaattaaatatccatacagaaaataaaaaactctacactgacctcacacaacaaataaaaattaatttaatatggataataaatctaaacataaaaagctacaactgtactataaagttttcaaactatatgtgtgtgtgtatatatatatgtgtatatatatatgtgtgtgtatgtgtgtgtgtgtatatatatacatatatatatacatatatatacacatatatatacatatatatatacacatatatatacatatatatacacatatatatatgtatatatatacgtatatatatatgtatatatatacgtatatatatacatatatatacgtatatatatgtgtatatatatatatatataacagagataaccttgttttagacaggatacagaaaataattaaccatgaaagaaaaagaaagccctgataaattagacctcaaaatttaaacttctgctcatcaaaagacatcactaagagaataaattagcaaggctcagattggaaggaaatacttgcaaaatatacctaataaaatacttgtttatatatttacatacatatatatttttatatatggctcatacatataaagaacttctatacttcaataagaaaaacacaaataatccaatttaaaaatgggaaaataactgcaatgaacactttacagagaaaattatataaatgaccggtgagcatatgaaaatgatttcgacatattagtcatcaaggaaaaggcatattagattactattaaacatcaccacaaacccaccaaaatggctaaacctaaaaagtcagactgcaccaaatatgggtgaggatgtagaacactaaaactctcacattttgttggtgggaatataaacaattactttggaaaagatctggcaatttcttcaaaaattaagagtacacctatctatgaccagaatcctacttttagatgttgacctactataaatgaagacctatgccctcaaaaacatctgcacaagaatgtttatagaagctcattcatactagtcgaaatgtggaagaatggataaacaaattggtaaaatggaatacaactcagcaatagagaactaccaatgaactcaagaacagactgatctcaaaaacattatgctatatgaaaggagcctgacacgaaagagtatatagagtatggttccatttatataaagccctgaaagaagtgatttactcttggtggggtagggatactgggaggggcctgcaggaactttctggggtaatatagattcgggtgcaacaggcagatacatttgtcagaactcacggaaattcactcataaaagttgtgtgtcttatcatatgtaaattttacctcaaaagaaaaaacaaagaatcgtaaaatttaaattctggtaataatgcacacgttcaagtatttaggaggatatgtactaatgtctataacttgctttgaaatgtgtccaagccagaagtggtggctcacacctgtaatcccagcgctttgggaggtcaaggtgggaggatcacagggtcaggagatcgagaccattctggctaacatggtgaaagcccatctctattaaaaatacaaaaaattagcctggcgtggtggcaggcgcctgtagtcccagctactcaggaagctgaggcaggagaatggtgtaagcccaggaggcggaggttgcagtgagcagagattgtgccactgtgctccagcctgggtgacagagcgagactccgtctcaaaaaaaaaaaaaaaaaaaagaaagaaagaaatgtgtccaaaaataagattcatgaatgatgaatggacagagggatagaatgatgcacagtggtgggtatatgagtatttactgtaaacttctttaaactatttggaatagttaaacatttgaatataaaatgtttaaataaaaaaattctttaaaactaagactttcacaaaaaaaaagaaaagaaaaattaaaagaaaaaaagagaaagcaatcccagctttgtaagttactagccatgcttcataaatagtctaagcataatttcctcatttataaaatataaaaaataatatctactatacaggactgttaaaggactatacttgccaatatatgtaaaaaacagttcctggtataaataagcactgaataaatgttttagctactatttttagtaagcatagaacgtctgtagccataaacccacaaaaataaaacttcctgagaaagaagacaatgtttgcacactttgttaaaacaattgttatgtttgttgcatagaaaaaaatcagattcaccgtgatttttttctacatgtgaataccatttattaggctccctaagtgaatgagctagtagaaaggaaatattatatttaaaaaaccccataaggcatatttttagaaacggtatttccttgactttcattccaggaaaattctaacacacggcacggtgcatgtggagcccagaaaagaaagcctgccagatgccacagcaataaatagagtagggccttggagacgaagcataaaaggaaaatgtggagcatcatatctgcagcacccttctccatctggtatttagcccactgaggttatgggatttttggaaattcacctttgtaggctacctttaattatttttcttgtttatttgtccagtaaacatttaaattgtagcctaatatgagccaagttctatgaaggtcttccaggacctttggaaaatgaagctgggtacggaaatttcaggaaaaaaatgttctaagtacagagtaatgaaaggttaatactatttacgtcttgccatctctttttacaatattaatttcacaaatacaattttagcatttccaaccaataaattaagcaacagcatattttctcaaatggcaggaattctcagacaggaataaaagggagtagaatttcttaagtgggttatgtctcactttgctaagaagggcagaaatgaaaataggttttcataaattatattttctatgggtcttgtattatcatttttataaacagatattttccaagcaagtggaatttcttcacatcgtctctcaatttagtaatctttctgatgagcaaactgagctgtagaatgttgaacattgtttcatcctactatgactgtcatcctttggcttgttgaatatatattcttgtgataattctaagaaactatgactaatggatttttatccagaattttaaaacaacaaaaagttattttaaattaaatgaaaaatacattctattcccttaacttttcttttttggggggattacacattctctgctaaaatttaggatggaatttctaacagtgatggcattgttcggtaactaacagtcttttgtgtgtgtgaaaaattctaaatgagtggaaatgatctcagaaattttatcttgaaaatgtttgcctatagtatttattcaagtgttgtccacattttaggaaagaacttcaaaaatgtccttttcataaaaatatgcagttctcttgtgtctatttaaaagggaagtccctctcctaactccagcatacgcactcatctctgggctatcaatagaagctaaagaaaaaattaaagaaacactggctgcatgccaaattttgggttaatagggaagagaaagctggttggcaatctcccttcctagtccttatcttttcctccccttatctctcctgtgctaggggtgctgggatgtctgtactctgtaacctctttctctgaatggagacagaagcaggaagtcaggtgccctgcactttaatgtcttattattcttctccttgagtaaatcctaactgttaacgggaaataaaatgctatatgtaaatgaacatcgtcacttggaaatcatcattctgggctacagcaccaatacacctgtaatcttaaaacatccttttaatagtaatgaatttgtcaaaaaagtatattaggacatctatattcaaattaagtttaccactggcttaggtttttaaaattaatacaagttgcttaagatggtgaaaggccaaactgttgtgattccttccactatgtatcatcctggagcaaaactcataggggaaaattagatattcgtgaagcaagatagcgagggtttttgttgttgttgaggttcccatcaggaacaagcttatattattggatttacttgagagtgtacaactgcccttgaaatgaaacatcacctacttccaacaagtgtgctctctccctagttcaccctaattaaggaggcttccctatattaattttgtctcttatacaagcatccttgagactctttgtgcttaattatttatgtctatgtctcaagtattaagagcacacttgaaatttaagatttttctaagtttctaacacttactagctttgttttttgcttagacctgttaatctaattttgtcttctcaacacttttgggaataatgcattgcttatccttaaattttgctttgcagtttctgtatgaaagattccaaattcaggtttcaatgtatttgaaacgaagttgctgattcctctcactggaattaagacctacacttacttttctcactcttctttattctatttcaaagtttgatgaatattttctcaaactgtatttgaaaaatttagaatccaataccatgaccaatcttcctcctgctaagccattggtggtctaactattactttttaagaaaaattaatatggaccctgatgtaaaaagaaaagaaaaacaaatatagagtgatttcagcaggtctattactagacatgttttctcatgtttctcggtagcttgaccctcttgtctggtattcctgagagaatgggcctacccacagagaaagggagaaggaggtaaagaagttgcaggtttgctggtgatttgagatgaatcctcatgcaacaacttgaaggcagacagattggaagagcagtgagttgattttctaaagtaaaatccaccagaaagagtttacacggtgttggaattctaccacatttacaaattaatgtgccagatgccatcagcagatctatcattatgatggctattgataaatatcaaaatttgaccattaagaaaatagtactactaatctcatactggggatatcagtaccactacagaaaaattctacttaaaaacatatgtgagctaaaagtgaaaagcatttccctgctgattccacatgtccacaacagcctaagcagtgtggagatggccagcggagcagcaatagggaacgtgtgccaacatttctgataggaactctattttctgaggatttaggctcaattatgaaagtctgctgaaaatgaaacttggcataaatactgtagcttagtagaattccatcaaatacaacaaaaatgaagattaaggagagggaaatcctataaactcaactttcagaaaagaccagagcattgctaaggaaaatcaaaggaagttctcaatacttattaattaatcttttcataaacgaaatcatatttgagaagtggtgagatcatttacagcctaataatttccagatatggaagggaataaataatttaaaggggtaatgattgaacctaggaagggctgtgtcagttctagaaatagtggcttttactcttgaatttttaaaagttccattttcttagtggtggcattggcccaggccacaatcatatacaaaaacataactgaccaaaaaaaaaaaaaaaaaaaaagaaaggctttaatctcttagaatagcaaaacagaatttgagaagagcctaaactctaagatatacagctcttaaaattttaccataaaggacacttttttagagccctaaataaggtgggaaccttaaacacagaccttaattttaataactcttgggaatggatggtctcagttaactctaatcttatatttgtttatagacctcagttttcaattacaggaggtctaagcattgaagtgttagagtgtttcaatagatgaaagatgattaatagaaactttaatatctctccaagtcaaatgaccatgtaacctctacaaatattactgtaatcgctacaaatatttgttactttgtttattcattcagtaattcaaaaaaagatttattgagcacatgctaggtataacgctccataaaacaagcctaaaatctaccaaaaatacaaatatgtattcacttgagaatttctgatagctctcatttagtgaaggtaccagacactaaacaacatttaacttgagatacatctggaacctttaacaacatactaaactttaaaaaaaagtgcatatttttctaatgtggttctgaaacaaagagacaaaaagaaattttttatttgtctaatggaagagaaaaggcctcaaaaactagctgacctcccagataatgaagtgtaaaagaatgtgcaaatgtacttcaaaaagtaactctcctggacaccaactgaacccttagaagctaaaggcgggaaataaccccttcttccttcttttactctctctagtttgtctttgttctgtttcccttgtcatttcccactcttcagacacaattatagttgattgagatataacgagtaaagctacattagaaactactcatggaaaaatcaatagaaaaggatagaggcacattcaacagaaacaacaaaacagaagcactgttaggaagaaggaagtgagaggtttttgtagcagaatgtacggaacagatatttcccaagtgcctcttctatggtaggtgggacatagcagcatcatacagtcacctcatatatccactgtaaaagaggagatgggtgggtgcaggcaggtaattgtccagaaaaagcaacagactggttctattatgagaaagtgaacatacttcatttgtggaaaactatacaacaattaaccactatgaatgaaacagatctccatatattaagagagagattctaaaaaaataaaaaaaaaattgagaaaaaacaagttccaaaggtatatattcagtatgatcccatctatgtaaacttaaaaaatattgcacatatatatgtgtgtatacatatatatacacatacatatatatatatagtatacacacatatatatagagagattaattataactatatatgtgataaatggtataatatacaacaaccttattatcatgatagtacctctgggaaaggagaagtagatatctgaagaacattttaaaatttttaaatatgggggtgaatacatacgctttgctcttttctgtaggtttaagctacttgacaataaaaattaacatttttttgaaatttgttgtctaaaaaaagaaagctgtagaaattgagacaattagaaggagctgttctagtaagtctaactttcttatttctgagctgagctgagaatatacaaggctgattattttccatcttcagaaagagaaacaatggagacttactgtagaagaaaagactatccttgcaatgagaagtcagtggcacttttggcaaatgaatggtcattttcaggtggaagtgaattatctgaatgtagttatattgagtcctccagctttaaaagaatgtttcaactcatacactatttatttgagttactcttttttttctttatggggtgtgaatatgaggtttaagggacacagttaatagatgccaagttttcattgtttctacaaatgtttatagagtctggattttggaataacaatttgcacacttacaagtgttgattagctgggcaacattgcaattaatattacttttttaagctcctcgcaaagacttccttttctttcaaaattgccaataaacattttcaaacataatccccaaggagctcattcactgggtgctgggggactccagcaggaaggaaacctactaacattttattaattttggatcatgtgtaattcttaggattaatggcaaggagccagagaggttttttttttttttttttttttttttcattttttaaatcacagtggaaaataagcctgaaacatttcactagtaaggcaagagtcacttaagatatattattaaatatgaggggtagaaataaatcacagacacaagtggtattatacagtgggcatttttctgaaaaaacagactccgtgcatgaggattagatatacgcccacaataagagggcatattgatctataattttcagtattacatccttgtattttttattatatgctatttttcaactagtagaggaacgtgttctcataaagctaatatttattcttccatgtttatacagctagtagtgcatttcaggaaatgagaaattctgagaagccaaatataacttgatgtcgtatgcaaaaaagaagacaagacagaaaaatccccatattttaaaaacctgactcaggaactcactcataaagctttaaataattaaataacacaacataatgaaagtcttttgatattattttttctattcccataaatgtagccttttcatagatgatacatcttatcatgtagtattcctcattttactagaaatcaaagaaaaggaccctttagtccagttctcattttcaacactgtactcactgtgtgtattttgtggaagctgaggcagatactcactgtaatcccactataaaaattgagatacccctactggaaactgtattgttaattcatgaattcttctcattttattattaagtaacctgtgtactggggaattcaatgatttcttaaacccaaagaaaatagtagtgaatgataatttggtttttcatggagaggctgtattcatattatattacggtaaaagcctcaagaggtcagagccatttcgggggagaaattccccaagcctttggaggagaaactccccaaaggtcaattgtttctatgtcctctccttttagtttataactttacttgagcccttggagaaatcaggagaaacagaagttgtcaagtcatttccccatactccgcatgcataaagatggaactgggtgttggcaacagtaagtaagtgaggcagaaggcagaagtgttgagggggatggcaggaggtgaggccaaggatgttgggactaaagggagagagcagttaggctgtaatcaagggttctttgagctccccacaaaccgatccttgattttctgaggaagcttgtggcctagagcagacagctgaaactatggtgcttggtgaaaagcaagtgaaaaaaacaactactactttattacttaccttttcccagtcatcttgcagatttcagattttctaccctttccgttctcagtaactgaccggccacctttgtggcatcagccccaccacttctcctgaggtccaagcctgtctccatctccatatccaacagctgtcctctctctgccattttcctgtactgagttctaatattatctttccctcatccatgttcctatatcaagaaaaatgatctcctttaaacaccaaaccagaatttctcgttcttcgaaagagtctatccatccatttatgtatgttagtgtatttctaggcagctaaaaaataaatgtaatctcagagtagaagtgcaatagaatggaaagagaatggtacccggagttagaaaaagggggctacacccagctccatctttctgcccatttgggcactgtcagctctaagtgaagtttctgtagtctgggcagttgcagacctccactgctggacaagggaaagaaggtttgagtctggttattacaataactggggttgggggagatgttggcttttggttcctgagaaccgtggttactaaacattcttttatttatttttatttttatttttttttttttgagacagagctgttctcttgctgcccaggctggagtgcaatggcgtgatcttggctcactgcaacctccacctcccgggttcaagccattttcctgccatagcctcctgaagtagctgggattacaggcacccacgaccatgcccagctaatttttttgtatttttagttgagatgggatttcaccatgttggccaggctggccttgaactcctgacctcaggtgatccacccgcctcggcctcccaaagtgcttcaattctaggcatgagccactgcacctggctggttactaaacattctaaacatgcatgggacaaccttgcatcacaaagaactgtcccacttaaaatgccaatactgccctgatgaagaaacatcaatagatgattttcaatgttccttcaacctatttggcctctaaaacttaagtgaaatgtagggaacttaagagactcaggaaagaactgtgaggataattaaaattttggattatgcagatttataggaaaagttttaaaaatgggcttatctctcccaaagagaaaaaggatgatttaaaaactgagactaggatgatacaggggaagtctgaccaataaattttctttttcaatggaagcagaaataaattaacatgatatgagctcagaaattacattggctttcttgagaaagacttgaaatcataaatgaaagaggagacattacaactgatatcactgatatcacagaaataaaaaggattatgagagactacaaggaacaatgatatgccaaccagttagataacctagatgaaacagatacatttctagaaacacacaacctaccaagactaaatagagaaaaaatagaaagcctaaacagacccataactagtaaggagattgagtcagtagttagcaatcttccaacaaagaaaagtcctatatcagatagcttcaccagatcattctaccaaacatttaaagaactaatgctaatccttctcaaactcttctaaaaaattgaaaaggatggaacatttcctaactcattttataaagccagcataagcctgataccaaagtcaaccatgccacaagaaaactacaggccaatatccctgatgaatgtaagtgcaaaaattctcaacaaaatactagcaactttttgctagcaacaaatactagcaaaccaaattcaacagcagtatgcagtatgctgttgaatttggaagcctcatacttcccgatgtcgaaatgtaacaacaaactctctatatattatatacagagtttcagtcatgcaagatgaaaaaattgtaatatataaagctacaatagtcagaatggcatggtactgacataaaggcagatatatggaccaatggaagaggatagagagtccagaaataaacccatatatatatgggatcaaattatattcaacaagggttccaagactccacaaaagtgtaagaacttattcttcaataaattgtgctgggaaaactgtatatccacatgccacagaataaaactggatccttattttataccagacaccaaaaccaacccaaaatgaattaaagaattaaatataagatttgaaactacacaactagtagaagaaaacccagggaaaaagctccatatttggtcttggctgtgatttcttagatatcacaagaaaagaacaggtaacaaaacaaacacagacaagtagaattatatcaaattaaaaggcttccatgcagcaaaggaagcaatcaatagagtgaaaaggcaacttacagaatgggaaaaaatttgcaaaccatatatctgataaggggttaatatattaaatatgtaataaactcctacaactcaactgcaaaatatccaaataatataatttaaaaatgggcaaaggacttgaatagacatttctcccaagaagacatacaaatggtcaacagatacatgaaagatattcaaaatcactaattatcagggaaatacaaatcaaaaccacaacgaagtatcacctcaagatggttattatttaaaataatagacaagggttagcaaagttgtggagaaattggaacccttgtacactgagggtgagaatgcaaactggtacttctgctgtgcagtatgaagattcctccacaaattaaaaatagaactaccatatgatccagcaatttcacttctgggtacatatcaaaaaaactgaaaacaggatcttgtagagatatttacacactcatgttcactgcagcattattcgcaatagctaggatgtggaaagaacctaaatgcccactgacaaatgaatgagtaaatatggtctatatgtagaacagaagattattaagcctaacaaggaaaatcctgtcatatgtgacaacatggataaactaaggtcattatgctaagtgaaacaagccagtcaccgaaggacaagtactgcatgatttcattcatatgaggtacctaaagtagtcaaactcatagaataaggtaaaattgtagttgccagagctgaagggaggagaaacagggagttgctttacaacaggtatagcactttagttaagcaagatgaaaaaattgtaaggatttgctgtacaacatgcagagagttaacaacactaaagtatggacttaaaaatttgttaaagggtagatttcatattttgtgtgtgtgtgttttaaccacaataaatgaaaaaaaaaactaagaaaaaaaggaaattggatccctgggtatgaaggtttgaaaacaaatggatttttattggtttcagacagttcacgcagaatcttgcttgtagactagggaggagcatttaggtaacttctcacgtccttcccagcacttctgtttctatggatacagttattaggttccagcacactgtgatatcctactgaattgacaggctagagagctgaggatggaggcacaacttctcatctaccccataccctagtaaataccccctgcctcactgttcaatgggggttaatcatgaggcccaacagcgaagggtacagtgggaaaactggagtctagcccagcactacagtaacatctactttgattcttagtagaaataaaagaaataaaaaaagtagaaccacagtaaagggctactaagagagaaagcatttgtcaccgtggacagaataaaagtaccaccaaatgaaataaatgcctatgggaaaagatgtgtcatgctagaaagtactgtgttccttctcctttgctcttcatttagttttcatccactcaatgtaccaagccttatcctatatcctgtttccttttccagctttgaaagatgcatggactgaatttagcctttggttaggtctttgtcagaaagtaccttcaaaataaaagtgttttacttggtactatctcaatagcaaacatgtatttccaaaatgaaatgcttgctctactagcaagctttttccttgagtaagcaacaatattgttagtaatttttcaaactgttaatacacatacacacacacacacacaaaaccccaaacaagccctattctatcatttataaatcatagggtgaatatcctctggtagaactaaatgaaaacattcagggcactgagtttttataatttgaaaaatgataatactagttgatattgacaaattcagttttgattttcaacgtttcaaaatataatttatccacaaggtcttaaacaattgaaagtacttaactaaatctgatatatgtagatgcttggcataaatttattgaatctattcagttagaatttataaacacaaaaataaaatttgttttaagtcaatgtggggtatattttatttctaatatccttgttacattccacagggtatacataaataagtatgacaagatatttattttcatttaaatctaactttcaatgaaattaagaaatgaaaatctgtttaaaatctacccccagagttctaattgaaatagagtacaaatattttccattaaaaaatatccctcaaacttagtatcttcagtaagaaaaatgaaaaaattaacacaaacctcaaaactgccagcagctcagaagacaaatgtgttctctggggacttgattgaaaccatgtattcataaaagtcttttaaatggatgctcttcacaaaggaagtctcatggaagacagcatggttctgacatatcagaggcttctggaagcaaagaaaagcacaccgttaggatatgtctaaagtaccattactgcctgtaatggtattattatcacttatatgtgttatcagcatgatgttattaatttctattatcaattttgtaccctaaatcatcttattcatcaatggcagagtgggacactaacctttcaatatcgtatttagaaatttctaaaagtcaggagtatttataactaagcaaacctctgcttttcctcttatctaggctgggattgaataactgtgggcagggtatgagcacaagaacagtgacagtatttactgagtgtctaccagatataaggcactgtgcaagtggcttttaaatctgggatctttaatacaaacaacactgcaattgaaaagtattggctccattttacagatgagaaaaaaatgcacagattgctgacctcaggcttagaacctgtaaccatcaaagttcaaaggccttagggcaggtactttccctcatctcactctgtagccttggtgatttagaaaaatatttcccaaacagaactgacaagagaacagataatgctgcaacatactaaattaattcaaatattactaattaattaagaacttgtcttgcctaatttactttagttttatattaaatatcatcttattcagtcaggcccacataaatacaaatgcccagctttaagcagtatatttttttctaccaacttttcttccttagacaaagagagaacttgctggaaactgagaagctcctttgtgtttggtgtgggattacatgcagcgctacatcaaggctggcactgcaaacttctcatcttcctctggcccatccatgtgacccacagttcctccactgtcctgatgaatgagaacacttagttttcctgattgcatcaggaactgagcccacatcctctatggctattactgagtgatattactgtatctctttgtggctacattcaccttaatggctgagggtgacaaagcgagggctctagttggatttccattctcatttttagtcagctatctctatatttgtttctgatggttccagtgcaacacagagaccccctgcaacttacccaccaccagctgtcccagtacccactctcacactgtgttgcagggctactgctcaccaaataaatgcttcaacacatcccttgaaatgatagctttggatgccatagacttttgtctgtcctgaaccttttagctcatggccccactgcaggaccaaaagtcccttagagagactagaaaatgatggagccaggaaggtcatgcataacttttgaaatttttagtttattggatttttggccacaaaagcttcagtcatgaataaagaaacaagggaaaacgattgatggtattttcaaattctacagaaccagagcctaggattattacacaaagaaaaaggaaaaagaacagaggaaaacagagctagtttatctttgcatgacagaagaaaggtgagcttgacaaagaatgaagaaaaaagacttgaaccaatggatctaaactaagtgagaggaatgtgaaatgaatagcaactcttcttaaaacctcatacactagcattctgtttacttcataccactcagaaacacattttcaggcagggcacggtggcccacgcctataatcccagcactttgggaggccaaggcgggcagatcacttcagtccagaagttcaagaccagcctggccaatgtggtgaaaccctgtctttacaaaaaatacaaaaattggccaggtgcggtggctcatgcctgtaatcccagcactttgggaggccgaggtgggtggatcatgaggtcaggagatggaggccatcctggctaacactgtgaaagcccgtctctactaaaaacacaaaaaattagccgggcatggtggcgggtgcctgtagtcccagctccttgggaggctgaggcaggagaatggtgtgaacccgggaggcagagcttgcagtgatccaagatcgtaccactgcattccagcctgggtgacagagcgagacttcgtctcaaaaacaaaaacaaaaaacaaaaattagccaggtgtggtggtgcacacctattaatcctggctactcgggaggctgaggcataagaatcacttgaacccaggaggtggaggctgcagtgagccaagattgcaccactgcactcgggcctgggcaagtaagtgagactctctcaaaaaaaaaacaaagacaaaaacaaacaaacaaaaaaaccaacaaccaaattttcagattaaatgcctaaactagtaggcccagtttttataaaatcctaatgacaatttttaaacattcattcagccactattcattatatacttatgagccaaacaataagttggaaaattccaggaacactgcaataatcaagatagccttttagtcaagcatcttaactgtcttgtaaagagatacaactaggatgtcaaaaaccataagaaggtggtaccagtaggtgtttgtaataatggggtctgaaaccaaactggcgggggtgttcctgcttcattacttcctggctgtatgaccttgggcaaggtactaaaactgtataacttagcctccttatctgcaggatgtatttcccgcaaaggctgttcgaggattaagtaagagaagccacataaagtgctttgtgcactgagtaacatacaataagaactcatcaaaagttaggaaatgttggcgggatgcagtggctcacgcctataatcccagcactttgggaggccaaggcaggcagatcacctgaggtcaggagttcgagaccagcctggccaacatgatgaaaccccgtctctactaaatacaaaaattagccaggtatggtggtgcatgcctgtaatcccagctactcaggaggctgaggcagggagaattgcttgaacctgggaggtggaagttgcagtgggctgagatcgtgccactgcactccagcctgggtgacaaagtgagactctgtctcaaaaaaaaaaaaaaaagttaggaaatattagtagtattgttgtataacagatcatgggtggtatcagtgatggaaaacgtgctatgaagctcagaggaattggagatcctttctgttggggatgaatggaatcaagaaggcttcagtgaagaaagtagcatttaagatcaactataagtaaacagagagacatgattaggcatttacagaaattctattataattgaaaagccagaatatgatatactttagaaaaacataggttcatgaaattagacattattttccaggatttggtgtgaaagtagacacctaacctaacaacacagccaggtcatagtacaaagaaaatcaacgtactgctaccaagagaggtacacgatcccatggggtcctgttctatttaactgtaatccaaaatgacaccatggcttttaatggagcttggcaagctctagacgtgccaattataaacttagccttaaatttaaatcatagggcttgagactcaaatctccaatgtgacctttcctgggtgttgttcaagaaaacatgtctgtcactgtggacagaaaccacacacccttttactctggaaagtataatataaagatgtactgtattttacaagcacagagccacaaaatgatggtggctataattccctagaagcaataaaagcaaaggctgtttgatttgtaacattcatttagaaatgtcttattgcattaatgaacattcttatttcccgcatattcgggactttaattcaaaaaaagcttggcaggaatctcatcatttatagatttaacatatagttcctctggatacattcattttgcaagggctcactaagccacactactttgtccttgccagacccatacaatattgtactgaacagaggagctaaaagcccacagtggcttgaattctcctataccctccctgtttcctagccatggaaggtctaatcaaggagagttctatggttgaaatgtgttcaggtgttgccaatgtgatagtgtgaagaggtatagcctttaagagatgattaggccatgaggactcctccctcatgaatgtgatcaaggcccttataaaagagtcttcacacagcattcaggtagctggcccttctgccttccaccacgtgcaaacacagcaatattcccctccagagaaaccatcttggaagtggagagcagccagcaccacagacaacagaatcttctggtgctttaatcttgaactttctagcctccaggactgtgagaaaataaatttctattctttataaattacctaatcaatggtatttgttataggaacaacaaaggcagaaattggtgccagaagaatgggatgatgctgtaataaatacctaaaaatgtagaaacagctttggaattgggtaatgggtagaagctggaatggtaatgggtaaatgctggaaaaagcctgtaccgtcatgaacagaacattaagggcaattgtggtgagggctaagaagaagcagaagactagagaaagcctgacttccttatggattacttaagtgtttgtgaacagaatgttggtataagcatgaacagtaaagattattctgttgagatctcagatggacataaggaacagggtactggaagctagaggaagggccgtctttgttataaaatggcaaagaattatgctgaattctgtcctgtcctaggactctgtgaaatgcagaacttaagagcaattaactagactatttggtggagtaaattctgaattttccattaattcaaattgtgagcatttgggaaattttcagcttggacatgtggagaataaaaattaagtgcgtttagaagagaaaaccaagtgcatgaccaagtgactgtttggtaaggagattagtatggatagaagaaagccaggtgctttagaagaaagccaggagccattgacaatgcaccaatggctctaaacacattttgaagatctttgaggctgcccctcccatcatgggcccagagtgctagggctttgagggcagaatggttttgaggaaggggcccagggtgcctgggggatctggggactcactgcccagggcaatctcaagtctctgctccccacattctgttacggcattcctcagcctccccagctgtggcttgagtggacccagctgcagctgtaaaccctggcagcctccatatggtcgtaattctgaggcttacagagtgcaagagctgtgagacacagctgcttccgcctagatttcaaaggatgtctcaggcagccttgggacctaggcatgaacttgcttgccacagaggtaggaccatggcagagacccttcactagtgcaatgactagtggaactgtggggtcagagccactgcagagagtccccagtagggcaatccttagtgcagccatgggggcaggttcactcataaaatcccattattgtagagccacagcatgcaactccagcctgagagagctacaagggctgaactccagcccgcgagagctgcttcatgggctatgctcaacaatattgtcatagaagggtctcctggaggcttggagacccaacccagctgagtatgtcttgaagaagatatgaagtaaaagattactttcaagtcttaagatttaatgtttgccttgttgggttttagacttacttgggacctgttacccctttcttctttgctatttctcccttttggaatggaaatgtctatcctatgtctgtcccatcattgtattttactttatttttgagacagaatgtcgctctgtcacgcaggctggaatgcagtggcatgacgtcggctcaccacaacctccacctcctgggttcaagcgattctcctgcctcatcctcctgagtagctgagattacaagtgcctgcccccacgcccagccagatttttttctatttttggtagagacagggttttgtcatgttggccaggctggtctcgaactcctggcctcaagtgatacacctgcctcggcctcccaaagtgctgggattgcaggcataagccattgcgcccagtcccatcatcgtattaatattttagaagcgcataacttgtttaacttcacaggttcatagcaggagagcaatttgccttgacatgaattatgccttgagtctcacccatagaggatttagatgagactctggattttagactttgagttgatgctagaacaagtttagactgggctactgggatggaatcaatgtattttgcatgtgagaggacataaatttgggagaggggccagggtagaatattatggttaaaatgtgtccccttcaaaattcaggtgttggcaatgtgatattattaagaaattgggcttttaagaggtgattaggccataaggactcctcccaggtaaatgagattaaggaccttattaaaaaatgtttcacacagcatttggataattgctcttctgccttctgccatgtgagggcaaagggttcctcccctccggaataaccatcttggaagaaagcttccctttccagaaaactgaacctgccagtgcattcatcttgaacttttcagcctccagaactgtaagcaaacaaatttttatgctttataaattaccccatctattgtattttggtatagcagcacaaatagactaagagagtgagcctgcaataaatacagtatccttctttatccctttcactgaaaacctgttaacactattttccattcattccaactcataacatcacaatttatgcactaccattgtgtcaattcattcttagattgctataaagaaacatctgaggctgggtaattcataagcaaaaatttattttggcttatggttcttcagcctatacaggaagcatggcgctggtgtctgcttctggcgcatcctcaagaagcttactatcatggtggaaggcaaatgggagcaggtccatcacatgatgacagcaggggcaagagagaaaagggagaggtcccagactcttttaaacaaccagatcttgcatggacttagtgagaactcacctatcacaaaggacatggtgccaaaccattcatgagggatccacccgcatgatcccatcacctcctaccaggccccaccttcagcattgggaatcacatttcaacatgagatttggaggggacaaacatccaaatcatatcaaccataacttctagctagtatttattcttgtagttcatcctgaaaagagcccaaaatgggtcatcctcaggctatagtggtgataaacatttgaactaaagtaaataaggcagggcactgtggctcatgcctgtaatcccagcactctgggaggctgaggaggcagatcatttgaggtcaggagtttgagaccagcctggccaacatggtgaaaccctgtctctactaaaagtacaaaaatagccaggtatggtgatgtgtgcctgtagtcccagctacttgagaggcggaggcaggagaatggcttgaacccaggaggtggaggttgcagtgagctaacaccactgcactgcagcccgggcaacagagtgagactccatctcaaaaataaataaaataagtgaataaatgcatagatgagataattcttaaaatgtaactctaattatgtacatccactactaaagaacttacaagggctccctattttccaaagatcagacctaagttattcaccagaaatatctgttcccaccatcctctgtaatctcaaaacagactatttctgaccaaaacccttggatccagtagaaatggtctgctcactatgttatatagtgaatctcaactagaggtgcatcacaggtgcatggggtgtcgcctatgacaaaagtgataaatgacatctctcttgccctgtttctctgatcagctactactttgtgaaccaccctatggcgaggcccatttggaaagaaactgaaggatctttccaagacaacagccagtaagaaacttgggccctttatctattagcctatgagaaactaaatcctaccaacaaccaatgagcttggaaatatattctgccccagttgagcagagatgctgtagatgttgctctagttgagatgactacaggcctggccattgctttgactgaagccttgtgagagacccagagttggaggacccagctaaggcatgctcagattcctgactgttgtttaagcaattaaaatagggggtcaggcctgaaaaattcctgagcaaatacaaccagaggtcttaaaaatagccttaatcttgcttaaattgccaacataagcaaaacttaactcaggtcacttctgataaatgcttacattagaactaaaacttaaccccagtgcatcgtaagcagctaatgaacataattatgtgactggactttccaagaaagtaccaaagaaaaggccattttgtcattgcaaaccggtcaaataattttattttaccttagcattttcccaataaatacttgcctcattctgtcattgagacactaaacctcttgcaatctggtgttctccatccataaattgtttcttactcaaactctttaaaattttatgccttaaattttaatgcagtgatagttaattttatgttgttaacttggctaggccatggtacctagatatttgcaaacacaagtctagatgttactgtgaagatgttaaaattaacatttaattagtagacactgagtaaagcagattactttccataatgtgggtgggccttatctaatcagttgaagcacataaggcaaaacagactgaggtcccccaagaaagggaattctgcctccagactgtctttggatttgagcttcttccctagatctccagcctgctggcctaccctgcagattttagacttgccagtgtctataactacatgagctaattccttaaaatatcttaagattctctctctctctctctctcccccctcccactccctctcctgttggttctgtttatctggagaaccttgactgttgagatagaactgataggacctatagagagagagatgtataataagggatttattaggggaattggctcacttgattatggaggctgagaagttccatgataggccagccatctggaagttggagaacaagagaagctgatagcaaggctcaattcaagtctgaaggccttagaaccaagaaagtagtaactctcacaccaagcccaaaggcccaggagcctaggggcattgctggtgtaagtcttggagtccaaggacaacagagtctggacttctgatatccaacagcagaaggaaaaggccatcctggctcccagaaagagcgagaattcaccattcctttgccttctttttccatctgggaaccccagctgattggatagtaaccacccacattgaaggcagatcttccccattcagtccactgactcaagtgctaatctcttctggaaacaccttcacagattcccctgggggcaggcctatcattctaatcaaatgccaaaacagtccatctgggtttccctttcatcaggagaaggacaagctcagtgcctactgaagcactgagaataattaatgctttaccagctatctgggtatccctttgttttagtctattctcacgctgctacaaagaactgctcgaggctgggtaatttagaaaggaaacaggtttaactgactcacagttctgcatggctggggaggcatcaggaaacttacaatcatgacagaaggtaaaggggaagcaaggcatcttcttcacaaggtgcaggagggaaaataaatggaggaactaccaaatacttataaaaccatcagatctcgtgagaactcactatcatgagaatggcatgggaaaaactgcccttatgattcaattccctccatctggtctctcccttgacatgtggggattatggggattacaattcaagatgagattttgggtggggacacaaccaaaccatatcatccttagaccagtcacactgacacccaatcaaccatcacaataatcacaattaactaatacgaagacccacagatactgtgagactaatatgacagccctcccatcacatttatcacaatgaattataatttttggattcctctctaatatggtaagcttcatgttctgtcaagcagagaccacgtacatcatgtttgcaaacaaatattgtactgtgtccagcacagtgactacattcttgttaaacaaatgagtcaaaactaaagcttctccagcagtgtcttcatataacctaagaaaatgacggaacagtcccccaactaacttattgtttacgatttatttgtacctttactgaaggtacctttaatattgtaagaaggcacatatattcattctttcacaataataaacaaaatagtagagatgagacaaatcatgacacacgggagtgacacacagagtggagttttatggagttggagaataagatgattgtgaaattgagaataacaaatttgaaattttataggctgctttagagcagaagtatcagatttcaattaaaagtgtttttgaagatgaacgtggcatcaaagtttagaataggaaaaaaggctattgctatttgaataggtcagttagacagcagtggaaatataaaagtagggttggatggaagaaaaatgcagagaaaaaattccatcaattagatgaaatggataatgagaaaaaagatgcagtcaacaattataggaatattttgagcctaggtgtgggggagactgtaagaacactgacagaatgtggagattcaagaggggagctggtatatgtctgcatgcttagggagtataaaatgatagtgactttactttgagatatgccaagtttgagaaatgccacattccttcctatgttttatgaatacagaaaatctaagtttgataaatgtttcaccaaagatcaatagagactatcaaagactatctctaatttattgttcagcgagtataatatatggtaaaatgcactgattttaggtgtacagttcactaggctttgataaatataccttcccaagtaacctacacacaagtcaagatacaaaacatttccatcacccctgaaagtttccttctagtcaagccccactcaaatgtgaaatttcaatgtctatcaccataaatggctttgcctatacttgaactctgtatataatcatacggtataccagatagcatatgttcttttatgcctggttccttttgttcaatgtaatgattataattcttgttaaatcttccagtagttaattcataagtattcaattgtataaacgactaataacctactacatataatattacattatatgaatttaccataacttatccattctcctgtctatggtcatttggcttgatccagtatttggctattaataaacaaagctattacaaacattcttctcagggctttatgttcttatacaaagccatatatcctttcattcttaagtaaataggtgtgaggttgccagggcattaagtttataaggaaccactagttttcaaaaaaatcctgtaatatgttataccctcaggagcacggtacaagaatttcagtattaccacatcctcaccaatgtttggtgagctcagtccttttatttttatctttttcttgtggatgtgaagtggtacttaaatttacatttccatcatggctaatgatgtcattattatggcttcaaatgtttattaaacattcttatcttcttttgtgaaggttctgtttaagtaatttgccaattggaagaaaaatattttctttgtattttttgagttgtaaagctttgttaaatattctagattcaattccttttcatacatatgtattgcaaactattaatatttgccctttctgtggcttgcctattaaaaatgtttttttatagggagcctttaatgtttgtggagtatagttaactgatttttttctataatgtgagtgcttttagtatcctaagaaatagttatcatcttttgactttttctagaaatcttataaattttactttcatgtaaagatctaattcaaagtatatactttgaatcaatttttgtgtatggtctgaagaaggtgttaaggttcattctgtttcaataattgctctagcaattggctctttttctttttctatttttttttttaagagactgtgtcttactctggttgcccaggctggagtgcagtggaacaatcatagctgactgtaaccgagtacccctgggttcaagcaatcctgcctcagcttcccaagtagctggaactactgatgtgcaccaccatgctcagctactttgactatttatttagagatagggtctcgctatgttgcccaggctggtcttagactcctaggctcaagcagttctcccacctcggcctcccacagtgttgggattataggcatgagtcaccacacccagcctccatttcttaatgagcctttctcctatatgtaacaaaattgctttgttattaaatcaatttactgtataagtctgtgtctatttcatgataacatattctgttccattgatctatttgtctatctttgtctagtatcatattttcttaacacttttatagaagtcttgaaatcagaaagctagtcccccaacactgtcatctttttctaaaataatttgacactaataagtccttataattctgtataaattttagaaccaatttattaatttccaccaaaaaaacataaacttttgggactgtgttaaatatacacatattttgaaataaaaatcttaatatagagtcttccatttgcaatttcatttaccaaatgtttcttactgtatagaaatagcactgatactttacatttatcttgcatcctgaaaccttgtaaattcaagagatttttgctaagttcaaatagatcttttttagactccataggattttctatacaattttttaagtaaatttttgacttgctgtctccaaatatttttattattcttttccaatctatatactttttatttattttactggcctgactgcattggttaggacctccagtacaatgttgaactggtgagagtgaacacccacatctcttttcctgatttggagggaaagtattcactgttaacatccttagttgaaggtttttcacagattccctttaacagattaggaaagataccttttattcctagtctgagtttttatcatgattagaggttgaattttattaaatgctgtctctctaactagtaagataacctttttttctattaatgtggattgattttgaatattaaagaatgcatacatacttgaaattcatttttgtcaggatatattactgtatgttaatacataataacacatcactgcagtgattatgtgttatttcctaattgtatgttaaacatttttgtgtctatgatcataaggcatatcgatgtgtgacttttttaataatgtccttatcaggacttggtattagaattacaaagctctcaaacaatgactagaagtgttctccccacctctatttcccgtctttgtttaagactggtatttcttcttaaatgtttgaaggaattcattagtgaaagcatctggatctggagtgttctttgtgggaagcctctgaattataaattcaatttagttaacaaatacagagctattcccattttctgtttcttctaatataagatttagtaaattttatcttataaaaaaaacttgtccatttcatctaagataagtttgtttcttatggcttctcataccctataataataattccttcacttgactaaaccatatatatttcactggacctcctttcttggtacattaaactcgctggtactttttcctcttctgagagcttctccagcccttactgacataattttgcactgccatgtgttttcagtcatctttattagtttgttttacctttgaaaaacagattatagtgtcctcagaggcggaaatatcttaaactttcattgttctccatggaatttagcatagtctgttaacattttatatgtgtttctgagattatggatttgttcactgttggttagcttgatatctattacagatgtgcttggagcatcttatagtaataacaggaagcatgaaaatgttagaaaataatgataataataactaagattggacacatcaaagtaacagaagccaaccttaaagcgcttccaatggccaaactgcaacaatttgagaaacaataaataataatactggactatatacctcaaagaataaaataatgatccatgagttcataatattgtcaatagtcaactgaatgactgaatcaataaatgggtgagaaaagtatctttcttgcagaattctaaatttaaaaaaaaagatggaatgagagaaacaataattagaacatctagttagaactgctacaggcaaaactcaatgatgaatacaaaaaaatgagtggccaaaagccactcatttaacaaggagcaggacagttaaaatgactcaaagtagtatccctaacatattaattactatggtggcttttaacatgtgtctacaattcttttatattcttccatcaggagatggaacttaatttttttccccttgactggatgatagaattagtgacttgcttgaaactaatatggaagaggaaagtagtaattgtggagaaacctggcaagcaccaccttaatcaagtaatcaaggttcacacatcaccatttaaagtcatgttgatatcatgtacctttgatattatgataaatgtactttaccactgtggtatttttccctaatatccctaatgctcttctaactgtgataacatattaggaaactaattaatattctatgaaatatcagacctttactcttaaatattgtcaaggtcatgaaaatcaaggaaaacctaaaactgtcacagattggtggatactaaagaaatatgatctctgtggtatcctagactggatcctggaacaaaaaagggacacagttgaaaaactacttaaaaaaagagtaaagtatagactatagttaattgtattgtgtaaatgttaatttcttagtttgataaatatactatatttaggggcaagcaagagtaatttggaaacatctttggtaacagctataaccactacttccaaaaaagacacaggttgccaatagaaaaattaataataaaggtcaatatccacaatacaaagaccctggacacaaatccacttactcacagacactgacacccggcccacccacagccctcatcaacagggccacctgcagaccctgtcaaatgtcctgcccagaatctctttccaggatgacttgtggagggctttccctaccaaaaccagtctataaagatggagagaggtgactgcttcttcaagtgcacagacaccaacacaaagatacaaggatcacaaagaatcaggaaaatgacaccaccaaaaagacaaaataaagctccagtaaccaaccctaaagaaatggagacctataactgccagaaaaagaattcaaacaattatcttaaagaagctcagtgagctacaagagaacaaatcaggaaaataaatgaacaaaattagaagttcaacaaagagatagaaaccataaaaaagaaccaaatagaaattctggagctgcagttattatgactgaactaaaaaattaaacggtttcaacagcagattcaatcaagcagaagaaagaataaactcaaggatatgtcatttcgaattattaaagaagaaagaaaagtgtgaggaaattccactagacttaagagcaagcagactaatcagcaagtaagctaatatatggactagcaagcaacatcagcaagcaaactaatatatgcattatgggacactcagaagaagagaaaaaggaacagaaagcttatttaaagaaataatggctgaactttttaaaacctgaagacggaaatggacattcaaattcatgagagaactcaaataggtggaacctaaagagttctaggagaaattactattaaattgtcaaaagtcaaaggcaattttgaaagcaagagaaaaaggactcctcacatatataaatctccatacaactattagcagatttttcagcagaaatgttgcaggcaagatgagagtgggatgttatattcaaagtgctgaaagagaaaaaaagttgccatctagaaatactatatctggtaaaaatgtcctttaaaaatgcatgagagacaaagatgttccaagacaaatgaaaactaaggaagtatgtcaacactgggtcctccttataagaagtgtgaaagggagttcttcaagttgttacaaaaggatactaaacagcaacatgaaagtatatgaaaatataaatcttggctggtaaaggtaaatacacagactaatacataacaatgtatattgtaatgaagatgtataaattacttataatcctaatataaagtaaaaagattagttttaagaataactattaccaaaaatattaatgcacaatataaaaagtaaactatcacatcaataactgtgtaataaacatagtttttgtgtgttattgaagatatgttatcttaaaatagactgttataagaagttttatgtacacctcatggtaattacaaaagtatagtagatacaaaagatagaataaaagcttattactacaaaagctcacataataaaacagcaaaaaggaagaggaacaaaagaactataaaacaagacaactaacaatataacaatagtattttacttatcaataatttaagtggatcaaactcaccaaataaatataaaaataagattcaactatgtgttgtctacaagagaagaactttaaatttaaggacacacagactgaaagtaaaagaatgaaaaaaaaatactcaaagcaaacagtaaacaaaataaagcaggggtagctatttttgaaatatacaaaatgcttttaagtcaactgtcacaagagacaaagatcattatataggggaaaaaagagtcagtttaacaggaagataacagtagtagacttcaataactcatcttcaatatggattgatcacacagaaagttattaaggaaaacagcagtcttgaataacactatataccaaatggacctaacagaaatgtacagaacattctacccagcagcagtagagcaaacattgttctcaagtgcatatagaacattctctagggtagatcacatgcttggtcacaaaacaaatctttattttaaaaagattaaaatcataccaagtatctttctgaccacagtgaaatcaaacacaatatcaataacaaaaaaagagaaaattcacaaatacatggaaatttgaaaacacactcctaaacaactattggctcacaaaaagaaatgaaaaggaaatttaaaaagtatgttgagaaaaataaaaatgaaaaatatactaaaacttattggatgcatcaaaagaaataataagagggaattttatagtataaacacctaccttaacaaaaaaaaaaaagctaaatgaatgacctaattgtatgctttaaagaactagaaaaagaacaaaccaggccaaaagctaacagaagaaagaaaatattaaacgttagaacagaaataaatgaactagaaaacagaaaaacattagaaaataatataacaaagagttggttttttgaaaagataaaatacacaaattcttgcccagactaagaaaaaaagattcaaataagtcaaataaaagaggggccattataactgatgccacaaaaataaaaaatatcataataaactattatatgtgacaatatatacgaacacattggataacctaggagaaatgaatacattattagaaacacaggacctaccacactgaatcatgaagaaatagaaagcctaatcggatcaatgacaaataaggagagctaataagtaatcaaaaaccacctactaagtaaaagcccagtatcagatggttccacaggtgaattctatcaaacatttaaagaatgaatgccaatattcttaaactctcaaaaactagaagaggaaacactttcaaactcattttatgagtccagacaccccaatacaaaccaagacaaagattccatgagaaaagaaaataggccaatatctctgttgaacattaatgtaaaaattttcaacaaaatagcagcaaaccaaattcaatagtgcattaaaagggtcatacaccacgagcaaatgggatttattcctgggatgcaaggatggctcaacatatgaaaatcaatcaatgtgatacatcatagtaacagaataaaggataaaaatcacatgataatattaatagatgcagaaaagcactttataaaattaaacacgctttcataataaaaacttaacaaattaggtaaagaagaaacttaccttaacaaaataaaggccttacatgaaaagcccatatgtatcatcacactcaacggtgaaaaactgaaagatcttattgaatccagaacaagtaaggatatccactcttaccatttctattcaaatgagtactgaaattctagccagagcaatcaggcaataaaaagaaatatatatatattttttactttgtaaaggaaataattgggaagaaaaaataaaataatctgtttgctgatgacatgattttatatacagaaaactctaagaagtccatacacacagaaagtgttataaataataaatttagtaaagttacaggttgtaaaaatcaacatataaaaattagttctgtttctatacataaacaattagctatctgaaaaggaaattaaaacaatcccatgtacaactgcatcaaaaagaacgaagtactcaggaataatctttaccaaggaggtgaaagacttgtacacaaaaactgtaaaacaccgatgaaagaaattaaatcacacacaaataaataaaaatcccatgttcatggaaagacttgagatatcaaacaaaaatattttgatttgaagaatatcaaaatgttcacactatccaaagcaatctacagattcaatgaaacctctatcagaatcccagtggcatttttttacagaaacaaaaaatacaatcctaaaacgtatatgaaaccataaaagaccctgaatagccaaagcaattttgatcaaaggaaaatctggaagtatcacatttcctgacttcaaaatatagtacaaagctatagtaatcaaaagaggataacctggcataaaaacaggcatatggaacaatggagcaaagtagagaatccagaataaacccaggcatgtaagatccaatgatctgcaacaagggtgccaagactaaacaaatgatggtggaaaaagtggacatccatatacaacagaatgaaattttacccttactgttacactgtatacaataaaaactcaaaatggaataaagacttaaatggaagacccgaaaccacaaattttctagaagaaaagctccataatgttgacttcagcaatgatttattggatatgataccaaaggacaggcaacaagagcaagcaatagatatgtgggatcacatcaatctagaaaactacaccacaaaggaaataatcaacaaaatgaaaaggtaacttacaaaatgggagaaaacctttgcaaaatgggggaaaataatttatctaataaagggttaatgtcaaaaatatatcaggaattcctgcaactcaatagcaaaaaaatccaataaaaatgggtaaagaaactgagtagacatttctctgaagaagacatacaggtatatgaaaacatactcaacagtaccaatcatcagggaaattcaaatcaaaactgagataccacctcacacctgttaggctattataaaaaataaaaagataacaaatgttggtgaggacacagagaaaaaggaacctttataagctgttggtgggaatgtaaattggtgcaaccactgtggaaaactgtatggggattccttaaagaatcagaactaccactggatagtagaaatcccacttctgagtatataaccaaaggaatcaaagtctgggtcacaaagagatttctgcactatcatgctcactgaagcattattcacaataggcaagatatagaaacaacctaaatacctgttgacagatggacaaataaagaaaatgtggtatatacatacaatgggatattattcagccttgaaaaagaaaatcctgtcatttgcaacaacatggatgaatctggaagacattatgctcagtaaactaggccaggcacagaaggaaaaatgctacatgatactactaatatgaggaatctaaaataatcaaactcataaaagcagatagaatggtggttgccaagggccagaggaagggcaaaatgtggaggtattagtcaaagggtaaaaatgttcagttataaaagacaagtcctagggctctactgtacagtagagtgcctatagttaatattttgtaagacttaaaatttgcagtgacattatttgctcgatcttatgttaaatgttcttactgcaaaataatatgaaacttttggaggtgattaatatgtttatggcatagattatggtgatggtttcatggttatatacttatctctaactcaccaagttacatacattaaatatgtaaaaattttacattattcttacctcaaagtgatttctctttaaaaagatcaatatccaaaaccactctgacttcaaaagtcaggtagatagtactgacttttttaggaaataaaagaaacacctatcttttggtgaggtaatatccaattattttacattttaactttcaaacaactgtaaagagacatgagatttatacttgttctagatgcttccagttcaacatggtaatcggatcacatcaacttattccatgccttctcaggttcccaaatagccataaatctacaaagccaaagaaaattggagtgaatgaggaaatgctagaaaaattctagatgatagaattgaacaggactgagaaagctacagcctaagtacatgtgagaagaaaggatgatcaaaagaaggcagaaatttgagagaattctgtagggaaacaaccagatttctagactataccctaaaaagcaagatatcaggctataatctctgatacaaagtttgcagtcaaattttctttcttaaatataattgtataacacttactgacagacatttgaagaaagttggaaagataaagaagtctgcaatcaacaaacaaaaataacccttgagaagtgtctgtttatatccttcgcccactttttgatggggttgtttttttcttgtaaatttgtttgagttcgttgtagattctggatattagccctttgtcagatgagtatgttgcaaaaattttctcccattctgtaggttgcctgttcactctgatggtggtttattttgctgtgcagaagctctttagtttaattagatcccatttgtcaattgtggcttttgttgccgttgcttttggtgttttagacatgaagtccttgcccatgcctatgtcctgaatggtattgcctaggttttcttctagggtttttatggttttaggtctaacatgtaagtctttaatccatcttggattaatttttgtataaggtgtaaggaagggatccagtttcagctttctacatatggctagccagttttcccagcaccatttattaaacagggaatcttttccccattttttgtttttgtgaggtttgtcaaagatcagatagttgtagatatgcggcattatttctgacggctctgttctcttccattggtctatatctctgttttggtaccagtaccatgctgttttggttactgtagtcttgtagtatagtttgaagtcaggtagcatgatgcctccagctttgttcttcttatgcagccaaaaaacacctgaaaaaatgctcatcattactggccatcagagaaatgcaaatcaaaaccacaatgagataccatctcacaccagttagaatggcgatcattaaaaagtcaggaaacaacaggtgctggagaggatgtggagaaataggaacacttttacactgttagtgggactgtaaactagttcaaccattgtggaagtcggtgtggcgattcctcagggatctagaactagaaataccatttgacccagccatcccattactgggtatatacccaaaggattataaatcatgctgctataaagacacatgcacacatatgtttattgtggcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaacccaacaccgcatgttctcactcataggtgggaattgaacaatgagaacacatggacacaggaaggggaacatcacacaacggggaatgttgtggggtggggggacgggggagggatagcattaggtgatatacctaatgctaaatgacgagttaatgggtgcagcacatcaacatggcacatgtatacatatgtaacaaacctgcacattgtgcacatgtaccctaaaacttaaagtataataaaaaaaaacccttgagggaatttgagtgattgacagaatagaacttttaaaactctaaaaacataaagaagattttattaaagaaataatcagacaattatcaattttacaaaaatcaatataaagaaaattgtgtttaataattcttccagaaagcttttaaaaactgaaagagaaatgaaaaacagaagacaaaagacaaaggatatagagaatccaaccagaagacccaactactaagaatgccaaggagaattcccagtaagaaaagcaaaggagaggaattcaaaagaaatttccacaagtgaaggtcaggtgttttcaaaattaaagggctcatcaagaggtaaacataatcaatgaagaaaagaatcataaccagatatgtttttgtaagagttcctacagataagtttctaaaaactgaggaggaaaaaattagtaacttacaaaggggcaggaatcgaatttcttgtcagcaatactggatactaaaaaatagagcaatgccttcaaatttccaagggaaaattgtttttaacttatatgtcttaatctagccaaatctagccaaaataataagtcactttcagatatacaaagattcggagtatttacttcccacatgtcctttctggaaaaattcttgaggatgtgcttcagcagtaaataaaattaaagtaagaaaaggcatgaatccaagcaagagcaaggcaagatgcctgtgtaccagttaccccaacctgggacagagggaggtatctaggaaaaaggggatttctaaatattttattctatttcctgaggtgaaagtacttaaaaatgcaataaaggcagattacacaaagaaaagtaaaagcaattagaaactctaggaaaaacaaatacaatcatagtatacaacttagatcagtagttataactacatattcatacctatatattgatttttaaccattagaatcaacctaacaatattacaactagagttgtaatatatttgaaaaacattatatcaaccttaataatttaaaattaaaagcacatatgagagaaactggaaggcattaaagggaggagttatagaaagaatgattgttatggtctgaacttgtccaaaatttgaaactcaatcctcattgtgctgttattaagaggtggatggaagctttggggaagtgacaaagtcacgagagctccatcctcatgaatggatcagtgccttatagatgggctggagggaactggcgtaggtccttttagctcttctgctatgtgaggatatggcattttcttcttttgctcttcctcctcttctatgtgaggatgcttccatgaaaacacactatggatagaacaggcctacactagacacagaaactgccagcaccatgatcttgtgctttccaacctctaaacttagaagaaacaaatttctgttctttatatatcacctagtgtcaggtatttttgttacagcaacacagactaagtaatagtctcatcttaaaaaggaatcatttggtactgtatatgattgagatagaaatgaaagaataagtatattattcaaaggtatacaggtaacgagaacttctgggttttcctctctaaaatatttagaggttttactctctaaaataggagggtattttagcaatggggagctgctagatcattatgtatcacagtgattaagtcaacagataatattgaaattttataaatcaagaaattgtgatcacatacacatgcaatacttgattcagccaatattacacagttagaactaaaaaggaactaacaaaaatataaacatagaaacagctaaaaaaaattattagtttttctttgggcagtaagtctagaggtgggatccaggactatagtttttcattataagccctcctatactctttaatttttaaaagcatatatatgcatttattgatcaaataaatgtgaaacatttattaatgtttaaaaatccatctggaaatcatccagctagactaatgcttcatcataatgcagctctcagcatttaaataaggtcttgttggtaattcagaaattactacattttaaagctcaaatagcaatgtcttctacacattctactctgtggtaggaaatatcacagcaatattttagaacagatgacaaaatagcctatatcagggatattaggtgttaaagaaataaaactggttaaaatatttgttaaaaatatgaggtgaataaatgcctgtcctaatgagtctccccactagtatctaacacatgttagagaaagaggaacactggtctctctgctcactagtacaacaatggatgactgcttaaattgcagccatcctgaaataccttgagtctgtcatttattccctctgatttcctatgagaaagattacaaattgcccactagaatcagggtctgtgagccacatcctccactttcatttctaggacataatacctctgccgtcaatcacagcacagctcaaattttttgaagcatagtgggatacaacagaattgtcacttaaaatttggaatacatctgatgtagcacgaactggactttctaagtgtgttaactactctgcaatatagatttggaaaatgtgaaaatgaagtggaaaaccttaaaaagacaaatgtccaaataagaaagattacagtctgtggatggtattctcattcatcttcaaatttcctttgctttgtgtttaaaccaaatgaagaggttttccaatgtcatttgacacaggcaaacatctgaaattcaacagcaaagtccccttcttgcagaagccttaaaaatgaaagctggtttgcttttcctaaagaaagaaaaaaaaaatgtctccccaacccccaacacccaccctttcctgaaagagaattttccagcagctggaagtttccagacctatgttctcagtgttggacagccttatatttacccatttttagcaaaattagggctcagaaagtttcatgagtagtggtacacatcagacgtctgttggaagtcattgtggaaagggtttctctgtacatatgtatagatctaagtaggagatggaagtcaccaaaataattttgtaacagaacagcaacaacaaaaagaataatctataaatattataggactttcttggtgtggataaaatcagagctcaaaaagagcctccagatcaatccatgtgagattttacaggccttctagaattggtaacagacaaggttttgctctcctgccagccggcactcctatttctgatgcattcatacagagtgatggttgttactaacattgtaattacttatacaatccttttaagaatgtaagttccatgagagcaagaatgttatatcatccactactgtattcaatcatttagaagagtgtctgacatataataggtattctgtaaaatttttaaatgaataaacaccttgtaaatttactgtaaagagcaaaggaataagtacaggtgaaagtgctttgcaaattaaattctaaaaggtgagcagttgttactctgcataatccaattcctgttggggcccgctcctaaaggctctgacaaagccattgcccgcattttgattccttctactgggccataattagactcatctacgtgggagaggcaggataatgcagttgttcaaagtgtaaaccctgaaactggacttcctgagttcaaatcccacctctatgactgactgactagctatatgatcttgagaaagttatttaacctctctatgcttaatttccttatatgtaatttgggagatgataatgatgcctaacttatagggttgtgataattaaatagattactatctgtaactcattgaaaacgggctggtacaaagtaagcattaagtacggctgctagtgttgttgctaccactcctattactatagggatgcagaaaaaatataaggaaattcagcaatgtccatactgcgaactttttctactaatgccacgtgcaagtttaaggctatattttacattgctgaattcctctgaagtttcaacttcatgaactattcttctacatatttagttccttaaagagctcaatggagctacagctcagtaagttatgtgttttggataaaataaggatatgagctgaggcatttaatcatagaagcagcctcaggctctctatccattcttggcttgtttttcaaagcacattgctaaatgtgttttctctttcataaagttttttaaaagttacttggacatgacaagcttctttaaatataaaacagtttcaatttttattgagatttgcttcaggaacattcttagtgttggtaatatttttagacaataattttattcagaagaccttattttatagattaactgcacaatagagttcatgcagttacatttacatggactttgtgctccatagtactgaaatccaaatatcagtttacttcagtataagcatatcagattgacctgaaatgctctagaacttttaaaaggcaaacgccaaaatgaaacaacacaccacctctcaagcatgtattctgtgctatgagcaagatctttcagttagaacttactaaattaggtcaagaggttctcctgggataaaggagtttgccaaagtaattctaaaattcccaaaataaggcacacagcactataacatttcactgattcttactcgttcttttatagtgctttgggaaatgttagaccattggtctgcatcatttcacctccttgtaggggaaaaactgtcaccagcaactgctgcttcaaactgtaataatcttccaggttcattctagggaatccaaaaggcgagcaccacatatttcctttcctttccacaggcgatcatgcaaattccctagcttaaggctgagaagtgcgtatgtgtgtatacttatgtatattatgtatatacagcctatggatattatatatatatacactatggacaatatatatagtatctatggatattatacatatgccatccatggatattatatgtgcataatctacgaatactgtatgtagatgcatatctaatatacatacatatacatgtattcattattttatagaatcaagttgagcttttcaattactggcagatctacaaaggctgttgagatttaaaccattacaaacaattacatgagagttgtcccggagtcacagagcccagaaagctaattctaacctgctttccttcttatgtactatatacttctaattacccagcacggttaggttctcataccattttgcatattttcatccaaaaattcaaacctactccatcctgagaacaaaagctggcaagaagcactcaagtgatgggtgaacaaatgtattaaaaaaagcaacattctgacatggaaatgtcatgtgagctgccgaatggcacacagctccaaagtctaccataatattttgaaacactttgccaatgagcatataattgactgaaaaacttgccagcactattccagagatgtttaaatactacataataaaacaatttacagaaaagaattaaatgttagaagtacatttttagaaagcttccaaaaccaatgtgtgtgggttttttttttttttttttcccattttggagccaaagaaataactctgatattctcagttctcacactttgccttccatatttgacctgctgcctatcacttgcatttttgcatagcagtcacatcagtcagtaataaacctgtatttattgagaactttagaagtacagatatcttggcgcaaattgctataagatcctgcctcatgaggtcagcatctgtgcttttttatgagcatttttccatccatctatctttctaacaagtatttattaagcacctaagatatgtcaagtattgggttagatgccagagagataatgatgggcaatataatgtgactgccaccatggagtttatagcctatctgggaagggtcacagttaaaggaataataatcataatttgtggctgggcgcagtggctcacgcctgcaatctcagcactttgggaggccaaggcaagcagatcacataaggccaggagttcaagagcagcatggtcaacatggcgaaaccctgtctctattaaaaatacaaaaattagctgggtgtgctggtgcaagtttctaatcccagctactagggaggctgaggaagtagaatggctcgaacccatggggcagaggttgtagtgagctgagatcacgccactgcactccagcctgggtgatagagcaggggaagaaagggtgtaaaacattaaaaaaattgttttcagaaaaacaatggctggtatgtagagaaaacaaggggcaaagcggtaagaaaaaagaccggagaggtgagcacaggctgggactattactgtttttctaagatccattctttgcccttggtcactcttctatgatcatttatagttttaataaatactggactgggtaactaacaacacatcctgaagtaataatacacaataaaactattattccattattcttaacacagacttctccttgtaacccagtgaatcatctgtaacaaaacccaaagcaactatatatctattccacaaggaaatttttagtttttttattaatagatgataggtcaggctttatgaccatatctgcatttgtgactgacatttcctttatgagatttattataatgaggacaaataatacaaaagcaatacatttaaaatcaataaaaaaggagaaaaatcataagtactcctttacctttcaggaaaagttaacccttagctattaatcacatagtttaaaaaacaatataggtttcaaagaaatataaggatctcaaaactatgattctgcattaatttattgtataaatgttttcatagaaaacatcaatatttaacagtgaaatgtatatattaatgcaatgtttgtttatgttcaggtacatttatatacatatttgcatgtgcatttatttctgtcaataggcagttacaggagcagtaataattagcttttattcttgtgggttaagtagaacaataatatctatctacttcatgttcacttcttgagacaaagaggcaattttttatttcagctcttttctttttgttggattctattaaagttgaggtagaataaaatacaattcaaaccagttttacatatctttaatgtgtaattgagagttttttgtttttagtcctaaatactttggctccatcacagtaagtccctatgggtagctgctaaattcttaaaccagaagcaattatatttcaggaaagagtcatttaaatgtttgtatctagcaccaaatgtatttttgtcttaataaattataaaatgtctttcctctcccttattttttctaagtccaccctttcttctctcttgactttggcatatgaacttgtacttgtagccaaacacatcagttgagctgggagtattatcttaaacagctggaagggaatgatgaagatgcttggccagcccatcacccagccagccttcctctgtttcctccccacccaagttctagattttggcttcacccaatccaaccagcctcttctaattaactcttccatactcagttgtctaaagcgatatggcaaaacttactgccagtcctattttggattagtttgtagaatatttgtgtctttacaagtcatacctttacaacagctcttgttatatgaatattctacaaattaactcccatcacctatgtctgctgagcattggaatattagttggactgtcaagatgccatagaggagacaggtggtttctatggagaaaagcagctagctgccagaggtccagctccaactgtagcccccccttcctaaaataaccttgtcaccaggattgaggctttctatatgccagattgtaggttgaggcacccacagtttcaacaagactacttagctatggtagcttcatcagtaactttcagatacacattttgtttcattttcatgggaatgcaacaatattaaccccacagaaagaaatggatgctcagagcattaactgatttgttcaagtcacgcaaccagtacacggcagaggtgggaccaaaacacaggacttctgagtgcctgtgtgtcatgtactccaaaacagcaaagtctttggcaatgtctctcaaaaattctcagactgtatctgcataaaatcgctgtgggtgatttttaaaatgcacgttcctggatgcagtcaagacctaagaattacattctctgagagtggggccaagaatctgcattttaatgaggtccctaggtaattttcattcatagtagagttacagaaaggctaagtcttttcttctattcctaaactttggagtatccgtttttcatcagaaatgcttctgggatctttaaattaattgcctgggttgtcttaggaacaagtcaaatacttatataatattttctacatcctaggtcttgttaattgattaaattctcacaacaaccttacaaggtagataatagtattacaatactcatgttatagataaggagacttaggcacagaaaagctaaagggacttccctcaaattacacacaagatgtgatcctgggccatctggctccagagtccatttgtcaaccactacactatgctagtgctacagcttcaaacaaagaatcacagtcactgaaaagtgctggagagcaactgctcgtggaaatctttgctctgagcttcatggaacagatcagagttcctccaggatgtcctgctccatactccaatgccttcacagctgttctccctgctaacatgccatgtatgccctcctaatctgacaaaacctggacacttcctggatgtccagagtgagcctgatgtccctcatttttgttcccagggcctagtgcacacaagcctcctggcactaattatactaacctatacctgcaaatctaagcctattttccacaggaaactagaacttcctaagggtagatattgagccttatttattttctgccctaagtatctagcagtcagcgggaactccatagatgcttgtggaataagtgaatggtggaatatacagtaaagaatggttattccctttataacagaatttaccaaaagtttctgaatccctgtgttcattgacatatcattaatgtcttgacagaaagcctaaaggactgaaaggtaaagccactgccaactggagatcaatccagtatcagataaaacatctttgaagtcatgatgtaagtcagtgggaaagcttctacgggatctaaaaatgtgaattagacacagcttttcaaggacactcctgttgcacaaaagggagtgtacacgttagagaaggtttgcctcagtgctatcaacatgtaagcagatggggacatgaaacagcttgtgaattcagtccttttctctccagctggcagaagcaaggattttgagaactctgctctcctgtctactgaaggatcatgtttccctgctctgcaatgaccatcaaagccatctgggaaaaacaaaattcttttgcacaagaacatagggagcaacagggaagaacaaagctgcagtactttggttctttggctcccgcttctggaaaactctagttggtattttatctagcttgttctctcagtggtgtagtaaatcaaacaggatagttgcaaaatgttctacagtgttggggaagaagaatttcttacatgcctagaaagccaccagggttgtaaattaaattcctcaaacaaagcagccccaaacacacagaatattagcttccccattttgtgtagttttctaagctcttgagattgtgtacatgttaaacacattcactgccattttcttccttgaaaaagattttgagttttctgtcacatcaaagaatgtatatcaaagaaatacaaaatggaatttgtgattagtagaaacagagcatattaatttttccttctaaacaataccctaagatgaaaacaggctaaagccattatgctaatccagtgatggaaggcacagattaccacacaaataaacaatgtgtgttacagaatacagactagagtgtgcctcacaattatattttatggtggaatatatgtttacggagcttttggcctggtcatttaagaaaaatgtccttaggctgggtgtggtggctgaagcctgtaatcccagcactttgggaggccgaggcgggtggatcaccttgaggtcaggagttcaagaccagcctggccaacatggtgaaacccggtctctactaaaaatacaaaaattagctgggcgtggtggtaggtgcctgtaaccccagctatttgggaagctgaggcagaagaatcacttgaacctagcagttggaggttgcaatgagcccagatcgcgccattgcactccagcctgggcaacaagagtgaaaccctgtctcataaaaaatgcccttaagtttgtaggtctctacaagtttcatgtgaaatatggagttctgtgaaagccatatctcatggaataaatcccaatcaatgtctttgaccagaagttcaggagtgagtgccctctgcctatggtcacaggtttaatcaactccagtatgggccagttatctctgctactatggtctgaatgtgtgtgtctccccaaaattcatatgttgaaatcctaacctccaaggtgatgttattcagtggtgcgggcctttgggaggtgactacatcactagaatgggattagtgctcttatgaaagaagcccaaaagagaaccctcattccttccaccatgcaaggacacaactagaagctgccatctatgaacaacaaagttggccttatctagacattaaatctgctggcaccttgatcttgaactgtggaaaattcagttgttcataagccacatggtttatggtattttgttatagcagcctgaacagactaagatgtctgctctgcccaacagtcaaagaatgtactattatttccttttaacatggatcctatgggacaattaggcaggaaacatagatgcttgttcaaagaaacagcatccccaaaacaaaaccaatctaagaagtgcattcctcatgaagaagaatttatcaaccatattaacatgttgttctctcttttaaactcctattttttgcttctttttattcagttcattctcaggaagtgtgttgtgagaacagatctaagccaatgtaatcatcaatattatcaatattaggttccttctggtaggtgagatacgtgggtctcctctcccataccttactaccaaatttgtcatacgttcaaatgtctattagcaagcagacacagcacaggtaatcagttccatgataattcactgtctctgttcttttcagtgccccccagcagtttgcatcaagagctcaggggaggcagatgcgttgatgttctagtgcaatactcagcattattttagttactatagaacaatcctgcaagcagaatggtctaggctataaacctacagtgatattagaaaggtgaccagatttccagacttgtatcactagattcccaaattttgttcatgcaatagtacagaatccacaaatcttaaactccatttaaccattgtaaaaaaaaatacatttctaagtcttctttgttgatcagatatgttgataattgaaatgtttatggtaactacctcatgcatctttgaaatactaaacactctgaattgaatatcctcaattaggtgcttcagatattggtttaccatctctgagagatagaataattcatgtgtaatacacacactccacagtgtccacatggaagaatttaaaagtaaattacagaaagtaaaaacaagtggaacctctatttttaacattctttcattaaattcagcatcaaaatgagtgattccaggaagtacatgacaaaactctccccacccatgtcaagagtccttagcaaatcttgtttcctttctacagtatgtgaaagcctggggatccagagagcatggatagagaacaacaacaacaaccctgagcattagttccaggtaggcaaataaccatacaagtccatttagtttggaatttttgtgctaaagtttccctaagaggtattgtcagaccaactgagatacatattagttcttcctcagacaagtgcaacaggttcaattcggttgagttaaataacattatggaatacatgcttgtgtttctcccaatctcaccatcaaccttatatgccagctttgaactattggcttacaggactgcattaatcacatgcctgcttaaaaaaagtatttgcctactaataagaaacaaattctttagcctaaaaacaaaacttcaacctacctctatagcctggttggcgactgctttgaccatttcttcccattccattgagaatgtcagtgtgagctagtctcaataaccaaaatgacttttcacacctctccaaggatccacccttagctagctctgaggatgtggtaaattaatctgtctcaccacagcacgtggcagaaagcttatactggatgttggtctggcagccagacaaactgggccacccaaagaccaggagaccccagaccccaggagtaggcctgaggtagacaaagtagctagtcagcaagagaaggcagcaccaagcaaagaaagtccaaggaactctgaatcccctgcgatcctctctgacttaccccgtgaagcctgaaatgtcttgtgccataagcaaccttcttggcagtcccagactcatattcaaagccctcgtcaagtttcctctgctctctatgcccttgatttagactgcagaattggtctggacttgcagtgggtttagtgtccctcccaggtccccagtgacatgtattacatctccctccttgaatgctttaccttgctttttaagtatttactaacgtaactgactcctcactgggctatacatttcctaaatgagcctgggccccattcatcttagtgttcccagaacctagcaaagtgcttagctcatagtaaatgcttttaaaaatgttcatcaaataagtgaataaataagtgcactctagtttagaaatgtaacagcacttcctcattactgcatagcttgttgatctagattctcattatcatgaccctggatagtacccattctcaaactcttccatagtggatcagaagcaagcccttgagccccttccccaacaaactttactggaatgtacttcattatccctggttttcattatccttggtaagtacaacagtcaatctgcacacacacacggtatcttgatgttttaattatcttactaataaattccctgaagtaaaaggcatgtttgtttgtttttcaattttatgacaatgttttatttaaattcttaaaaactctccggtatcactaataaataccatatgcaagaaactaggctagctgggtggggcccaaaaatgatatgatatcatctttcttttcacagatctttttatctacatggggaacaggatatagacccatgaactgaatcaccatcacacgaaccatgcagacagaggattagggaggctttgccggggggcggccactggtcaggtagagatggcatgtgaggatttgaaaagaaagtggtactgagacagaagacataatttaagcacttaaggtcaggaaagtggcagcaagcaagtctaggctctaaaatgctttgcagcaaccccagcagtgagcaagaagaggccgggatcaggcccagtggaaaggctgggtcgaaacaggctctatttaagatcagtggtggtcacccaccatatccaaacaatatgattcttccaacttagctaagggaagggagtaagggaagcagggagggaatgagggaagctcttagtgtaattacttgtagaaatttggtaatatatgtacactatgcaggaaacaatggtttttccttaatatagcaatgcatgaggacatatcactatttttcaaacaaaacccagaacagcatactcaaccctactctcttatttggagctgtgtgaaaaagtaaacttaacttttgtccagaccttctgaataaggtaaactgactcatgtctagaaacaggtttttttctatagtaagagaataattaaattttatattttatgaatatattattaaaaacaccaatcaataaactccaaaggatgagttcaagtttagaccaatgagatagccaccataagatgtatctgggtacaacccgatgtgatgacacatattgtgcagggtactataggcccctagagagcagcagccagtattatccaaagactgatatcagaggctcatgtcaggctgcttaacaaccactgagctgggctgggtattcccgctctcatcaagggggactgtgtccaaatcccacataaggagggctgcaaagtctcccctataccttagacagactgcacacaagtcaagtcctttgatgccaaagtaattttgttactgagccctataagaccactctcatgtccttccccctaaaaagtaagagatataaaatatactttgccctggaaggtccttgcttggagtgaatgtaaatagaaggctttgagtgcaaagacctactgaaaatataaatgttctaataatgatttatttgtaagcctaactcttctactggactgggagctccctgaggtctggtctgaatggtgtctccaaggcttcattcagtgctcagtggacggtgtaggctcagtacatgcttttttgagtatacaaaaaataaatgctacaaggcaggagagtggccctaaatgaaaatttgagttttaaagttgctatggcatataagtacttaagagacactgcagaaactgtatagaatcatgtatagaatcatgaatagaatcaatcctacatgtataacaatttatttgtagacaagatcataggagcagcattgtggatatcaaggtgggctcactttctaatgtcagaggctggtgctcattggagtgtgcctctcagtcacatctagttcttgaaatctgaggaaaaactctatttaaaagtagagagactgaaaaaaatgagtcttggattagctagattcagataattcaatatttttactactaaaccacagagatctagattactagggaacagaaattgccttgaattaaataccactctgggtaagctagtattggcttaatgagctttttgtgtactgggcttaataaaaaattgtattagtcattttatacaaatatagtggagctgatgaattactcataataaagaaaaataacccctaatccattttaataattcccatatttcaaaatacagaaatttgtcctcaagcacacagaatcctagatgataatacaggcccagagaaatgaagtgagttgctaaagtcacataactaattaatgaaggagataagattggaaccaaggtctcgcaacgccttgtctggcacacttctaccacatcagtgatttccaaacagtgccctgtagaagcccttcgaggatcctgggacagcaggtgagggggcctggcaggcacagttcccctctttgcatcatgctgtcttttcatgcagacccttgtgctttagtgcactggtacccagatttgtggatttcatgctactgtaaaaaaataaagaatgactacatacaattactatcatgtcataaaagaagggatattttaaaactcaaaacatttggaggagagaatcttggaataaatagaaattatttataaaacacagcatggttccacatttttctcatttcactaagaataacaggaaaaaatcctcaatgtggaaagtcactgttctgtagaccttcatttgggaagcagtggttttgtggcaagaacatagaatttggatttcaaccacatcacagtagcagtgcatcttgaatgactcattttaatttctaagttttgtttcttatgtataaagttcaatagtaattcctgacacacaccacagtccctcactcccatcctctgcaagagttgctcctttcaaagatatctacttctgttattctcaaaaggtgggctcaggactacttgcatcagaataatctgaggtgcatattaaaaacccaagttccttgaacctaacccagatgaggtttccaagaaatggggttggttttaagtggtttagtttagaaggcacaaagcctgagttgttattttttaatgatagtttacaacatctgctctaattaccagaggctgatggtaagattatgcagataaaattcctttggaaaactgcagcaactataaaaatagaaaacagagaataagggaaaggaagacaagaataaggactaaagagaagatgcgaggagggcaaaccatttattcttaaattagttttcttacctgatgaacaaggactgtgaacgggatcaatgactttttaaccaccccattagcagctaaactattttcaaagaaaatcttttaaggaaataaatcttttaagaaagcaatgtcttctgacaaaggcagagttgctctagtagaagtggcccagagttctgtcccgtcaatgccctatctcattccctccatcctcctggtagcctctgaggccccctatgctagaagataatagaatgacctgcttgctctctgaggtattgttctgattccagagaaggtaggtctaaccattaactaatgctatgtattttaatataatcaacacagaaaatgtagccacccaatcaccagattctccctgaaaagtgattcacgtgcaggacatcttaagcagcatggcacaccacaaacatgatcaataagaaggtaccacacttaattttttagtccattactgttcttcacctaacacagaggttctcaccaagtaatctgctccctttctttcctcaccggacccatggaatctgttgcttcctttccatcctccatggctacagccatcgtacaagtttcaggaaggccacccaaccaccttcttcacatcatcctagccttcagacccctttagtccatctaatatcttcttgccaactcattgtcttgatagtgacatctgaaaacaagttctcaccccatggtcttcatagagacaattccaactcattaaccccagacactcacatttcttagctcctctcattaaaaagcacactggtctaggggtctttttgagtcatcagggtccaagctcctgctccacacctcacacacgtgttcctctccaggctcctatctcaggagatgacagattccaccactcaccaaggtgttgagatcaaatccttatagtcactcttgacatgtttacttctctcaaatccccatcctacccacatgtatgaaacaaggcccctcctcacgccctccaccctggccaccatcatgcctccctggcttgctctctgctcccatcttcttctacttttcttcttgctcagctcactctgctccagctccctagccttcttgctgtcctccaatacaccaagcacattccagtttctgggcctttgtacatgcctgttcctctgcctggaatgctcttccccaagatgtctgcatggatatagccctcttttcattgaggttctgcttcaatatcactgcttcagagaggtcttccctaagcaccttatttcaaagagtgcttctacaactctatctttaccctgcttaatttttcttcataacatcaccacctgaaattcaattatatatgcatcagttgacacatttattatctgattccactctcatttgttgtggagcagcatgaagtctgagtggtaactttgtttctgacccagtgtcaccgatgtctagaatgatatagggcactctgaaggttttcaataagtcaatcactcaattaaacaaaaatctaactcatctttaaatccctcattttatcaactactccttcacatttaatattaaataatgtatatttttaaattttttaaattgtggtaaaacacacttaacaaaatttaccatcttaaccatttttaaatgtaccgtgcagtagcagtcattgcattcacattgtgcaagcatcatcaccatccatccacggaactctcttcatcttgcaaaatggaaactccacatccatgagacaataactccccattcttccttctctagcccctggcaaccaccattctactttctgtctctatgaatgtgactactctaggtacttcatataaatggaatcctataaactacaaatcattatatgcaaaacttgaataattctctttaaaccttgcatcaactcaattcaatttttgactggcttatttcacttaacataatattctcaaggttcatccatgttggttctttggcctatattcccaaaagtagaactgctggatcatatggcaattctatttttgtttttttgaggaactgtcctaccgtttcccacagcagctgcatcattttgcattcctattaacaatgcacaagggttccaatttctgtacatcctaaccaacacttatttggttttttttgatagtagtcatcctaacaggtgtgaaatggtatctccatgtggttttgatttgcatttccctagtcattagtgatgctgagtatctttccttgtgcttattagccatttgtatatcttctttggagaaatgtcttttccagtcctttgcccattttttaatcaggctgcttgggtttttgttgttgttgggttgtagaggtttttagatattctgggtattaaccccttatcaaatatatgatttgcaaatattttctcccatccagtggggttactaaataatttatattcttcattttttaagttggttggttctcttaatctatccataacggtttctactttggacagtgtactcacagagaacagagatggtgcctgttgatttgatccatgcaatgcttaacaaacaatgctctatgcaggctggatggttaaagttttttgaagattatacaacaatatagtgtactatttggtatcacttttctttcaatagtggcagacaaatggaagtacaactgttaattaaaagcacataatgttgcctgattatgagtaaaatgtcccagctcactacagcacaattcctacagcattagtggagaattaactagctttattaaagatttggaggactagtcactttttcatcatcctttaattaaaacctccacatcttccacttaaaagcctttgtttcgtacccattattttcattctttattctggccttgaaaaaccaggatgaaaaacagtaaaagcaaaaacgtttctaaatgagcttttcatgctgtaataataaaaaggcatagctttctaaaatactgaaaaaaaataaaattttaatgttctttgaactagaaggccaggaaaagaaacagagaaaagcagtgtttagcagaacattttggagttcaatgttcttttatattctaaaatgaattaatgctactatataatttctctctaccttcccactcacactaactgaaagataccacagttgaggggtaccagttcaaggtcctaaagtggaaagctattgttatactctagcctactttacttttttcttaacttggaatcattatttattttgaagtaaatggcatgatgcagtggtttgaatgtgccccctccaaaattcaggtattgaaacttaatggccaatgtgataggattaagaggtgacatggtcatacgggcttgttcctcatgaatgggattacggcccatatgaaacaggcattacacagcattcggccctcttgcccttctgccgtgtgaagacacagcattcctcccctctggaggatgcagaaacaatgcactctattggaagcagagtgcagccctacagacatcaaacttgccagagccttgttcttgaaattcccaacctccagaactgtgagaaatgaatttatgttcttcataaattacccagtttcaggtattttgttacagcaacactaatgaactaagacacacggcaagacagaacctccctcaacctcagctccctcctcccgaagatccacgcataagggtgcccagcacagaccctcacaaatatcagacacttaataataaattaataatttaaaaaccattagctagaatttggtggatgttctgggccaaacctcatactgtgtgcttcatattcacaatgtcacaacaactacataggcagctgtggtcacttgatgaccactatacaatgttacacttaactgcatatttctccccataacttgcccaacccaagttacagactttctctcccctaaaaatactagaatatgctacttagggaaaggagaacttgattttttaaaaaatatattgattttggagcctacatttctaaatctttgtatacagtttatagagttcattacatagctaatttcagctcagctgagaagaaatctaaaaataatatgctttttggtttcgtcactgaaacattcattctgtcattgaatttagcctgatgcatcttacaagaagaaaaatctgatataatgtgtgtggaaaagaatttgactgatggaaaggaataaaagtgagccagtgcaatgtctataccagaattattatttgtatgattaaaacataaagacacctgaatttatcttttctgcttctgctgtttcagtctcattaagactatgtttctgctttcttctaaatattgttttccatatttcaaacatctaattaagtaaacacaatacaaagtgagatgatatactgtttggaaaaccataaaattatagagtagatagacttccattataatccaattttcattctgtcataattttccaagagagtttcctttggggttaaaattttctaagcttgatttcagttcaaaattgaatgttttcattcacttgtatgtagaaaagactcaattcagtcttttctgttgatcatatgagtgtgtttcctttaaaagtagacaaggcttaattttgttgatgaaacctatgacagacttctagacccaccttactttcaacttcttgggcacttaaaataattacttaagtaatataaagggtacagaagccaacagagaatatgtttctttgccttagtcctccagtcctaccctatgtacaacgtgcccccagcatataccctttgtatacataggactgttgtcttaccacagaaactaagaactagaattgttggatcaaaaggaatgcactttttaaatagtaatatatgctgcccaactatcttccaaaaagccttcactacattattataatctcaccaaaagcacatagatgagaatacctattgcctatatttattaacactgaatgttattgatctattgaataaaaagttatcttaatataaaatttcaaaattatgagtattttattgtccatttaaaaaattgtatctcttatcttgcctttgaatatttatttttcattttgctgcagtagagctgtaagttattctttcatagaaggttttgtacctctaaaagtattttgcctttatgtttgagaatcctaggttcaaaaagttttccacgagaattttaaagtcttgtgcttcactgtattacagaatccagggcggccaaaaagaagtccactaacagaatcctctttctttcttaggtagattttttaatatataggttatttgtctttcatcatgctgggaaagtgattgacccacttaatctgaaggcacaaatctgtcttcgatttagagaaattatcttatttatttgataattgccttgtattttgagaggactgcttcaatttctcaagtaataatattaataatgataacagaagctaatatacgttaaacgtttctgcttgttttaaatattttacatgtattaggtcatttaatcctcatagaaaccgtgttacagtagcccctccatccttagtttcacttttttgcgctttagttacccacagtcaaccacagtctgaaagtattattgcatgctgttctgagtagcatgatgaaatcttgcaccgttccacccaatatgtgaatcctcctttcgtccagaggatccttgctgtaggcactcattcccagttagtcacttagtagccctctcagttgctaaatcaactgtccttgtatctcagtgctactgttaaagtaacccttatttgacttactaatgggcccaaagcacaaggtagtgatgctggcaatttggagatgccaaagagaaactagacagtgcttcctttaagtgaaaaagtgaaagttcttaatatggaaagaaaaatcatatgctgaggttgctaagatctatgctaagaatctgtttgtcaaattataaagaaggaaaaagaaatttgtgctagttttgctgtcacatctcttcaaactgcaaaagttatggcctcagtgtgtgataagtgcttacttaagatacaaaaggcattaaatttgtgtgtggacgacatgtacagaaatgagttccaattgacagcaattgggtttggtactgtccgtggctttaggcatccactgggagtctcagaacacatccccttggttaagggggcactactgtattcccattttacagatgaagacatcgacagaagctaagtaactttcctaaatgatactattagaagcagaagtgccaagtttactcctaggccaactgtctctaggccccaattatataagccaataactaaaaattgtttgcacagctattaaaacaacaaactatgaatgcagctgtcacactaacctgtccaatccaggtagtctgagtttaaatgccaagaatgcctctgactcaagatccttctgaatcagtgactaaagtcagatgactctcctgtgtacatatgctgtttcaatactcatctaatattttatgttgcctgtgagtgaaggttaccttggagagaaggggaagcaactaaacaaagcatccaatgttcatagtatttcaaacaatacctatcaactttcataaatggtcttattcaatggagatagcaagtttgacattgatattgttaagaactaaagtatatgatcagagcagacaatgtatttacaggatttatttcctgatagaaggagtagaatttttccaaaagaatcagagctgtacaaaggaaaggtgcttccatccaattatttcctacttgtcatctctgataggaacccacctgggggtgatctgcagagtctacctgtgttaaatttcttcacatagagctagctcatcatgcaagtggtactaagaaatgaaaattatatggcttagaaaatggtttagcagaatgccaacaagcagaactatctcatgtgcagatattatgcaaccccaggatttgaaaatagttacctttacccactagtcccatgctgtgtgtagaataaaccaggttgagaatgatcaaaagttaacagattatagcaacaatatagttatagcaacaattgtataaaacaaaactgtgtctaaattgaaagtacctctggctacttttaaatcttcaagaacaggaatttgccaaatcattaaaatcaaattagcataattaaggatctaaaattgttagagtattaatgtgattacatttatttaaacccagttaatgaaaaattactgttacacccttttaagaaaaaaattacattaaattatatcattgggtaccatttagattagccagttaatctcaatataaccaaaatctgtatcagtaataggagtgttagtaatttatatataattagaatgaaagctttttggccataaacaatctggggaagtccttataaaataataagtgggaaaacaaattgtcctactctataaaagacattatgcaaaatataatacaaaaaaactaaaataatataatacttttttttacaagaagtaaataatactttttttttacaagaagtaaaaatagtattattagggtaacagtactgtaggaggttttatactttccttaaatttttaatttaaaaagttttaatctacaatgaactcaaacaaatttacaagaaaaaaacaaacaaccccattgaaaagtgggtgaaggatatgaatagacacttctcaaaagaagacatttatgcagccaaaaacacatgaaaaaatgctcatcatcactggccatcagagaaatgcaaatcaaaaccacaatgagacaccatctcacaccagttagaatggtgatcattaaaaagtcaggaaacaacaggtgctggagagcatgtggagaaataggaacacttttacactgttggtgggactgtaaactagttcaaccattgtggaagtcagtgtggcaattcctcagggatctagaactagaaataccatttgacccagccatcccattactgggtatatacccaaaggattataaatcatgctgctataaagacacatgcacacatatgtttattgtggcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaacccaacaccgcatgttctcactcataggtgggaattgaacaatgagaacacacagacacaagaaggggaacatcacacactggggcctgttgtggggtgaggggaggggggagggatagcattaggagatatacctaatgctaaatgacgagttaatgggtgcagcacaccaacattgcacatgtatacatatgtagcaaacctgcacgttgtgcacatgtaccctaaaacttaaagtataataaaataaaatttaaaaaaagaaagttaaaaaagttttaatttttaacatgttaaagactgaataaatagctctgttaaaataaagaaaaagaagaaaataaaatggtattattttctatccagtttaacattttggtatatacttttccagtttttctctttattattcatatttttaatttaaaatctgtaactcttaaactataatgttaataacaattctgttcctttgtcacttaacaatgcactgtggactttttttacattttaaaatgttcttctatgacagtggttctcaaagtatggtccacagaaccctagatgtccctgatagatccttttttatggtctgggaggctaagtctattttcataatactaaaatgttttttgccttttttactgtgttgacatttgcaccgatggggcaaaagcaatggttggtaaaactgctataagattcaaaagaaacaaggcagattttgattgttgatgtagtatcaaagaacaatatccaaagttatctgaagaaattattaaaacactcctctatttacaactacttatatttctgaggctggattttctccattttcctcactgaagcatcgtaacaggttgaatagtaatgcagctacgaggatccaaatgtcttccatcaagccagagtaagacactaaaaagatctgcaaaaatgtgaaaggatactaaccttcttgttatatgttttgttttcaaaaatatatttttaaagagtatcttatgttaaacaatgtgttttatttttaaatgtgtaaatatatatacaaatatattaaatatatatattaaaattttctattttcatttctaatacagtattgatggatataaccacatgaacaaaagctttttgaagccccaaataatttttacgagtattaagaagtactgagaaaaagtctgagacgtgcagtttataacagcacttttacagaaagcacagtgatctttttcatggacatgccttaatttatttagccctggaatatacatacatttcttgaaaacgaggactactacgtaaatcctaaagggcctggtgagaaatgtgcacccggtgagtaatgacctgattttggagccacagttcatggtcatcatatcttcccccaggaggagggctgattgaagaagaggatctaggactagataaagccccctcagctatgggtgcctacattcattctcctgctgagtttttttctcccttctcaatattttgtgtcatttttctaggatttccacagaaaaacactgaaagaagttggaatacaatttatttcaataaatcgagtattttcctttagctctcatgaagtctctgatatattttttccatttctgattggcattctatcaggtagagtcctgggtacatgagttttgtcacccaactaccttcctgtcctcactacctctgagtccatcactggtgatgcacacggcccttaatgacatggcccagtttatacgttttctaactctagacttcttaaatcagattacttacactaattaatttttaaaattagtttagaaattaaaaaacatctgcccagagtttgaaagcatacaaattctataaaatgccattctctcatgccttatattacttaacaaattaaatatatacagagttagcctcattaaactcgaatggtctctgggagacctacctaagtaactctgaagcagactatattccctaaaatgtattctgaagtactgaggaattttcattgttatggaggcgtttgagcacccattttttagtaggccaggatatccttgccagaatgctaaagagagtagaactaaatgacagtacagccatgtaaggttctcaaactgtgaacattgatgctgtttattccgtaatttagtgtaaaatgagtgtgggaatctttattagtgattttcaagtgcaaaagttgaatttgtcctccaaaaatttgcactggcttttactgttgtaaaccaagccacagcctccttaatccaacataccctttccgttgtatgagtccaaccacaaacacactttagatcctcaagaaataatttctcaagaaaacatagtggagtaagtagcaacccacttgggtccttaaccaggctcctctgggcctaggataactgcacctgggctacaggcttgtgttctgaagaacaggctcagtgttgctggcaactgctgagttaaaatttccaaccaccacactcctcgtccacagccctgatgtctacccctttcctctcccagaatagttcagtgatttccacaccaggtacagagtctgatcagtttccagggataatattttaccttctctcactcctatgaaaaaaggaaaaaaaacaactgttcgctaccccatcccttaactcctagagggtaaagacaataatgctatcacagactgaagacggtaggtgtacctaggctaggtcttctagggattgtggaaaatgatgcttttagtctctttgcaaattacaatattccaagatgaccacagtaggaatgggtgctcctaaagcgcagatgcctaaggtggtctcttcagtccagtatttgtcaactggcaacaattttgctctccaggagacatgtggcaatttctggagacatttttggctatcacaatggggctggggggtgttgccactagcaactagtaagcagaagttaggggtgctgctaaatacccacaatgctcaggacagaccccaaaacaaggtattatttagcccaaaatgacaacaggttaagaaatcctgtcccagtctgatgtcaaatgcatgcttctggatccatggatttaaatgaaaatattgcttacattacttgatagttcattcaattatttgcattcatgtacagttttcattatcagagatctgagcctggctctaacatctactagttgtgtgacctttagcaaggagcttaaacactccacacctgatctatgaatagggaaaataactcctccacacaattgtcatagagattacactacagagtacatataaagtgcttagtgagtagaggttagctgctgctgctatcattatcatcatcattatcatgaaagacttaataactactaggtgcctgacactatgtttagaaatacaaacacattttcttatattctgaaaatacaagaaagaataaagacttagaacctatcactaaagaactcacagaaacacctagctgagcaaaaacatatgagaagacctatctgactatgtagcaagatccatcttttcatttgcctctagcatcccaggaagcaatgcttggccctcttgggtcttcttataccctgccttccagtacctctccccccatcgttaactcaatacactgtagtacttcaggcactttgtagcaaagagttactctcacaaaaagagaaaatagcaagctagtgaatgacttctcgtggacctcagaaaggacctcagaaatcttcaccaagttcacgattcaggtgttaaaagtttcagcccatgagcagcacacggtcagcacatatcatcaggctacttgctccccatggtatttttgggatttgtcaggtagaaactcttaatttagaagaactaagcatctttcaaggaaaaaaaaatccctgctaaaatattattcataatttattttccttattgtatcaagtgacttttacttatccttcttatatcacctgatacagttccactccttgttctgtgcaggaaagttttaatttgcacatacacattataatttgtaactgtaagaatgactgcagcgtcacattcactagaataatggcctgtagcataaataaataggggtcataagggaagtatatgccttaggagaatatcctttaagctgtgcagttcagaaatgaggttctgtcttgcaccgttctacacattcagcggcaggaaaaattacttggaaggtaaaagccctattaaatgccatctttttttgttgatttggattaaacccaaatgattatttttaagttaatgtaaaaacactgtggaaaaatgaatcatgttttaattgctataatgctgcatcatttacttaaactagaaatgattggtgaatctggtttggtggtatgtcccaaacaagccaattagtacagagattaacctctataatcactctctagccgattgctttccataattttttcataaaatttgtttgcattcatgtttttgaatgaagcaggtaactagccttgcattttagaattttagtcctgtttcatagaaaagtttacaatatttgctttggagaaatttattgctgatttacttgcatgtaatacaaaaatcccatactttgctgagaggcttcaaaccataaaaggacacaagataattactttttggactatttaggaagcagggagtttcacttaaaaaaaaaaactccatggtttctcaactctataaatgcttctttaagaaaaatatacattccaaaccagaatgataaaggaggcacagaagtgtctgcatgacagccttcttccttcaaaatacatcaccaccttccataacatctgctctatcattttggtcactcacaaccttatatgctcagaaagaaatatttgtaagatctaatgtaaaaagtgcccagctgttcacccttatgctggggcagtcctagtggtatatttgtcctgtatctaaatggatgctctatttgtatctgtctctatcaaatgtatcagatacatatggaggatataaggtggattatctttagaccaatttacataaaaaaccaaggagcttcctcagatggaatggaagaaaatggagtgccaaggaaacaatctgcttctaggacaagacacaatgatgtcagaaaaatgaagtaatggtgaaaaaaccacacataggtaaagtctttgaatactgagagactggttcagtgggcactcatgaatcctgggcagagaaactgcaataaatgcagagctaataattcagaatggtttatctgaaatctcagtggggcactagaaaggcatgacgttggcactcatccactgatgggagataatactcattactgagctacacataactgccactagatatggggctctgtcaccatggacgggttatcagttgaagtcacaactcccagctaccaatgacaagtgaaggcacagcaactggaaaccttcccagggtagaaggggaataacttgctggtgattagtggtaaataagaggcctcattcacagaatgtatgtgagacactcactggagtctccagagctatttgggaggaatctgagtgagcaagctgaagccaaagaaatgctgttttgtaactgttactgtgatttgtttttatccccaggatgaagtggcttgggaaatacaggaaacttgcagaagtaatgatgactgcgataatagctactttattttctatgtagttctctgcattgtttctgtgaagtaagacaactatatcaaaatatttcactgaaaattaataagctctcaagtgaaattataaaagatcttgtgatgtgagacacactatccaaaagtactgaaccaggtggaggaaactgctgaaaatcaatgtctcctctattttctcacgatataccacagacagagaacattacctagcttattactgattggaactaaggagtagaaaaagcactatctgatttccctggagtctcagggttgtatggggcaccccctgcatctgcccagccttctacccgggaggaacactcctcaaacatacctggaggcagaagacatcctacagggtacttagcctctgtcctgcaaccacacaatagtcctgcctctcagtgaactggcctttcctgggctaaggacccagcctctccagatctatgactgtcacagtgctcttagcgctagctgatctccctcagcctgtaccagggttcaacccatctgatcaggctgcctctgagcctagccctcctgccaggtgtgtgcacgctgatatagccactctctcaggtaatgcctaacttaacatcatgatatatttaatcctcccataaaatatttccttcatttctcttttatttcatcattttttaaaaaaccatagagaagatgagaaactaaatgtggaatggtatgtcacaggtctgaataaggctagaatgaccctaacgtgacacattttagattgtagacttggggtacacatatataaattattgtagactttggggtgggttaaataacattcagattaggaaaacttcctttcattgcttttatactaaaaattactgtatgaattaatgttgaattttaataaatactttatcatcatataatgaggtaatcatgtgctttttcttctttataaaattagtatgaaaaattacattgagtcaatcttgtgcccctggtttaattccaatttgctcatgtattaactatttaatatattacttgctaatgttttcatcaggattttgtacttatttgacataaagttgttaatatcctcttattatatttctaatgtctgcaaggaactataatgatgtcctcctcttttttcattcttaccacctggctatagttttagtctcttctttttccttgtttgaggttgaaaatgttaatagacttctcaagaaaacatttgcctttcctccccgcccctgcccttttggagacggggtctcactctcattcacactggagtgcagtggtgtgatcacagctcactgcagcctcaaactcctgggctcaagcaatcctctcacatcagactctcaagcagctgggactataggtgtatgtcatcatgcccagctaattttttcatttttcaaggatggtggtctcgctatgatgcccagggtggtcttgaactcctggcctcaagtgatcttcctgcctcggcctccatagtcactgggattacaggcatgaaccacaacacctggctcttggctttgatgatgatttctgctgtacatttatttcttgtttttgtttctaaattttcattattttctgctctcctcgttactttccttcttcctactttgctttagtttattttccctttttctaagtttttgagatgaatgttgtttaatttttagtcttcctttgaacatatgcacttaaggctatacattttcctcaaagatggcattagttgcattttatatattttgatatgtcgacatttcaatatcattcaggtcaaaatattttctaatttccactgtgatttctcctttaacccagtatttatacagaactatgtttcctaatttttaaacatagaaatattcaagattttgctgttgttttcaggattattgttactgtcttgtagcttaaataaattatgatcaacttttaattatttataagttttcaatcctttgaaataattttagatttgctttttggctcacaagtttttttatatgttctatgtatactagaaaaaaatgattttctgcacttgtgtattcaatatctttatgtgcccataaagtttgtcatattatttaaactttctaaatgcttactaatgttttgtgtgtactctcaattcctgaaagagatatattgcaatgtcttactctctgaattttcctgtttctcctcttagttctgtcaatctttgatctaaatagtttatattattaactaaaactttgagattattttaacttccaggtgtattaaagctttcacacttgtaaaatatcctctttgtatctagtaatttttttttatttaaggtcttattagtgttagtgtagctaccatcaccctttgctaggtggagagcattagtatttacaacttatccattcttgtatattttgactttcaacctttttacacactcatattttagatatatctcttgaatgtagcattaagttggaccttatccagtcttacagtcttgtcctttaattgaaacattacatctattgacaatgaatacaattacaaacatattcgagtttaagtctaccatcttagcatctactcagctattctgaaccaagtatcagatctggttcagaaaaacataatttgtttttttccctaacactattcagcatcaacttcaaacatgtattatgaggattaaacacatttatatgagatttgtacaagtgctttgaaaatcacaatgtcctaaagccaacttcgtgttactaaatatgcttctattaaagattttccaaagatctctgatgcaggctctcgaatgcagtttcagacaagttgaaaaaaagaaaaaaaactaaaaacaagtattggcagcatgataagactcccaagatgacccttttaaaagaaagagggctcatgacctttggcatagaaaagtatgttggaaggctctcaggaggcaagggcttggtgagtttaaggaatggtaaagatgccagtgtggtgagaagtggtgagactggtgagatggctatgagctaggtcctgcagagctttgtggggttgttgactttgttagaaatgcacttcccagtatgtagtgcaatatcatggtcaggtttacattttcaattgtttattcagtcagctgtggccaaaactaattagaggaggcaagaatgtaggggagtggacaaggtaaccattcagtcttctaaaggaccccccctcaaaaaaggtggtgcctttaacttgagaaacagaagcagatagctttgagatgcctctgagggtggaatcaacagcacataagaatctcatgtggggaataagagacagggtgatgtcaaggatgatgttggtaattctaaatcaatcaacaggctgatgagaggtgtttgcagtaaatttatatctacagtaaataaagtctaatacttatagaccatttatcaaatctactgcatatcactgttgtcttatttctgttctttaatatttacaaatatcacaagcttatgaaaacctctcatagttccacactctccaaccttacacttcttccctctgtttttttttttttttttttttttttgctaaaaatgatttcagggaccagatgctgtggctcacacctgtaatcctagcattttgggaggccagggcagggggattggttgaggtcaggagtttgaggccagcctgggcaagacagtgagacctcatctctacaaaaacaatttaaaaactagccaggcatggtgacatgcacctgtagtcccagctactcagaagactaaggtgggaagatcacttagggccagcaattcgaggctgcagtgagctatgactgcaccactgtactccagcctgggcaaaagtgcgagagctgtttctaaaaaataagaaacaaaaacgatttccaataaaactgaacagtgcaccacatactatattattcttttcacaaaaggcacaatgaacctcagaggttcagaccaggttgacactgtctctaaaaaaattaaaacatgaaagtttcatcgtattgcattttcacaagaaaataaattgaaataggcagtccttgcaaaacacaatttgtttcttccctaacacaatactcgagtaccgctgctttcaaaagaagcatttctattatacaaccatcatgtttgtaattgaaataataatgtcaaatcattattgggcctgcattccatttaggttttcaagttctgagctctctccaaaataaaaagataaagtttctaatggaatcataagactgttgagtaactgaacatttttcttctttttctagttataaaagttatgtcaaaagaatccctccgaaaaaaagagaacggtttctgaacactagaaaagcttcactcactgtcgggggttccagaaaatcccctcagcaatcaatctgcagaacgtcaataacaaatgatacacttccctcaactgcaaaaacaaacagtagagatgccagaggtccctggaatttaaagcataagtgtcttcttcttttttttctttttttccgagatgaaatcttgctctgtcgttctggctggagtgcagtggcgtgatctcggctcactgcaacctctgtctctcaggttcaagctattctcaggcctcagcctcccaagaagctggggctacaggcacgtgccaccacagccccggctaattttttgtagagacagggtttcaccgtgttagccaggatgttctccatctcctgaccttgtgatccacccacctcagactcccaaagtgctgggattataggcttaagccactgtgcccggcctttttttttttttttttttctaatgagacagtctcactctgtcgcccaggctggagtgcagtgccacgatcttggctcactgcaacctctgcctcccaggctcaagcaattctcaggcctcagcctccggagtagctgggattacaggcacctgccaccacacctgcctaattttttgtattttagtagagatggggtttcaccgtgttgcccagggtagtctcaaactattgagctcaggcaatctgcctgcctcagcctcccaaagtgatgggattacaggcgtgagccacggtgccagccataagtgtcatcattcattcagactgctgtaatacaatactgtacactgggtggcttataaacaacagaaatcaatttctcacagttccagaggctgggaagtccaagattcaattcctagtgagggctcgcttcctggttcatagacggctgtctccttgctgagttctcacatggtggaagggagctctctagggcctcttttataaaggtacttgtctccttgatgagggctccggctacgtgacccaatcacctcccaaaggccctaccacctaataccatcatcttaggggtgaagatatcaacttatgaatttgcaggggacaaactttcagtctgtaagaacgagtatgcatgagggctgagaggaggggagtatgtatgttacacatggggacatggaatggggaagggtgtgaaggaaggtgaaggttgttctttcttctactgtttgttatagtgatgcttctcctggggttgagtggtaaaaagaggaaggaataaagagaggaggggaaaaattgggggatcagatagagccctgttttccaaacatcatgttttgagctattagtgaatggatcagaaacataaattgttttggtaagctagaacagaagctatcggaatatactgtatgtaatagaggtaacatttcatgaaatattttgtttcacatatagatgagtgttattgtgtgggtatatgtaaatttttgtgtgttgatttatcatataaaatgcttttcatattacggtttgtagtaaaaaatgagtcactgaactagagtatttaaggttccctgcccctgcttcccacagtacaggactgttatgttaaagacctgatgttcattttttacttgtgttttatgcctttagaacaaaatagtaagttttttctttatttctgttacccataatgatgcaaagaaaaaaaaacccttgcttctgacttttcagaaatcctgtcttattgttctcatttcatgccatgcattgatttcctgttaaatagttttcaaatctcaagccatactagatcactgagcttttaaagattatgaaaatcatctttctcttttatctcttttgtagatggtttttaaaactggcatgtgatgtggctttatttaaaaatacattcccatctacattattgtcttttttctttttcttttttttttttttttttttggatatgtagtctcactctgtctcccaggctggagtgcagcagcacgatcttggctcatggcaacctccgcctccagggttcaagcaattctcctgcctcagcctcctaagtagctgggattacaggcatgagtcaccacacctggctaatgttggccaggctagtctcaaactgacctcaagtgatctgcctgcattggcctcccaaagtgttgggattacaggcatgagccatcgcgcccagcctaagctactgtctaccagaaaaaaaagtacacagtgaatcagaatcactttcttgctgtataaacttggaaagttattcattctctctgagtgccagtttcttgggctgtaaattaaagctaatattatctccttatctagattgttgtaaggagtggagatgattcatgttaagtgcctgaccaaagttaggcactcactaaatgatattttgaattataataaaatgagaacccaagcacacaactatttcttagtaacctcatatataagcaggcctcttgttgtctactgccttgaagagcccatttaatctcctctcaccccaccaagggccaaaacatggcccgacacacagttgatgcttgataaaagttgacagaattgaattaaggggcggtgctgttgtgttttcctgatagagtacacttattgccaaaataattatagaaatcaagttttatgcccaaattagctcattaattttaggctgggagcataatcacaagagaaccgcctatctcccaaatgatccaactacaaagagaacaaaagtcaagcttcatccagtaagcgtcaccttacctggcagaggtttagcgcatctctctgctctgggaagaagccaataattgaaagcatctgctggtcaagacaagcagaacatttaggctgaagagggagtgatatttttgcttatctttaaaaggaaagaacgagttgataagagagaacagtggttttgctctgaaaccagcctgacaaactatattgaacacagaggtccgtacttattttctttcaaaaacttcctttcttctgctcccatttatacataaacaacacatatccctaaactccatccattgttttatcctcgaaattcttagccccaattggcctcactggcagcacatgctctcctgaccacacagctgcgtccaagggaggtaggggcacaaccttcaatggtatctctgctatctcaaaggaatttcagatatcattaaaacaatgtgtctgcgcctctaaataaaacaggccagtcatgtttcagtaaactgacagtcttctctaaaggaccccgaggtgtacgaagttactgagttttcccatcctaccatcttcaaagtgataaagaaaatgcaattgttatgcaactagcctttccagctgaccctagggtggcatttgctgtctactcttaaactacctcacaaaaatcatctttttgtaaagattctttgtttcctctctcatacatgcataagagaccccggggtggaggcagtgttaggatggggagggatggaccgggctcctgggaatggcctccatcagaggcctggtctgtgggccccagtcaccgtgaggggtcggtggggagtgtggagcttcccaggatcctgcctctctccctgttttctgccaagcagcaggaacacacaattcattaaagcaaagccaaaggtcatggactgagaaatagcaagaaacttccagggacttgttgattttggaaacttaatgtccacattgtgtaacagtgtgcatgttccccagggggaagtagattgctatttatgtcagaaagatgtttcagaagaagatgtctcctccaagcaaatagtatatgtctagttgttggcatctactatcctctctcctcttttattcaataaagtgatccaccttatctgagctacacagacctctgataggtgcaggggaggatgttggagggggtgccatttcgataggttggcattttctctgtaatggcaggaggcaatagaactatttgtttatgtttcaaacataaaataatgaatcagcactcgaacaagtcttgaaagataaaacgttcagtgttaattgaatctctatattgtgccagataatatttaagtgctaggaatacggtgctgaataaggtccctgccctcatagacaggtgttctagtaggaagagacaaaacagacaagctaaaacaaattttcaaagagtgataagtgctatgaagatggttaaacatggatagagactgaatggctgtggagggggcagatttcagcagatttagggaaggcctctcagatgagttggcattaaaccaaaaagtaaaggaagagaaagagctgccaagccctatcaagagcatcccaggcagcaggagcaaatgccatgcagtgatgtggaggacagtttggctgtgtgcctggagcctggtcaactacaggcacgtgcatgagaagaggtcacagggcagagcagtagggccagaccccacaggagcctggggatggtgggaggagttcctatgtcactctaactgtaaagggaaacactgagactgcaatcaaataaatctcctttgccgcctcactgtcggagccctgcttaccacatctgaaggatccatatcttccagagctctgcagattttgacagcagagatatgctcctcacacccccagcttctgctttttcattatttgtgactatcaaaacagaattttgatgacaaattatttataaataaaccaatcattaaaatatgtaagatctctcacctatcaccatacatctcacttaaccattctcatgcatcccaatgacttgaacaaaaagaaacagaaccagaaaatagtcaaaacagtacaatttaatctaaattatccttctcacaacatcactgagattgacttgccaagtcctgttcattgtcagattggattctctggaagtgagtgccttctgcaaagtatctcagacatggataacgcaggcaggactaaactgcttttcttcccatttgagttgccaatacctccctctgggccaatcgaggattattgtttcaacaatacatgcaagctaattgtttgttaagccggcccagccaaccataaaatcacaggagagtcaggcctggcccatcctcttgcctctgaactggatcacagttaatatctctgagagttccaccccaggttcacagaccaactggggaagatggctcttgagcaaactctgaattttgtttccatgaagaaaggtttctccaacataatcaactacaatcacaatttttgaaacattcacattcttaagtctgtatctgctttggtttccttaaataaaaacaagccagagataaaagtatggaaataaaatagtttcaaacagagagccctgtggaagaatgcactaacttaatatgtacttccagataaatgacaagatacatgtataagagaagcaaacttctacaaacattcattaacaatgtgtgaagataaaagttatctttgatagaaaaaggtaactgataaagacatcaaagagaaagatctgaaagtgaactttctacatactcaccagataaaacatataaaggggcaattttggtttgttttattgttgtaggtctaaaggaatactttcattttcagtagtttgtcagcaaacagcacaggaaactttactatttgaaatgagtagtctgagttaacaatagtgaccagatattataaaaccgtgttctgcctaaatatatccacaaatcttcagatggcctacaaacccaatattgaggctaaaaaagacatgacctcttgagaggctcttctagaaagtgggactctctggtactagggatatagcactgtgaaccccaaaagggagacagctctgacccccagtgcaatcaggaaagacagatgcaagccctaacttagtttacaggtttgatgtccccactgctgtgggcattcctgtccagaaacccaagtcctccccaagagagtggctagagagtatatgcaaacacaataaacctttcacagaaaaacaatgactttctatgactagaatttggccaaaggctcttcttttgagtgttagtgatataaaattctgctctaaaataatagttttagaactaagcttaaattcctgattatttgaacacattagaaaaagaaaaggagtttctatttcagaaggcatagttatttggaaactgccacagtttctttttaagtcaaaaataacaaaatttcataaaagcaaaacaactaacatccctctccctgaccctccaaagaaacctttcttagaagtattctagttccacacaatagaaaccaaattcaatgtggctgaagtaaaaacagggatgtactggcacacttaatggaaagttcaagggataaagcattcaggtatgggtagaactaggtgcttagactatgaggacctttctccatctcttaattctgctgccctctgcattggcttcatttttaagtaggttatctttaactggaggcaaaatgactatcaggacttccagatttacgttacatcatgcagcaacctcagttttataaaacacaacgaaacttcttctgggagttcaacaaatgtctcaggattgggtctccttaatctggctgggtccacatgccatccctgtggtctgctattcctgtggtctgaatggccagccctggtggcctattcctacagatgtaccacttggattccataagctaagacgggacgacccaaggtgcggctggcaggaaaggaatacaggctgacagatatcactaatggaatgtccatgtctctccctccacttacctgtttcctcctctttcaatcaaaagcctatcaaaactgggttcagatattaccttctgcaaaagcgcttcccaaattccatggaattgtttacttgaaaatggttaatttaaaaaaaacaaccaaaaaaaaccctcttcctagagtctctccttttggtgtaaagccctttctgatcctcccacaaactctgtttccctctaacactgaatttattatactttttgaaactttctgtccatatgtttgtcttaagcataatttcccaaaagacattttatccttgccatgtaggaaagtctttggcacaaaatagtaaaaatttatggaattagactgttgttgttgacagagacagttcttctctctcagagtgtatcaatcagtccactgtaatatcagtcacattgaatttattctgaaatatcaatgaaacagtctctagcaaaactcccacctttaatgtctctatcttgtaaacagaaatctgaaaactcagcaactgagaaatgcatttttacctagtcaatagaattcaaactcagacaagaatagcaaaataacaactgctaaaagtactttaaaataactcattaggaagcacaagtccctctattcaacaaaaaaacgagtaaaataactaattcatctctaacttcatttatattttcagttcatcttctgacttcacaagaatggaagttttgtattctactatgatcaatacctcatgtaaaaatagttacggcacaaaaatgcatgacttttcagatgatgttatttttaacattgctgaaatttaccattacttaaaatatactaactgcatcagtagattctagaggatactcctctgtatcttgcaaatgtatatatgctctgagcctaatgctcttatggctcctcctcagtgtccaatgaaaatgaggtagatcctaaaagaacccagttccaacatgtctggtttcagaattatccacttcaagttgaactcctgtgatcaaggccttaaaagctgtactgaattccacattcaggtcccactggttcaggagacactagtatcaaggctctaagacagcggctgccaatctttttggcaccagggaccagttttgtggatgacaatttttccacagatggcagcagggggatggttttgggatgaaactgttctacctcagatcataaggcatcagaatctcataaggagtgtgcaacctagatccctcacaagcacacttcacaatagggctctcgcttctatgagaatctaatgccttcggtgatctgataggaggtggagctcaggtgataatgctcactcgcctgcctctcacctcctgctgtgcagccttgttcctaacaggccacaaactggtattggtttatgacctgggtgttggggacccctgctctagggtgcaggaaaaggtgaactaatattaataaagggaaggtaaactaatatgagctgtgtgaggcatggtgctgggtatcctacacacagttggagccccacaatatgctattgctcattcaacacggtgtcttcctccagtgtccatcagcagttgggtgtcatactggagggacaatgggctgtgaggacttcccaagagatggtataagtagggagagaaccacatttgctgttctttatgagaaattaggcacatgtcaagaatagttttgcctacacatctttctcatcttctacttgactgcagataaggtatatccaatccttgcttgagataagatgtgactgcactgctcagtgcctcagctatcacaaaaactctgagagggttaaattattactggcccaatttataggtgagaaaacagtgcctcaaaggggttaagtaattttcccatgataatgtgctcaaaaactacaaaaactctcctccttacaaagtttctaagacttatcttcagggtatgtggacatagcaaagaagttgtactttgtattgagttaaagaatcaatcatctctagccaatgagccttttgtgacattacgatagcaatttagatcagcagtttacgttattaaggaaaggagttcgtattacaaaacatgctgcttcttaactgtttaagagtttagaccataagtaacccatatttagagagcaaaaccctggtgtcattgtgctttttcccagtaacatctttcaaatattatcatatccaagagacaagtattttttttaagtaattttgcataactcttaaaaagatacacaatcctaaacttaacttcactgggatttttaaaataaaataaaaattacagatgctgtttcaagatatgctttctcaaatacttttccaagtatagcatacctaacacagaacatagtttacatttgtccatggtgaggcttcaaaatggagcaattagatcaagttcaggggataatttattttctaaaaattatgtggcctttctttttaattctatttatgtgatgtatcacatctattgacttgtatatgttaaatgatccctgcatccctgggatgaaaccaatttgatcacgatgtattatctttttgaggtgctgttgactcaaaagttgttggaagaaaaaataataataaagagagaaaaaaatgaaaattatgcagaatatttctgcttcaggaaactactgacccattttttatcttttaagataaaaacatttttatacaccaaaaacttttatcttaaaaggtacattataatttagtcaaatctgatagtcatgggcttcataagctgcaacaactgattattacatttgataatacgatgactgaaaagcaaaagaacatttggtatcttaatatcaatttaaatttcacccgatcatgatggcaaaattgcccacaaagctgttctagctgttccttacacctttcctcttctacagcacactcagccagtgcaggagaggatgggcccagcacaattgtgtccacacaccacctcagacaagatgaggttattttgacttaaagggtatgtggtaagcttaatgaaatgatttaaataatctttacgcaggccttaatttttttccatttgcttctttagtttagaaaacactggttttatgaggagctgggtttcgttctcagcttctctgtattttaatgtcctgctggcctgacctggtctctacctgataccctgatgtctgagtcatctccaacctctccaggaagaagcagggacctttcgccctgtcactctgagaggtttctgatctcttaccaaccctctttgagagccctgacttaagaaaaaaaatgcttgaaaataaaacaccgaagtattcattgacagtttcaacttcattgtgggagacattctctgatgtcatgaaaggagcatgccagggaggccacccatcaattgatttttgaaattcctagaagccatagaaaagggctcacctctgctctaggagataaacagtacttcataagatatttattaacctagaggctcttaactaaaaaaaaaaaaaaaaagaaaacaatgcagccttttagtatattcctagaaccctcctcattcccctttcattccttagcttattccctcccttcttctttctcatttacacagaatcttagggtcagaagaaaccttgctggttaaataatttagctcttctggctatacattctcctccctttttatttctctgcatctccatgtcccagcttgcttctcctctcctctctgcaactgttcttccccctctcatttgttctgaaattgctgctgcctacatggtaggcactcctgggtatacacagtaggaccaaaataagcctgacatgaatggttttgcctgggtcattaactgaggtccaggactgactacccaaaaagaactacctaaccttgtagtcctctgcctgtcttaatacatgaaggtaagactaggcaatcagttatttgttgagctaatgaatgaacaaatgattgcttatccaagcaaatagcatatcattttctgttaaagtgaaaatacagccctaggagaattagggaggagcttcactggtcacagatatcttattaccaattaatttaaggatattgctccttcctaatagaagtagtcatgataaaaaatgggagtttgtaataatattgaagaggaagaggaggtaattttggaacctgggatattctgtatggggaaatatggggagtggagatgggggttgggaaatctgagcagtcagaggcaacctagagacaccaccggtacctaaagacaggtgttaggaggcaccagaagttgggaatggcacacaaaaacgaaatacagcagcaaaattcaacatgaatactattatttaatgtaggtttaggtagctattgtcataacaccaattcatatgtgctgaattgggaaatcttgcattgagcagtcaataaataataactaaagttaatagtgaatgtaggaccatcaccattttgctactttacttctcaaaacaaaacaaacgagaaaaaaaatgctatcccataagacagactgggcttgacacttggttgctctgacaacgaaggcccaaagaaaaagttcctgttttactggtgtcaaagtactcaccgcttctttaaaactggctcacttaaatatatctgccttatccctttttgatgtcatttgtacgattcacttttgctttggtttctggttttgcaaattgttagttcctgcagataatgacaagtagagggattaaaggaagtgcaggataatgaacaaacaaaaagcatgatataaatcaggcacacagtgatgtttacttaaggctgatatgttggagaactgactgttgttgttctccattctagtcctagagtattgtgagaataaagtatctttctttctttctttctctttaaagagggagtttcacttttgttgcccaggctggagtgcagctgcgcgatctccgcttactgcagcctctgcctcccaggttcaagcgattctcctgcttcagcctcccgagcagctggggttacaggtgtgttgtcaccacgcccagctaatttttgtatttttagtagagacgggattttgccatgttagtcaggctggtctcgaacacctgagttcaagtgatccacacaccttggtctcccaaagtgctgggattacaggcatgagccactgcgcctggctgagaaatcacaaagtatctttctaagtgcactaatgctacttggggaaaacataaataattacaggtggatcctagataaggagacattccttgttacttccaaaaaaattccataatctttggagattccaaagagattttccatccctcccgaatcatatggaatgcgaaaggcaggtatacatgagaatccatgtacacattgaatcagaaggaaagactatggcaaaaatagggagccacattaggcacttaacagcagtctgggctaaaatcctatttctgcctacagttaccttgaaaggaatcctttgctgccctttatgtaaatgcaagtgatttaaaaacatagttagatctgtatagtgctatacaatttacaaagtacttgggcattcattatctcctttgatttttgtaattgttttgtatctccagttccaaaatgagaaaagtggtacccagaagacttgtgtagccagtacaaaaacatgcagtaactggtttcaaagctaggactccaatcaggttttgtttttatttttgagacagggtctcactctgtcacccaggctagagtgcagtggcaccatcttggttcactgcagccttgacctcctgggcacaagcgatcctcccacctctgccttctgagtagctgggaccacaggtgcacaccaccacactcagctaatttttgtattgtttgtagagacggagtttcaccatgttgctcaggagtctggtctcaaactcctgggctcaagcaatccatctgcttcagcctctcaaagtgctgggattaaaagtgtgagccacggtgcctggccctaaccaggttttttgacccctagcccaatattctcttaaactcttaagcaatgttttcttattttcaaaactgaactaattatatcttggatgagaatactttaaagacattctaaaaatacaaagtagctttaaaaataacaaagtgattcttgcattcttatcctgtctatctaagagctcaagtgtcaaatgatatcttcctttctattggtatcccaaaatagtaaattataaaaaaaattgggaacaacttgcaaacccgctaatatcccaaagctttcatgagtaaaaagatgttaggattaaggagaagctacagaggaaaagtgctatcagaaaacatcaccttagctgtgtcttaacaatcacacaaagacaactagcatcagccgtatatgtgtcctcaaccatctgtgttctcaacccttgcttttttgccttgtagcaaactttgctaatttcacagtactgtacgatacttcttggtattatgtgaagtactctatttagacatgttgacttcactaattagtctataaatacttgacttttagccactgctttggtaagtgagataattgctgaggaaaggccaaagcatttacggtcaatcagatgaggaaaaggggaatatggtctttgagctgagtaaaatgtaaaacattatgtggcaaggcagaagctattagcaggatcaatatctctcctagtaccttaataaatcatcacatcaaagccccgacagaggatggagaaaacctcagtctacctacatggaagcttccaaattggaaaataaaattccatttaaattacaaagacccaattcatgtacaatggaaatggcaagctacaaaactagtctccaaatcctggatgtgctaagagtttagaatcattagtgaagggagaaaagcagaaagacaaagaacactgctactctctgggttgcacattcataattcgcaagttgtaaatatgtatgaatctgcccactgcagctagggatgacatactgctttttagagatagcacagagcagagaaatcaaagtagaggaaggtttggccattataacttacctcctcccacatttaacagttctcaatcttctcaaatctccccttacttaaattgctgtcttttggggatggcttcctaaaatgaaaagaacttcgataccaatgaatgttcaatgtatagcaaaaagcatcccatggtgagctctcactgtaacatgggacgtaaataattgtattttttctaaatctttaatcgctcccattctctttgatgcttccaggaaaacaagcaagcaactaaaagaagttactaggctaacttgcccagtttttttttttttaactctagaactaattatttctcttttctaatatgtagtaaaagacaaaagaaacattttgcagagattcatattatagaacattaggctttcccttaaggatacgtatttcctcacttacagagatgatagtgaatactgacactattttgactccaccacagcttttgctttgcagtcatactgtttaattaaaaataggtttttttcttataagctcaaattactctactgtagatctctcaaacttcgtagtaagttgaagctgagaactaagaggtcacatcaggaaatttatttagataggtcataactggcaaatcagcaacaaaagaaagcagggcttctcaacatcttgaaacattcattcatgattaattatttctttcattccacaattatctattagacacttgagtatcatgcttgggcttgatgataattatatcaaagaaagttcccagaaggttctattctcaaaaaaaaaaaaaaagtctgaccatctaagtgggtacataagtcacccaatacttaaaatgttagctaacattagaagatgtaaattatataaaagctgattgtcacaagtgccatatatggctacgtgccaaagaagggctacagtaaacttttataaagaaacctctattggcagggattaccagggaagggactaggggagagggtaaaagacctgagctacatagaatttgaataagtgaaaaagaaaaggacacatgcttcaatcagtaggaaaagcctgggcaagccagtgcaggcacacagtgcagtgcgaagcaggagagagttcacagtgcagatcagtggtaggtcaggacattagagtcccaccccaacacgcaggaaagacagtggctggactgcatatcttaaggtaggaaagtttttacttcagatgggagaaaaatagagagtcaggagaattctgataccatgtccaagtccaagaccatttggggagtcaaaactgtacagaaagaaatatcttctctagaagcagcagatttcatgtatggccagaaggtggtaggggtttccataaagcggtctgaggctatcaggaagcctgtttcttatagaaaaggggtttcagaagacccagggacaagacacaatttcaggaaaggggcactgggaggatggttcttttagcagaaacctcctcacaggaacagggatgagtgcctaagggaggagctcctgcctgggagaggcaagaaaggcagaaatgagaagcagggtggctctgacttatcttcctggtctaaatggaacctagtgtcttgctggttcaggagcctcattctggcctagaaatagcaccccacttccacctcaccagccaggttccaaccgtataagtagttgagctgaaaacaggagattcattttgtgtggtgcatacccatagttccagctactcaggaggctgaggcaggaggatcatttgagcccaggcattcgaggttgcagtgagctatgatcatgccactgcccttcagactgggtgacacagtgagatcttgtctctaacagaagttttaaatttttaaaaaattcattttgtggttgtaagtacaaaaaaaacctcaataatgatgagaaaaaagatatacgaagatttgttggttaggagatcatagctgatagggtgtgtactacttactacaactgctattctcccacactcacactatctcctgtcttaagaagtttaagcaaatctaggcccagtgtcccactgagggaaatcacaagaggacttagaggggtcccatccatgagagctgcaccatgagtacatgctacttggaaggctgcttctgtggtcattctgagagctgggaaaccaacctggtgctgagctgtccagaaggcagcatctgctgattctggtaccactgggaagaacaggacacatctttactagggaaccagctgctagtcaacagctgccccttctgctccccaataagcacctttctgattactgtcagtttttcagcagaaaggccatcagctgttgtgttaatgatggggcttcactggttggaagaattttgcagtctccagtctgaactattcctctgggtgtccttattcaagcagcagttaatttgaaaacaattagctggttgttcacttccttaaggcaaagcaatactggatgggctaccaggttggactaagattccagcagaacactctgaaggagccaggatatttctaggatgggtctgctttgtgttggcttcaggaaaagtctagcatttctaaccctgatcattgggaattagtcactatttcccttagttgctctggcaggctttcatttatttttgcctgggtgacaaggagacacttctacatttcaacattaaacagactggacgattcatttgttttcttctttttttcactcttccaggtaaagggaaaatggatccttatggtgaattatagatgagaaatcaatgaaagatacagagactaaagagaagtagagttttataaaaagcaactggatttgttttataaagtagcagatttccttttacaggctggccaacataatctttgggactgaaatatctttctgataagagtatgtattttctgtcactgaatcctctacttatatcccctgccacacttcatcctgttaatgaggacaaaacaatatgaggaaagtttttctgttttcctcagtctcccaattcctcacctctcttctctgcaaaccactcggcttccataacaaaaaggatgacacaaacagagtaaaaatatgttaccagagactttctcagttcatggcaatattcagtcagctaaatctggcaaactcatacacatctggcctgctggcaagtctgactagaattcagctgtgcctgtacaaggaagcaggggaacagcatttagagttagacagccctatggcctgctgaatcctcaaatatgcaaggggcttattcacaaaatgcttcacaaaaaatggctcctccaaacacatgcatacttatttgatgtttttatacttttttcttttcagtgctaagccatcttctttagttagaactatttttatcctttgtcactttataaactgcaatggaattcagtattccatgtacaaccttaattttctgtatgacatggaaaacaatatgggaatcagagggacttaaaactaagtctatggagcccaattcccaaattgcagatttaggtcttactgtctctcaggcagattagatgacttctgaaaagaaatacttatttaaatatgcttattttattgttattgaggtatgcataaattatcccgttatagctatccaaaactgtgaacaacagaacaagaccccaaactgcagagaatatatcaactcagttgcaaaagataagacagtaggaaaggtgccatacagaacaatattgggagttagcatcatgaagaaggttagcaagatgtgtttataatacaactttcattccaacagaaattataacatgctaagagcatggacctcgaggaaaaaatatctattttggtgggctaagtaacttttggaaaagactaaaacacaaactcctttagtaaaatgctttaatatactctaggccttttctttaaaagtaaggtatgattaaactaaaactttcaagtagttcaatgaactaagcaagaactgttggcttccctccaaccatagtcccacttgctagagataataaccataaaagtttcatgtgcagcccacacataaacaagcatatacagctgcatatttacacacgtgtgtatttgctggtacaggcctaaaatatggaaacatttgctattttattaaaaagtgctcataccatatataatattcatgcaacattgttctgtatcattgacatagatgggtttgttctttttaatggctattttatgtactattgaacaggtatgctataatacctatattcctattggtatgcttttaggttacttctgagttttaacaattaaaaaatacgcaatatgtcttcttacaattataactttctaacttgtatagatagaactaaaacttctccaaaaattattattccaagctacactccttccaacagagtaacaatttctcaccaccactagatagcatcaactgtttaaattgtgtccaatggacaactgaaaaatactctcttattttaatttttgccatcattaatgaggccatctttgcttggctgttatatttttctttgaatagcccattcatattctctatttgttttcttccactgagttgttactttttactaattgagtcccttgtttcacagagaaattagcccatcatctgtcatgtgtactgcaaatataattcctaatttttcatttgtctattggctttggttttgttttggaatgaggagacagtcttctagaaaataagacatattaaataatatattggtaattgtaaagcacagattgtatggcgccagccatcatgtgctttgttcaggtgtcatgcttatcttaggtaacaaggtcaccaggattaattagtgaaaatcctgctgagtttcagatcatctcagtggccctctataaagtgttctcactcacctggcagcctcctttcttaatctcagttggaatctcaaccacaaagtggttgctccttgtatctagaagtcatttaaaagacagtaatcaaaatttctgttctcttttatttgttcctctgcttccctatcaataattctgggaggagtgggagagagaacagtgcgtaatcaaaaggcagacctagcaaattattattttattgataaaataattcagcaaattctcaatattcctgcttcacagtgattaccctagattttatattttagggttttgcacctacctcttatcatcaccccactaactagagtgtagtctgtgtaggacaccgattagactcacccctggtttggcaggcaaagaatgccaaggcaaaagcacagccgacaaagctccctgtacttgtgcagatagagaggcagagtataccccggagctgagctgcaaggtacaaatcctgaccctcctacttgataactgtgttactcggagtcagttaacctctcagagcctcagattcctaatacatatgatgcatataggaacagtgccatcagaataagaagagcagctacatcacaggactgctatagggtgaatggagttatgatgtaaagtagtgcctgggatacacatagcacattttaagtaaatgtggcatatcaatatagtaattacatatagcacaatagaaaagttagagtgtgatgaaatccaataggctttacaaaaatcaagtaagtattagtactacataaccacagaaaagggaggcccaaaggaacagtcaagaaatgcagcaagggccaggcacagtggctcatgcctgtaattccaacactttgagaggctgaggcgtgtgagcccaggagttcaagaccagcttgggctacatggtgaaatcccgtctctacaaaaatacaaaaattagccaggcgtgatggtgtacatctatagtaccaggtacttgggacactgaggtgaaaggatcactggctgaggctgcagtaagccataataacaccgctgcactccatcctggacaacagaatgagaccctgtcaaaaaaaaggaaggaaggaagagagagagggagggagggagggagggagggaaggatggagagagggaaatgcagcaaggagaagagatggggagcaacatggccaaatagaagcctccaccactcatcttcctcataggaacaccatatcttgagtagaaagatgaaaaaatgaaccaatgcaaaataatagttataacaacttttcaagatatagacagtacaataacatataaatagaaacaataaaaagttaaaaagttggggaatgaagtttaaagtgtagagttttttaatactcttctctttattagtttgtttatgcaattagtgtaagttgtcatcaatttaaaataatgggttataagatatttacaagccacatggtaacctcaaataaaaaaatacaatagatacataaaaattaaaaagcaagaaatcaaaatataccaccagaaaaaaatcgccttcattaaaaggaagacaggaaagaaggaagagaagaccacagaacaaccagaaaacaaataacaaaatggcagcagtaagtccttacttaccaataataacactgaatgtaaatgaactaacctctacaaccaaaaggcacagagtggctgaacagataaaacaaaactaaactaaacaaaaaacaagccccaatgatccactgcctgcaagaaacatgctccacctataaagacacacatagattgaaaataaagaactggaaagatactccatgcccatggaatccaaaaaaagaacaggagtggctatgctggtaccagacaaaacagatttcaagacaaaacctataaatggagacaaagaacttcattatataataatctatgggtcaattcagcaagaggatataacaattttaaatataacagtggagcacccaaatatagaaagcaaatgttactagagctaaagagagagacagaccacaatacaataatcactggagacttcaacaccccactttcagcattagacagatcatcaagacagaaaatcaacaaagaaacatcagatttaatctgcactatagactaaatggacctcatagataattccagaacgttttgtccaatggctgcaaaatatacactcttctcctcagcacatggatcattctcaaagacagaccatatggtaagccacaaaacaagtctggaaattttttaaaaaaaataaaatcacatcaagtatcttatctgaccacagtggaacaaaactagaaaccaaacaacaagaggaattttggaaagtatacaaacacatggaaattaaattatatgcttctgaataactagtgggtcaatgaaatgattaagaaggaaattgaacaatttcttgaaacaaatgataatagaaacacaacattccaaaacctatgggttacagagaaaacagttagaaaagggaagtttatagctacactataaaagaagaaaaacttcaaagaaacaacctagcaatgcatcttagttaactagaaaaggaagaacaaacctaacacaaaattagtagaagagaataaataatagagaccagagcagaagtaaatgaaattaaaatgaagacaatacaaatgactgatgaaatgaaaagttggtttttcgaaaagttaaacaaaattgacaaacctttacctagattaattgagaaaaacagggaaagacccagataaataaaaacagatgaaaaaggaggcaaaggactgttagaggctactatgagccactgtatgccaatacattgggaaacttaaaagaaatggataaagacacatacagtctaccaatattgaaccatgaagaaatccaaaacctcaaaagacaatcagcaagtaatgagaatggagccataataaaaggtctcgcagtaaagaaaagcccaggacctgagggcttcaccgctgaattctcccaaacatttaaagaagcatatcacttctatttaaattattctggaaaaaaaaaggaggaaggaatacttccaaactgaggaaggaatacttccaaactcattctacaatgccagtattaccctaataccaaaaccagacaaagactcattaaaaaataaaataaaaaactacagaccaatatccctgatgaatattgatgcaaaaacccttaacaaaatgccagcaaaatgaattcagaagtgaaagatctctacaatgaaaactataaatcattaatgaaattgaagaggtctcaaaaaatgaaaagatattccatgtttatggattagaagaattaatattgttaaaatatccatactacgcaaagcattctacagagtcaatacaatccctttcaaaatgccaattacattcttcacagaaatagaaaaaaaatcctaaaatttatatgtatcaaaatatctcatgtgccccataaatatatacactatgtacatacaaaaattcaaaataaaaaactataataaacagaaaagaaaaaagaaatgcaatgaggaatagacggaatttgaggaggaggcctaaaataaacaaaatcaagtattgtgtgtattctaaaagaggagaagagccttacaaaaacacttacctcagggacaatgaataaactagtgggagtgcagtgaaaggctgtgactggatagtaggagaggattactttaaaaatgcagattgccaacatctcaaactctgtttatttaaatgaaaatgtttacttattctttgctctcaattaataaactgaatcagctattatcagagtagtatttcaaatgtgaatctttagagcaaataattttaaaaaagaaacacctttcccacagaaatactgatgtccaggatggagggctttccaggctggtccctgcagcccctgactacaaatgggaaggcagagtaatgatattgtactatcatcagtcccattcattccttcactcagtaagcatctgctgaatgcctaccaccagtccatcactctcttaaaaaagaagtggtagtggtgaacaaagagaaacaaggtctctactctcgtgaggcttctactttagggtggggaaggggagaagcaatggatacagagcataaaaataaacagatgagtaagattaagattacttgagacagtggaaagagcaataaagcaaatcaaagcaggtgctgtcatggggtggaaggcccctctgaggaagtgatatctgagttgacagctgaatgatgaagcagaagataagtaccaggaagtccctggcagagggaacagcaagaacaaagacattatggctggaaagagcttgatgtgttcacagaacaaaagaaagggcagtgaggctggagtcaagtgccagagtcctaagcaaaaagtaattgtgaagtccaactttgaacgtcaagcacacatttctcccttcgttctgttgactgccagagctttagcagctcctcagctctggacacaaaatgcatggtgttgagctcctcagaagctccagtggcctggggttctctctcatggatccaggaggaagccttgggatcaagagcctgatgtgaggaaagggaaaggactaggggagggaaggataaccagggtggtcacagctccagtacccacaaagacgctctttagaaagtaggggatttcaatccatttgggagaatttcagttaagtttagttaattttttagataaggaaagattcttgccttttgtttccttagtttgtctgtgagcttccaaattagcagtttggacaaaatcaggaacagcaggaaatccaagggtgagctatgtataaatcaagaccaggaaaactaggacagttgctggtgcatcactaaccttttaagatttatgttaaaaaacaagcaagcaaaaaccccaccatgccatcctagtaaacatcccttaggatcattctgaaaaacaaaacagatccactgatggatagaaaatgaatctcactggttatggcagtttttaacgagatttttctatttgtttggcctaatttttaaattcttgatcctcgtaatcaccatgtgggttgcagtagcaaaataacttgtgactgatgataattaagaaaaggaaatttaagaaatgcatgttttcctgagccaagtttcaactaaatgtttttgctactaaaattatgctttcttacacaaatgttgaatataagtaagttgctctggggatgttagtgtttacattttttcccatttgttatttattagcatgaattaatatgccagtttgtatttgacacaagattttttttaattcttgcaataataagactacatttctctatgcagtcatattgctttcttgaaaaggatgattatctcacagtcaatgaacttggtgacaaattataggtattttgatattgcaggtatagtaattttaatgcaacccatcaatgcatagatcaatgaattttatatttattatatgatatatattctactgtactagtatttctaaggaagatgaacacccaggacaaataaatatattttatttctgagtttggaatatacaaattgttattttcagtggcaatagcatgtctatcttctgttggaatgttattttaaaaaatacttctatctgcagcaatacagaaggaacactggttatttgggagataattatttctgaaaaaaatagagcaaagactaaaagctaagaactttgagttatttgtactaaatgttatctagtatcatttgagagatgaatgattgtaagatattgtctccacgctcagaagagaaggtatagatcttcgaaaaatttaataatttactgaattatattctaaataagtttaaatgttcacacatgtgaaaatgctttgtgaattaaaagctaccacaaaatttaagggcatgccattattattttcggagttagtttatcatggcaattcttatagctaaagccccatcaattcttcttttttcagtgaccaggtccagatcatcaaaataagaatgagcagaacaatgagccctcccagaggaagagacagccaacagaaaatgttattccatccaagaaatcaatttgtttattcataatttgaacaaagtatttccatgccaattactgattggtctctccaaggtctttttgttttttaactcaccataacagatggaggaaaatatatatacaactaaaacctgatagcataattagtggactggaagttggggtaaaaaccacataaccaaatccttaacaggaaggtcaatatcaagacatattcattatactttgaatggttatcaaaatacatgtgttagtgcaaatcagtaccatgtgctttttccctgtcagtatttgttttttatctaatttacctatattattatttttaaaatgtgatcttcagcccagtgagttctatcactctcctctttatctagtcctcttataataattttcaatgtttaatatgctttaaaatgggacaaatcatatccaggaaataaactgtttaccaagaggaactttgttaaaaaaagataaactggctgaaatgattaactgtaaaagttcatttcatccctgtctacatgtggcttgataattaattaatcttatatttatgaaaaataggggaaagagaatcataaatgttcataatttagaggaaaggaaccgagacacagagaggtgagtaccttgcagatgagggatcagtgcttaatctacatgtctactctgttcccacagtctgcaaggaagagaaacagaatttataaagtagatttgtaaatcctgataacatgagtcaggatatgattatgtaacttcaaatatctttgcatttaacaagctagaaacccagagcttgatatttgttgaattgcatacatgccttttcctggtttcttgtttacaataaattttgtggcaggatatttagatttgtgaattctagccagactgctctctaatgagactacagcttgtttgggttttaaagctttatgacatttatagatgtttactttgcatctctaaaaaacacagaaatgctcccatactataaaaatactgatctctaaactttcaaagcataatgcaaaaaatccctaggtgacgaacctttgtgatagagtaatacttttttcaattctttgacaagtggcactattatttataaacttgagttacacaggatagtatataactacagcaacaatattttgataaaaggtgtcagataaatgctttgcctgaaaaggctaatccagaaaacttttttccccttcctcttgcatgaaacctcttaagcagttgacaggcacgagacacattgcccacagagagtggcacacactgagaacacacagtatctgacttaaaattccagcttttgccaaagaagagttgtcttcagcagccgtgtcagggtgccccgggaaaaaagacagagactcctctggtcttttctgtcattaagtgtgagaaaataatactttaaccaactagtgtggaggtgattacctcctccaagaaacattttgataaactggcccactccacttgagcttctaggggttaagccagatcacaagctgagaggagggagagcaatgcaaataagaaataacccaaaatgaggcatccctagcacagttaccaattctagcttcagcctttcttttatctagagcgggtcctacaactccagagtttttttttttttctgggtctgccaaaattcaagttcctacactaatttgttgatttgggtctattagtataattattattttcatccccacatttgaaactcattctatgagactaaacagaagaaggcaaatggatttcatttcaaaagccaatttttatctattactagtggctgtctttggggtctgatttgagcagaattctgaggctgagcatggtgagaaagtacaacttaatgatttcatgatatctgctagctacggggatagggtcagatccccagggcttgcagcatgtgtaggtaatcaaaaaaatgtttgttgaatctttggttttatgcaaaatggctgaggtctctttggaaaagaagctttaaaaacaaaagtaatagaaaatcaatggctgtatacccttagatagaaatgcagccatccgctcacttaccttttatctgaaatacttcaatagcccttcctcacctctttccaagctatactgatataaaaatgacctttctaaattggatcatggttgctttttccatccctggttccttattctcataaggctctcttaggaagcatatcacataagcatataaagatcacctagggcagacagatagatagataaattagacagagaggtgaatggatggtaggtaggtaggtaagtagagatagatagatagaactagggcactttcattaatcaatttgctggttattctctgcattctgttcccttgcatcaatacctcagactctttgctatggctcagagacctatgttctcttcttgaaacctttgacttcattgtagctcacagattaagataaaagagactcccagtgacactctcagaagaggaagggtcccctggcattactgcatgaagaggcagattgagacgacaactcatcctttattagaatcttttccttagaatataaagggcaagctccttagtggtttaaaaaaaaaactgtatttctccatctggtccctgctgttttgctcagcttcatacaaccaatcatcattctccaacaatgagccttttaaagctccttaactacaccacgatgtttctaaagttctgcttctcttcactggtgtttttgcttttttgtctgcttgacaaactctgacttggttttgaaaacccagttcataatcatcccacaccacaccctggaaaaagttaatcattcccttctctgggttagctctgcactgttcccataaatatttctatagttgcacgaatcaggtgctttgttagtttaaattagtatctgtgaactggttgagagcaggaactttgtcttaattttctgttttcttagcacccagcatagtttaggacacattcaatataactgaggatacctttaagattttccattagggagaaaaagggaatagtgataatattatccaagaaaggaaaatgaaaaacaggagcagactgcattgtgagatgccatttgtttcatttggagatagtcacgtttcaaagtcccagttagatgtaccacagaagaaattagagggtttgggaaatctgggcttagagttaggaaaggggtttggagctgaagatggtcatctgagagtcagcaacacataggcagtagcggaagccatagatgcacatagaaatgaaaaactagaaaaagtggcaagaaccctgtagttcactaaaaatttggccccaaatttaggagccaatgaagaacatgtggatagatgaagactgggaagaatgataaggaagaacctggaggacctcagaggccaaggacattaaaatttcaaataagaaggggtatcgatcatgttagcatctcataatggttaagtgggatgaaagctaaacagatgagatgaattttctaatatgaagaaaggggtgtgcagggcaaagcacgacatcgagagcaatttcagtggaggcaaaagcccgggatagaacaaactgcagtcagtcagagtgaatgagtgcctttcatccagactcattacagaaactgtggcttaagcaagaagccctcagtggccatctgggtgagaagtggaggggaagagggatggaaaggtgtggtgagaaggaatcagctaatgggcaaagcaggaaggattctactgtttgcacgacaacattttacatattgtatattttaggcaagatgtccctaggcaaatggttccataatcccttttgttgataaatgcctattccctcatttctcatgtttctataaaggggaaagaacatcaactccaccagaagatacagtctctggcttctcattcacttcttcttgggaaggaataatttatctgatttttgagtttgggagaagaaattgaacatgactagctcattatcttcctcccttaaattcataaaaggcacagaatctcctattctgttatgctttaagcagcctgccacagcagaggaggatgacggctgtctaccaatgcctgtaactgggggctcagtttacatagaagggagttgtattaagtccaagtggtcacagatgtaagtcacattctccaattcggtcatgctggtaataaagcttatggtatacactccatctgtctcactctcatgtttgcttctcaactagatgtgaactcaaggtgggaatcgggtgcttaattattattgccttaaaaccttaaaagtaggccgggcgcggtggcttacgcctgtaatcccagcactttgggaggccgaggtgggtggatcacctgaggtcaggagtttgagaccagcctgccaacatggagaaaccccacctctactaaaaaagaaaaaaaaaaatacaaaattagccgggcgtggtagtgcatgcctgtaatcccagctacttgggaggctgaggcaggagaatcgcttgaaccctggaggcagaggttgaagtgagctgagattgtgccagtgcactccagcctgggcaacaagaatgaaactctgtctcaaaaaacaaacaaacaaacaaacaaaaatcaaaccttaaaattacacttcaaggaggttgtttaaaaatagagaaatataagacctccaattcctcatctgtgaggtgaaggggctgaagtggataatctttaagtccttcccagcaatctctacacgtctgtttgctattgtgtgtgtgtatatatcagacaagcggtggggcggtgggggtggtgcatgcgcaaggagtcagacaatcttaggtaaaaggaagggaggattcaaagcaggagcaggcagtcaccggggtagtgagcagaaaggtctcctaggctgaagaaaaattaagagattagagggcaacttacttatgaagagcattttctgagacaaaaatgaaggttgctatatataaacaaaaatatatatatacacatacatatacattataatacatagagataaacaaaaagcaaaatactgaatcaggctggaaaaaaattctccccaattcaccagcccttccatgctcacataaaccccttccctcattagattataagattttgtacctttgcacctaaattttccaagagaaaaaatgaataggccacaaaatgcctaaaagcaaatgctaggaattgtttggctcaaataacaaaacagagacccttaactaagctgaggacagtggaatattattttgccttcttgcctgttggaagcactaagaagacatttccaattccaacgttccatagaccaaaaggcttaggtgaagagggtttccaggctcacagctcaatgaaaacaatgatgatccaggggagtcatggcactcatgtcttcaacactaatggatttcagctgattcatcagtgaacatttctcagaccaaagtggaaaaagcaatttttgtcttctgttaaacagaaatctcagtcagtcttgcactgaattctttcacagaaaatctctgctcttctgccttttcagacacacaaggtctccagcgggtgctctccagagatggaaggaaggtgtgttctgtgcagtgcatcagttgctatgtgttccattgtggcaattgtgattcacaagggcatagctgagccaccacagctttcagctgtaatcctcctggcatctatccctgctgttagagggataattatctggttatccctgaggccagttcttgccattttcacataaaaatcacctcttgcataagacatggaatttaaaatcatctcctcatacatatcattgagtcacttcattacctctgggacatatataaattatgcattcttcgattctctttaaatttttagaggctcatagggacagtgaaggatctcattggtactgaaaatataaggcattccagaaagaaacaataacttgtgtgacattaactgctactagtgttccaaaggctccctgcttggtcaaggaaatcacataaagcatggagaactaatagcaggcttgcatgctaatgactgccggtctgctagtgactgaatgtcactgcctcacatcctcatgctattcatttttcttatctcagtgacttctcccttcacaggactgatttacttctttaaattggcaccattctgagtgtctgcaaccaagaaggcactgaaaaattagaacccacatgcccttattcccatttatttctccaatcccatgcctcaatattaagagagttatttgtctgtaccatggaaatagtgttttatgaattctctggagcttgtttgattttacctttagatgcgtccaagactcactaccatacgtgcattctttaaattctttaaagagagggcgtgacattagcatgaataaaatgcagtggctgtcacggcaagaatgaagaaatgtgtgtgttctcatgccctgccattaagatgaattcacagatgtaagctggcaacacaacacagcacaacacaacactggcaacacagacatccatggagggctacacatttcattccatagttcccattcaatataaatatggctaacattccttaaagattcaaacccatagtatattgttcacctccaaactggaaaaaaacctagtcctgtcacagaagtgaattcagttgcttgatctttacagctgctgataaaagtttgaggagttcacagacttatgggaaaagtgagataaacttcagtatccagcattaaaggctttccaaggcaaaatacattgtgcaatattaatttttcaagttaaaaattggaggtatttgaaaaccattgcttccccaaacaggaaggaaaaccactgtttgggtggtaaaatgtgctaattctgtacaaaatgcctttaagcccttgacctaatgaggttagtgacagggatatggatgactagaacagaaaatgaaactcagaaagaattttgttcatgaactgccatatttctcctgtcatttagccaattttccctctcaaaattacaacatggactgcaaatcttcaaggctaatgctgcatatgacagactaagtgctatttaaaatgtaataatatatctgtcaatctgataggaaaaaacaagaggccacgcgaaggacttttcaggtagacatgggtcctaaaaggttataaagacggtaatcaggaaagcaagccaccacacagcttttcccgtccaattagtaaaagtgcagtattgtcagcgagttctacaaatgaaagaatcctttcagcctgagcactcaatggcgtatacccactctattaagtgaccttcattgtacaatacattaatttctactaaaattaatgttttgggttaaaatcaatgcttagaggacattaatggaaatgatttaatatgtgtgtcatgcatactgtttcaaaagtttttaatctttgtaatttgctacaaaccaaaattatatgagaggtggaagaacactcagaattctaaaactcccactgctgactaaaacataccacttttgttttccactttcatctcagtcagggcatctgtgctattttaatctgccatgcctgaattatcaggaaagagaaaccactggtttcctacaaacatactttatcttagtaggacactttccctctagactctctgtgtggatattttcaaggattcacagcgagacactgggtgtgtacgattgaggttatttaagattttcccacaatgactggcatccatgtggagagacaccaaatgtcatgcctcttcttaaccagttctgaggcggggaaggtagggaaggaaaagcagtgcgcctggggagatggcatgacaaaagagagagccacattctgcttaggagcttattgctttaaaagttcacctaagattgaatttaaaatttgctttaagcacctataatgaaagaacattttagatcttgggagaaaaggtacaagtgtccagcatggagtgaatcgcttggccctttaatatttaacttcactgaaaaagaaacctcgtgaagtcctcttaaaagaacgcaggggactgcacaggactttctcaattgatggcataatgagaaccattaggaagcttgactccattttacatcttaaatctccaagtcctccttgcaaaaggaagcaaacagtacctgcttcccaagtgagacttgagtggaaagtcggccaaaatgagacagttttcagaaaacaaatttcagttaagtctcaggaagctacactactactactttctctattctccatgccctgctcctgacagatgggaaatacatcaactacactctgggcagaggtaagtgacacagaagatttccataggtagtgttcaggtcacaccttcctgaacaacttgttttattaaactgttcctaagaagaacctctgccttcctgttgaccttaaaatcttctcaagaggattataacacaagatgcttttatattgtggttattaacagctaccatttatcccagaggctcaaaacaataggatgaggattgttaccagaagaataagacatagattcctcggtaatttagcaaatttccagctgtagtactccttgcccagtaaaatgcttggctagccctttggtattttactccaggttcctcttctgtaaagtcaaccaacacaagtggcctgacagtcatgatggtgacaagggatgatgttcactttgattgtattttggaggtaaatgcctgggcaaagaatataagaaaccacatcctagcaatatgttgtaatacataagtttctaaaaactaaaaaacaactaaaagaatgtacattccattgaaatgtactggcccttgtagtctaatgagaaacgtaatagaagacaatgaaacaaaaagtattttcttcaattaataacacaactcaggaagaaatgttaagaattaaggaaaaggactcataaaaagcaaccagagttaattgtttaagaagtgcatatctaaccccatcacttgcctacttagattggcaccaaatccttaacacagactgttgtaataggacaacagaagctattaaagggtttcaaactgggaggggagggaagcatgcaatcttcctacttctgtcttcctacttctaagactcaatccacttgccgctattttctgctttctctaggaaagcttcccacagctgacgaggaaattagattccctatagtataatcttgtaggactgtatactttttcttgacacttatcacacttagaattactttttcaatgtttctctttctcctcagacctgtgatgagcaatatggcagccacatgtagctattgagcatttaaaatgtgcctagttcacattaagatgtgctgtagtgtaaaacacatgccagatttgacaaacttagtacatactgctactgaaaaaaaaaatgtggccctgcagaaaccttgattttagcccatgagaccaattttagtcttcttagctttagtaacagaagagaataaatttaggttgtcttaagacactagtctatcgtaattgtaacagtagcaatagaaaactaataaatgtggcttccagaaagattaaattacatatatagatcacatagtatttctatggaacagcactaggttagattataaactccatgagggcaggaaaatgtctgttttctcagctgctccatgttctgcacccagcatgcttcctgacacatatagtcagtccaaaatactgtggattaaagaaagaaatttaaagaaggttttaccccctttataattcgtaattcaatcactattccaataaaaaattattaagcgtttactatgaaccacacattgtgtaaggcactgaagatacaagtataataagaagtggttgccagagaatgggagagaagggaataagtagtaactgcttaatgggtatggatgttccttttagagtgataaaaatatttttttttttctttttttttgagacagagtctcgctcagtcgcccaggctggagtgcaatggtgcgatgtcggctcactgcaacctctgcctcctgggttcaagtgattctcctgcctcactctcctgagtagctgggatcacaggcatgctccaccacacccgactaatttttgtatttttagtagagatggagtttcgccatgttggccaggctgatctcaaactcctgacctcaggtgatctgcctgccttagcctcccaaagtgctaggattacaggcatgagccaccatgcccggcctcaatattttcaaactagatagcaggaccagtgtctggagagggctgtctccacttccaagatggcaccttatggctgtattcccctaaggggaagaacactgtgtcctcatgtggcggaaaagacaaaagggcaaaagaaagaaaagaggaattccctccatcaagccattttataacagcactaacccattcatgagaatgaagccctcacaacccaaaatcctcccaaaggaccccacttcacaatactactgctctggggactcggtttccaacacatgaattttggaggagtcctccagaccacagcattaaccatgcagattgtagaaggaggaatattgcagacagaaagctcatttatagcatccctagatggctcttcaaactcttggccttctctattaactgacaactttctgcttccttgcccctatcctgattgacagttcttagagagtaaagcctgaatctttgaagtcatagtcaccataattacccagagtcacagagcccaaggagcaaaaagctgttcaaaatgggaaactatataaaaaaaaggagaatgggatccagaggcttgatcaactctatgggcaatcccacaaaatatgcatgtaatatataatcagagagaagaaaggaagaaaaaaactaggtttgcttagactttacctgacgacacacgacagccatttgaaacgatctggcttctaataaaaataagacatagagccctaaacacaatttgggaagaaaaccaagaggtcatcaaaatcacaggatatacatgacagtggatagggccacttggcttctcctgtggctgagaaagatttaaaaacaacctgggaatatcagtgaaatttatttcaactaagaattgatgcaaacaactgtacactagataaaaaagaagtggtaatttgaggaaaatgtattatatttgtgctctagaataattttgtttataaaattttttgacacatttgaaaacttttatctctaattcttaataatgaaatgctaataattcatacttaatatacttaatgacaaaatttacctaatacttaatataatgaaatttatcctcagttcatgtgttatcttctcagaaaggccttcccttcataagtagcgtcactcaagaggtacaatcaaatccccttgctttatttcctgcagattattatctgacacttttttgttcacaatgcatccacttttctgcttacatttgcctcctctctctagaatgtaagctctgttagagcacagctgatatggtcttattcactgctttgtctgcaaccacccttagcagagtgccaacccttagtaggtatctttgtagaatgaatcaatgaacacaaaatcaaaatattattgcttgacttaattccacctttgatctcctcccccaatgatatataaaactttataactggaaaatttgttaattttatttctattctagaagtcttactagatttaataggtattatagagttaattaagcaagtgggaccagaaatcatattcctagataggaattcttgttccttcattttttttttccttctgcttgtgtggccttgggtaagctacttaaccttcttatgacttagtctcatcattaaaatcaagggattaatattaatattagctatgtcatagggttgcttgaagactcaaagtgtagagaatagtgtctgggacctactaagcacacattaaatgtaaattccataatgggttgaagtagtaaatgaggaagaatggtggcttaacaaaatgtgggattttctatcctctcaaagaaacagatggttttaggagtaagttatctgtacccagaggtgttcaaacagaaataattatccacttgatggagatattagaaagaagatttatgtatcagaaatccaattacattagataacttttaacagctccctttctactcttgcagtgctaagctcccattgtgaactgaagctgagaagtacacagtacacttcccagatgcaaagacaatgagcatttcagtctccaatatccagcagatgcatttctactattttcacaagggattcagtgtcttctccatacttgcagaacttcctgtttatctttcactatccatgtctatgttattgatctccccatgagaccacaaggaatcagggtggaggaacatgggaaatggagcacaggcattctgggagacagaacactgagagctatgcttgctcagaaggctcatggtaaagaaaattgaaggcaaacctgaaggggaggaattgcaaagactttgagatcttcaaataagtcaaaaacaaaacaaaacaaaaacactacaattcttaattagaaaggaagaacttaaatttatccaaactcaaagcagcccatattctactgtaagtggagggatatgacactggaaaccaactgacatttcccaaagtggtcctacagtaggaaagagttcaaggtgttcttccagatgcccaccaatacagccagcaaggagggtaggggtagggtggtgagggctgtggaaaggggtgcacccacatgcaagcagatagtaatcatgcctttttaaaaaagaagagagacctgaaaaatctaaatccaggtgcagacttgagaatgagaatgagtcaatgggcttctacatgtacatcatcagaacattatctgggatattcatgtccttgacctgtacaaaaaattccaaaacacctgctataccagaaaagatcagttaaatgacattctactttaatatttatgttaactgggttttatcatattcacattgtctaaaaattagcaatttatgtgtacaaagttagttgacactcagccatttggggtttttttgtaaacagtggacacttttgtcgccaacaagtaatgttacgtagcattcacagacatagtatgacttaattctcaccagtcgtaaatttggagcagcttctctgtgaggtattttcaagtgccgaccagaatagctgcactaagaacagttcttgtatgctcaggtgaatacctaaaaatacacacttattcttctttctacagcagtgaaagccattttcacctcccctacaaaagactttgatgtcagtgtgtgtcagcctcagttaagctgttgcaaatcctatatacacatttggggcagttctttcaaattctgatgagctagccaaaaattgcttcaaaaatgttacagtccttcctcactgtttgcacgcaattattggtaagctcattctgagttcaaagaacttcaaagtttatttttataggtaaggttacagcctctcttaatagaattctcattttgtactgtatgtacagaaatttgcttgagtctttagaagtttattttagaaacttgagaagttttaaatttacacatatgttatttagtaagtcatatttaaattcaagaacttgtcaatttaatatagtttgtcctttaggagattaattgaagcaggtggtaatgaaagttaggaccttgtgttgaaatatgatagatgaatttattttaaggctattggaagagctagtttatttgctataccttgtattctcttatacctaaacatagagcaaaatggagagatactcaggtatctgacctaagttattttagcactacctgattctttttttttttttttttttttttttgagacggagtctcactctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcagcctcccaaagtgctgggattacaggcgtgagccaccgcgcccggcccactacctgattcttaatggcttcctctggcatcaatatttcatcagttttattccatccccaaggaggaaaagtccatttcttacatatacaattaaaaatcattttctaaaaagcttaagtcttagcacaagacaaagaattatcatacaagtgacacaaaaaagttttaaaaacattttccaaacatcagcggttattgattacgagtgatactttccctactctcctagtgggtatttttgattgtcaaaatgagctggaagactctgttggcctttactgtgcagaggagccagggatgcaaaacctcctgtaatgcacatggcagccatgaacaataaaggactgtgccaaccaaaatgtcaacatggggatacaagagaaaaatacagaaaccaattaatagcaggaattatttacctctttccatttgtgatcaatcaagtagatttaaaaaaaggaactatacagagtatccaaataacctaactaaaatggtaaatcatatatagtatgttctacatgcatgtatatatcatatctgcaccctggaaacacagaacacaccttcttttccaatatctacaaaacaggcacaaaatttgaaaatctattatgccacaaataaaacatcaataaattccccaaaaaagaaaagtatagaaaacattcttgtatcatgatacaataaaactatcaatatctaacaaaactagaaaaaatatgtcttatcttctgaaaattttaaacttccctcataattttgaggtcaaggaagaaaaaaattaataacatgcagaaaataacttttaaaaaaaatccacaggatagctaaagtcatgctgaaaggaaaattcatagatttaaacagttgattaataaacatgaaataataaaaactaaattaaacattccatccagggagttaaaggaaacaaaactacagaaagcagaaaaagtaataaatatacagaaatataaattaactgaaagtgtcttatttattttcaataaataaattgagaagctggtacctaattagttcaccaaatcaagggggataatgaaggaggctaaaacaattacacaaaataaaaataataagagccagataataccaacatggaagacattttatttctttttctttttttttggagacagggtctcactctgtcacccaggctggagtgcagtggtgccatcatggctcactgcacactcaacctcccaggctcatgggttgctcccacctcagcctcctaagcagctggaactacaggcgcacaccaccacacccagctaatttttaaattttcttggaagagacggggtcttgctatgttgcctaggctaaagacctttttaaaaattataattgattcctttgctcaactctgtgcaaataatttcaaaacatggataaaggagataattttctagaaattattgtatgtcaacctacttccagaagagagagaaatattacactaattatcacacaaataaagaagattgttagagttatcccccaaactggacacacatgcacagacagacagacagacagacacacacacacgcacgcacacacacagcctagatggtttcatagcacaacttgccaaacctttcaaataacaaaaaattccaatgccatttaaactccttcaaagcataagggaagaaaagactaggacagtttccaagttctttttacaaagcaatagtaacattgataccaaaacttgacagattgtaccaaaaagaaaattatggagcaaactcatcttggaatagcaatgctaaaattctaaattaaatattgacaaatagaatccaacagcaattaaagtaatacatcatgactgagtgaaatttattttattcaggaatgtaaaataaattttttaaaaagaccaaaaacttagaaataaatctatcaacaccaaattactcattatggcattcaaagccttttatagatgacacagttttctcttccacattaatcccactatttcaatgacagtcaaacactattactcactttttcttgtacttatgctatttcctatcccttaacctccgctaattttgtatctatgtttggaatgccatctgtctaaacttcctcccagttctaaatatcctatctacccataaaacccaatctaaatattaactcaaaaaagcttatttgattctccctacagacacctttcttctgctgaacaaccaaaatgctatctttcttgcagcactcattatatattttttaaaaacatcaggtcttctattgtcatcaagtaaacacttgttattttcagccatgtattacagatatttgtgtaaaggctctacatctcctatcagatataaacttttcttttttttttttttagggtaagggccatgtcttatgtacctttgtattctaatcactccaagcacaaatctttccatacttaaacattttgacgcacgagcacaaaaaaacccagattgtaaaagcaaactgaagacttgcgaagaatagtttccccttaaaatgtaactgcatgtgcacaggatgaagagttagaatctgaaaatcagctgggcactagccatgcctgccctgctacctttccatagccagaatcacagcagcatgaactgcactcaagctccagaccaagaaactctaattaccttcagcgagcaagtaaactgacagtaacagctattgcaggaggcaaaagcagctacaaccttcaattccaggcacggaggtgggaataaggaaagaagtcgggatggaactgttggtttcattaggttgttggtttggaagcaagtatttcacaaacacacccatccccccactatacacatccatccgcttcatattttcatttctcataatgccaaaatattaacttgtgttctaatatttcagggaagatgtataagctagtgagagtcataatgtcgagtttcaaaatgcatgtataatttgttatgcgtggcagggtgaacagtcctatcagaaatgcacctgaaggtttgctaggaacagaatattaaacagagcagagactatgggatctaacgtgataaactgacattaggttagaacagtacaaaaatgccacattccaaccactgttgatacacttctggagaagtggactttcaatataaagcagttattctaggtgcaattttaatagcaatgaaatacaatgaaatgacaaatctctggttcattctgaatacaagagttcctgcttattttgagaccatgtgaatcaaagaagtcgacatcaccagcactttgcttgtaggctaatctagtagtgacttttgatttcctgctccccctgttgatccatccatccacagctttaagaccagcctgactacaatcattcttcatgtcaccaaaatctccatccgcaggcaagaaggagatacccagctgtcccagtttgttaccccatcgcaagcacaaactgggatcactttctccaccccaactgtggtaggctgaataaaggcctcccaaagatgtgaacgtcctaatccccataatctttgaatatgctatctcataaggcaaaaaggattatgcagatgtgattaggttacagatcttgagatggggagattatcctggatgatcctatggactctatgtaatcacaagggtcctataaagagggaggcagaaaaatcagtgttacagtggcttaatgtgagaaagacttgactggcaattgcaagttttgaagatggaagggggccatgaagcaaagaatgtgaacagcctttaggagctagaagaggaaagaaaaggttctgccctagaagattgggaggcagggcagccctgctgacaccttaattcagcccattgaaaccggtttcagacttctgacttccagaattgtaagataacatatttatattgctttaaggcactatattggtggcaatttgttacagcagtaataggaaatttagacagacaattctgttcttggtctatagcaccacctcaaagcatccttattcattgatcgctcacagttaaccaccctgccacttgacttgccaagacctattgattctgtctcctaaattcttttaagttttgtttttctgtttttgttttttgagacggagtctcacactgtggcctgggctggagtgcaatggcgcgatctcagctcactgcaacctccgtctcctgggttcaagtgattctcctgcctcagcctcccaagtagctgggattacaggctcctgccaccacgccccattaattttttgtatttttagtagagacagggtttcactatgttggccaggctggtctcgaactcctgacctcatgatccgcccacgttggcctcccaaagtgctgggattacaggcgtgagccactgcacctggccaagttttgttttatttttattaacaaactaataacaattgtttatatttatgggttacaatgtgatgttttgatacatgtatacattgtgaaatgatcaaatcaggctaattagaatatgtatcatctgaaatatttatcatttctttacggtgagaatgtgtaaaagcctatcttttcctaaagcgtctatgttccatccatctttccttgtctccacagctactctctgagagaaaacttcagcctgtggctccttactgttctccctacgtctgctcaggccactcccttcgccaaccccaagctgggcaggccattcaccaaactgccccagagggtctttctaagacataaatctgaaatatctcaagacaaatggcttgccattgacagcagaatgaaaatcacctttctttacctgataaaatatctttcacagtttgacacctacctaggcatccaactgtaatgtctgcttcctggtcaaacttgctgcttgaccagcatgacattcatacctggtgcttcaacatgactctgtgcctttgtctgctgttctctcactgctcctctaactgacaaacccctaaatatctttcagtactaaaccaactgtgttggcgggctcttgacagtgagctccttgagggctgggacctctcttcatctctttgtctgcagtggctagctgaggcctccctctgaatgaagaggagggggcaagacttcctttctcataaccgctagcctaccttctttcctgccacattagcttacttttactttcagctcatatttggctttggaattactttcagaattagcagttgatacccgcccagtcagacaccatgtcctcacactcctgtgttttcagtgagcaggtgcaagatttaagaaatagtaaaagaggcggtggctcacgcctgtaatcccagcactttgggaggctgaggcaggtggatcacgagatcaggagatcgagaccctcctggacaacatggtgaaaccctgtctctactaaaaatacaaaaaaaaaaaaaaatttagctgggcgtggtggcacgtgcctgtaattccagctactcaggaggctgaggcaggagaatcacttgaaccagggagttggaggttgcagcaagccaagattgtgccactgcactccagtctggcgacagagcgagactatctcagaaaaaaaaaaaaaaaagaaatagtaaaagaacaatcagctctgatatcctggccacttcatctaatgctaagaccttcattttaaaagatagatttagggtaagaagcacttgtcagtctcaattttgctccagatgaggacccacgcaaaactacttctatgctttcctttcttggttataaagaattccactttctttcaattttcagcatagataagttttttactttcaaatcatccattacttttctctggcccatctccaatttcctaatattgtgtttaaaatatggagctcaaaattaggctctaacatagaccttatcaatggtgaacacagtgagtaaatttcatggttcttgtgtactacatacattctggttaatgcaatcccagatcatgttcaccttcttgataacagccctatattgctgacacatatccctgacaggtgagaatggctttttacctatagagtacttacatgtcaattccaatctttatgatggctaggatagtctatcagtatattttttctggaataataaaaacatcacctattgcaaagagctgtctaatgcactgacagtatagctcatcttgacttgatgttccacttcataattggaaccattagactgaaatcagagcttctgaaaattctctgagttttatttttaaacatgttatatatttatgtgggtacataacaatttcattcaaagtaaaaataaatacagttattcttcaactattagttgatacaacttcactttagaagccataaatatcagaaacaatgatttagataaaccatgtggaaatagttttaggaggtatcctccaattccatttatggaattctctttgcattttccaaaaaaaaaaatctataacaggaaagacagttgaaggcagagactgcattttaagttatctgcctttctaacaaagcaatggaaagggagacccaaattatgcttctgaagtgaaacgggataagcttagcaaaaaatttcatctctaattaactccttaaaaaatttcagtccagattaagtatatttctgttaattaacatatatagttaatttcattttctcatattgacctagtaaaattaaagcatacaaatacatctaaaattttttgacatactttcatgacagattgaacattatcttattaaagcaaaatgtatagataagtgctttggagtgaaaacatctggatcatagtcttagtgcattcaatcactataagatcaaaaaagtcacattactctttaagatctccatttcttttacatgataatgacaatcagtaatcgtcataacgcttacaacaatctactttttccctctgatgtgagtgtggctgagaaatccatataacccttaaaaaaataatgaataagattaaaatacaaccctgtaatgtggaccagtatgatctctaaaatacaatctgacacttcaatatagggaagttgaggttggaatttgaagttgaaagtcctactggagcctcattcccatacctcctagacatatggcctctgagccgtggtttcctcattactgtgtcagatagactacactagtttcaagtttttgttcttggaggtgaaattctgctcagatcctcaataaacaaatgatgaaaacagggctgctctggtgatgccaatgtggcagatgtggggcacttcgcatcctaacccttcattctatggccccagcaaaagttgcatggaacaaaattttaaaaccaatggaagcgatttagatatgattgttttcaattatcaagtcttggtgtctcttaaccatatgcacttgccagaggtggggtgagggagaagtggtattttaatggcaaagagcactggtacagatttggacttctaatccttggtaggctaaatattcaggaaagctctcctttcataaaacatttgcatgatggataaacagctaacttacagataaacacattgctgagctctccagaaaacaagggaagctaacaaaagatgaaacctacaaactaaaacaagaatgctaagcaaaccctgaagttgggccttccatgcaggaaaaaaatgaccaaaccaggaacccagagctttggacattaatggaaaaaaaaaaaaaaaaaaaaaaagcaaagggtctgcagaaagtagtgctgttaagtctgagaccctaaattcaacgggtactagaaacaacctcaccctcagtgaaagagagcaccaaaagccaatagcctgttgcagaggaaacagataggaagcctacctgtccctgcctactctcaggataaatatagcaagaaaataattgtctcccctcagaatctacaacagaagaccagatctcagatggtgtgaagtttatattacttggggtgtcaggaaaactctaggccaaataataactattatcaagatagggtgtcactctgtcacccaggctaaattgcaatgacacaatcatagctcactcagccttgaaaccctgggctcaagcaattctcccacctcgacctccaagtagccagactataggcgaatgccactatgcccaactaattttttatttttcatttttttggagagatgcagtctcactatgttgcccagtttagtcttgaactccaggcctcaagcaatcatcccatcttgtccccagtgcactgggatcacaggcatgagccaccatgcctggcccaggccaaataattaaataaaagctgcccttagttggctacttattgaagccctggtaccccaatgaagcacaggcaagtctattctgcaaaaaaaaaaaaaaaaaaaatccttaatatacatccctcataattcccacagattaagttcagccaagtatgagctcacaagcaaacattaatatatgtaggtgaggaactaagccaacagcaagctacaaatttgcttgatggcctcaggtattagcattaattgacatagaacagaaaatcgttatgctctaagtggctgaataaatgagaggaaaaattttttaatgatcagaaaatatccaatcagacaaaaaaataacaaaacagatgattttataaataaaaaagaaagcttttgaaacaaaaaactgaatgatgggttacaccacaaattagaactcacttgaaaaaaagattcagtgaactagaacaaagacttgaaggagcaaccccagattgcagcatagagtgacaaagaaaacagaaaatgtaaattagaggttatgaggcatgaatgatcgaaaatgagaaggaacacattacaattaaaattgtctttatccaaagacaccataaagaaaatgaagagttaatccacaaacatggtgaacataaaacccaaaaggatgttacatagaatacattgaaaaatgggccgggtgtggtggctcacgcctgtaacctcagcactttgggaggccaaggtgggcagatcaggaggtcaggagatcgagaccattgtggctaacatggtgaaaccttgtttctactaaaaaaacaaaaaaaattagctgggcacagtggcacgcgcctgtagtcccaactactcggaaggctgaggcaggagaatcacttgaacctgggaggtggaggttgcagtgagccgggatcacaccactgtgctctagcctgggcgaaaaagtgaaacttcatctcaaaaaaaaaaaaaaacattgaaaatgcctatgtatcaaaagataaagacaacccaacagagaaatgcgcaaatgtcagaaataggtatttcaaagaagaggaaacataagtggtcaaaaaaaagtatgagaaaatgttccaatagtaaccaggaaaacataaatttaaaccaggaggtatcatttgatactcaagattgggggaaattagaaaagttgtggtttccaaatgttgacaagagcacagagtattgaatacaggtgggaatttaaacttaacaaccactttacacagtaatttagcactgtatttgaagatacacatacccattggctaattatttcaatgactagatgtattatttcccagaaaaccatctgcacctatgtcttacagatatataaggtcttagcagcattatttgtagtagcaaaataaaaataaaaaacccaactatgaacaattcaaatgaatcaagagatcattaaaaacttctgaatagtcatacaatggaatatttcacagcagtgaaaattaattaagtgtagctacacaaattaatacagataaatctcagggataaaatgttgaataaaagaaaagccaaacagagtatgagtccctctatataaactcaaaaacacataaaacaatatattgtctacagatcacacatgtagaatacaaccataagacaacataaaaggcacagaaaggaggtttggtgggagagagatgaggggcagcaaactggagaaaagtacgtaggagacactccatttattggcaatggtctttagctgggcagtgcacacacaggtgttttgtctttctagtcttataatgtaagtacctgttacatgctttcttttatatgtatgtaatgttttgttaaaagtattaaaattctaaaaagagcattggagttgggaacgagcagcaaaccccagggaaaactggagctttggccagatttgtctcagacccctcccacctgcattttgtctcagccaattacagctcccatccacgaatactgccaaaggagtatgtgataatcctggtgttggcaaatagaagttggaggtaacttttcccatggaaactttgaaggcaaaagaccagcctggctttgacaccctccccaaaacagccctgtgccaggggacaccttctcacagcagcccacacacgactcagctccacaatgggggtgactggagggccagcctgtggaccacttacaagagcatcccagagcccctctagagggccagttacccctaatgatcacaatgctttctctatatttttcaccgtgtgtgctcaacaagctcctagtcattcaccttagttgaaaagacaaataatttgaccaactttttgactagatataaaatgtgaaaggagtccaacaatgcatacaagtcacacttcttatattactatttaaatgttagtgacttctgaatttaagaattgtgttactatttgtcaactaatcaatatgtttactgaaacactcagtccttataagcataacttagtgcatactgcaataaaaaatttaaaatcttgagcatctgggacatgtaaaatatgtgattaagtaatttatgggaacattcatgcagctttatttatagataatttaaaataccatcattgcattttttttaagtaaaaacaagtacacaaagaatagaacaaagaacagcttgatttattcttgtcagtaatagaatatcagtatctattagaatgtgatttaagttaattcctcaaaattagtttggttggattttcaatgtttttacatcagaatgcaaaacttattggtatagatttttctatgctgtaaatgctatcttaatgaaatatagaaggaagggaaggaaggaagaagaaattaagctttttctaaagacaggctatatgattcaactaagccaatttaacttaactgcattgatatttgccagattgctatcctcctctgcagaggaaggccctgaaaacactaatgttcatcacaaattctcctaaagtcacattaggatctgataaaatcaataattctttggcacattaaaaattgatctcaaggagatattgccttataattattcctttgccagatacccatacaaaaacactttcataaattgttaaggttttacttaatattctgcatccttgaagttctcaaaaatatcagtaactatcacgttagttattcagcagcaacgctgtgctagtatttcatatagtaacagaatacatgccaactaattccaagaactgcttgtataactggattaaaaatttcactaataattattgtagagaagaccagcagcctagagtctgacaaagattgttgtctggagtgacttctcatctgtttaccttcctacaggctttggagaccatttcactggcaatgaaggaattctactgattttgcccaaaatgcatcctcaggcctacctcctttcagggagaaggaaccaaacgaataaatgatcccatagcctacatcagagatcagaaataaaatggtttggaattgagggtgagtggggagagagtgaccttgagaagccactgcaggagggcccttctaggtctctgaggcaaccacaactcctccagctttgttttcttggttattctgtctgcagcgaaacccttaaaacaaaacaaaacaaaacaaagaagcccttcgaagctcacctgagaagtgactagaattaaggagaggttatggagtgttcgtactcagcaggaattcgaaaccatggaggtagccaacaagggcgccctcacccctgagggtccatttggatttgcaattctattcccccacccccaccctgccacccaatctctgtacacacacacacacacacacacacacacacacacacacacacacacacacacacaggcactccctttgaagcaatttatcaggctttcttctggggaaagtcttggagtaaatattagttttcttaacttatccttcttctattgacaatgacctgttttgtaccaaagaagctactgagtaatggagttatgaagcacgctaaaactgggagttcatccaggtaaagctatctgggattttgtgccagagtctaatcctcttgccctctaggtctggaggtatctctacaaggtcagggagatgtgctcctacctaagtgattgtctcttactgcgcccaacaacgccaggccccattgtgctcggaggagtgaagggattacaagagggcaaaataaactcttccaagatgcacagatacttcccttctaatatctctgcaccatccagagatactagcaaggaaggagaagttccctttacaatttggaatgcagtatccaggaatgtggtataattctttgatttgggtgataggtataaatagcagtggtaaaaacagcaagttacttctgtctacaaaccgaggtcaagtcatcccttcttaaaaaactgttagctggactgttcctgtctggtgtaatagtgtgaataaagattagtctgtacacatacatacaattcctcaaaatagtatcttcatataaggagagttatatttgtataaaagaacgtgtttgaaaattacaggcaatgtagcaacaattcctgaattattcttttgtttacttagcacttcagttcaaaaggctaattagttattttgtttaagctgaggaagaggggctgaggctgacatggaacccaaagtaactatctttggtttatatataggtggttaggatatatcaggcgctgtgtagccctccctttattatctcactgaattttcacaacaaccctgggaaagaggtattattatctccattttgtaagtgaaagaaacaaagagggagagaacttacttaatgtctcatgggctcatagctaactattagcaaagccaacattcaaacccaggcctaactccaaacctcacgaccgaagttgaaccaatacttattgggagatggtgcatgaggcagcagggagattcctggctcccattttccttcaagagactctgctgcaaggagcatgggtgatgaacagcctccagttgccatacctttgcatcaccacagctttcactccaagaccaagattttccagggcttctctcagcccatgtctaagcatgcgctaagaaggttgtcagaagtgaaaggctcaggcagtttatcagagaggcgggtggagatctggaaggacagtgctgtggatctcagatgcctcagagacaccagggctcccttggggtgaacccacagctagggagagatggtgccttagggagggaaagcggcatacctagatcagaaggagcttaatgtaccagattttaagaggctgttaagtgagaagggaaaccgggacccaaatgaggtatagatattgaatgaatagaagtttgtagagtaatagcaggtagaacgaattatttacattttctttttctttggtgtctcctgttttcttcttcctccttgattatctaactctaatctccttataaaaaacatactcttgtcctttttctttcatcctccagtcagcagaaaaacataccaatgaacattttatttcttttttttattatactttaagttctagggtacatgtgcacaacgtgcaggtctcttatgtattagactttatgttcgttgttctccatacagattaattgaacattaaaatttttctttctcaagaagagttaactgctcttttaacatgtatcatggccctcaattaacattctttcatagggtcatagggtcaatggtaagaagagggtacacttttcactttcatcagaggtattttcataggaaaatactggctaacaagatttatcctataaaattaaaacactagtgaaaatcaaattcacttagaaaatatctatatacaatttcacttactaaaagagctaaaataaaggctaaggtttttcttaaagcaatcaacttcaggagctacttgcaaattagtgtctgttcttttctttaccagtcattagcctgaattggtacccaagtcatgttacgagaaaataaagacttacacagaccattttaaattctgtagtctcaattaccatatatgctcttattaattgtttctaagaattcctcttcaaaatgtgtgcaagtaacgcatcatatggaaaggcaactgagttttcatatacggcttaaaaatacaaacttcagaaacacagatgttataccaaattctcacttgcttactcccagctaaactcaatctctgagctttaaaaagattttctaaactgctaaagattaaaaaaatgacattatacattcacatctggctctgtcaccatttagggcatgttaacatagattttaaacatctggggacaggggaaaagatctatcgggagcttttcactaccatgacaactgaagtgtactgttgctcaaatagttcagtctctgctcatctacatttaacaccaccacaggccttccatttttcaccacttaaaaacaacaattatcataggaaataatactcatatgtagaaagttcctagggagagtgtttctttcatttccatcctgctttaatcctgtgggtaggacagatccttcctctttgcagcaatgcagttaaaccagtttatattttctggcttttagacatggaagtccttcctatatttttgagtcactcaagagatggctcttaatgacaaagtcttaatggaaatggtgaaaataacctagcattatttttttctataaagcagcatcctttctgtgtgttcaaaatttaaccaacattctaaagagcatagaatatgggcaataaaaattataggtttcatgtgttaatgttttctgaatggcagatgtacaacatactttagacatactatttttcatttattcttcaaaactacctgtagttagtattattactttggaaaattaaactatggagagaggtacaacattcacacaaccatgtattaagtgcctatgcttgggcaagtgctgtgctaggcaacaggaatgtaatggtaaaaattacagcatgccccaccctcatggagtgtatcagtctgttctcacacggctctaaagaactacctgagactgagtaatttatgaagaaaagaagtttaattgcctcacagttccacacgcttaacaggaagcatggctgggagacctcaggaaacttacaatcacgtcagaaggcgaaggggaagaaagcatgtcttaccatggcagaacaggagacagagagagagagtgggggaagagctatacacttatcagataaccagatcttgtgagaactcactcactattatgagaagagcaaaggggaagtctgcccccatgagccaatcacctcccaccagggccctcctccgatacgtggggattacaattcaagatgggatttgggtggggacgcagagccaaatgatatcatggagcctaccatccatggccaagaaagggaaacaaagggccactgacaggtgggaatggaatctaaatctgacttcaaagcaaaaaccaaaacatcaggtctgactgacttctaaaccaaaagccttgaagtcacctttgactcacctcttcctgtcacacacaatacatccaatccatcagcaaatcaggctagctctggcacaaaatcaatccagattacaaccacatctaaccacccaggtcaaaatcacaaccatctctcacctggattattacctccattcctaactaatctctccatctctagccctttctctatttattctgttctcaagagacagccatctgggtcttgctaaaatgttttgtcagacatgtcactcttctgctcaaaaccctgcaaagtctcccatctcactcagagaaaaagctgagtccttacatcagcctgcagggccctatacaatgtactgggtcactgtatctcccactgctcactttcttgctcactcttttctggcccacagtcttctctattgttcctcaaacatatctggcctcttctcatatcaggagtctgtacttgctgttccctctgcctagaactctcatcccttccgaatggtaccagcttagcaaggcctatcctgcccatatttatgacagcaagcctcctccagcatgccctattctcccttccctgcctcatcactctctgcagtacaaatcaccatctgacatacactttacatgttgaaattgttcactggctgcctcttgtgtctcccggctctacagagctgactgtgctcatctcttcccagctcccatccattgataccatattgctagcctgaaatcagctgtgatcagcaaacactacaaaataggcctttaaagaaaaaaaaaaaagacagccaaattagtgtatagcactctcctcctaagaacacatagccccctccaacaagaaaatatgctgcatgaagcagagtttttgtccattttgctccatgctttctccacagaaccttagtgcttggcacatcataggaacaagataaatgtttgttaaatgagtgaacatttctcctatcctcaagcagattgaaagtactagtatcagaactccaaaccttcattttcagaactgctctaagcatgttctgtggtttagaaagcgtggccattttcctgaacctactccatctgttcctaacgggggctcctctccacttgcatggtctatgggcagaagacacaaggattgccagtgccctccagtctctgcacatgcctctaactcacagacggcaaagcagtaaattgggaaaagcctgacaaaactgttttttcatttttattgtaacttgttaaaacaaatattaaactacagatgatacagtgtgctatgttcaaaactgtagaaaaatgtgtgttaaaactatgggtcatgtttaagaagacccctttaaaaacacgttgtttagaaagtaaaaattttttttaggatccaaggagcagtttaacagaggctctaaaggaaagagcaaactgataaggatctgcagaggaaacatgttattctgtcacatacatggaggataactctttggtaagtaaaagagaaagaatgtcactgacccacgtaaatgtgttaacagtgccttaattcaattgaagtgggaattctagaatgttcgtgagcttggtgaacatgatggagggaagaggtctgaattctgtggtgcaggtgggagagtctgtgattaagataacaatcaaagtattgaactaggagaaaagagggaagaggtttaatagaaccctccaccaatcatgcttccttcaggaacacaaaattggacaactattcacacccaaaaagcacctttaaaagaaccaaaaatcacagtacctggttttaaatttatatcactgaaagaggcactgaagaggatataaaagacaatattgaattcctgatgccaccccttcctcattccatggcagtacatcccaccatcgctgcactctccctcccctaaacacacttgggaaagggagagtgcagtgatagtgggactttgcattgaaactcagtgctgccctgtcacagaggaaagcaacactaggcagaactcaactggcacctacagagggagcatttagaccagccctaaccagagaaaaatcattcaccccagtggtcagaacttgagttccagcaagcctcatcactgcagactaaagtgctctacagatctcaataaacttgaaggcagtctaggctaaaaggactacaattcctgggcaagttctggtgctttgttgggccaaaagtcagtggacttgagatgcatatgacctagtaagacaccagccagggcagccaaaggagtgcgagtaccgcccctccaccaaccccaggcagcacagctcacagctctgggaaagactccttacttctgcttgagatgagaataaggaagagtaaagactttgcaagtccaagttcaggacttgcaacttggatactagctcagccacagtagacaagggcaccaggcaaagtcctgaggcccccattccaggccctagcacctgaatgacatttctagacacattctgggccagaagaaaaggacccaatcttgggtaattcatcacatgctgactaaagagcactttgaccctgaataatcagcagtaggacccaggcactactcactgtgagctttgggtaagactcagagacatgctggcttcaggtgtgacccagcatattgccagctgaagtggctatggggaaggaccccttacgcttgagaaaaggaaagggaagagtaaaggagactttgtcttacagtttaggaaccagctccgtcacagtggcacagtgggatagagcatcatgctggctcttgtggttctcaattccaggtgttgactcttgcacggcatttctggaccagcactggccagagagaagttcactgccctgaagggagagttctaggctggctgtatccaccacaagttgaacgaagagcccttgggtcttgaaggaacaatggtggtagccaggcagtactcactgcagacttggggcagtggtaaccatgaggagagactcctctgctggtggaaaggagagggaagattcaggaggactttcccttgtggcttgggtgccagcttagctacagtagaatagagaatcaggtagattattaaggtttccaactctaggccctggctccaggacagcatctctaacctgggggggatctttctgccctaacaggaagaacacaaacttggctggctttaccacctgctgattgtagagccctaaggccttgagtgaacacaagtggtatccaggcactggttaccgcaggccttcggcaagacccagtgctgtgctggcttcaggtctcacacagcacaatcccaataatggtggccacagggatgcttatgtcacccctcttccagctccaggcagctcagcattgagagagagactctgtttgtctgggagaaagtaagggaagagaagaagagtctctgcctggtaatccagagaattcttccagatcttatccaagaccaacaaggtgatagctctctgagtctgcaagcgtcacagcttgggcttgggttaccctctaatgcagatatggctgcaaggaccaaaaacttataacactaacatcttttcaaatacctggaaaaccttcccaagaaagacgggtacaaacaagcccagactatgaggactacaataaacacctaactcttcaatgacaagactggacgaatacccacaagcattaagaccatccagaaaaacatgacctcaccaaatgaattaaataaggcaccagggttatatccaggggagagagagctatgtgactattcagacaaagaattcaaaacatctgatttaaggaaagtcaatgaaattcaagatagcacagagaaggaatttagaatactgtctaattaatttaacaaagagactgaaataattaaaaagaatcaagaagaaattctggagctgaaaaatgcagttgacacactgaagaatacattatagtctcttaacagcagcattgatcaagcagaagaaagaattagtgaccttggagacagacttattgggaaatacacaaaggagacaaaagaaaaaagaatcgaaaagaatgaagcatgcctacaaggtctggaaaatagcctcaaaagccaaaagcacaaacctaagagtcattggccttaaagaagaggtagagagaaagagagataggggtagcaagtttatccaaagggataataacacagaactttccaaacctaaagaaagatatcaatattcaagtacaagaaggttacagaacaccaagcagatgtaaccaagataaggtgaccaagacatttactaatcaaactcccaaacgtcagggataaggaaaggattctaaaagcatcaagaggaaagaaataacatataatggagctccaatacgtctgctggcaaacttctcagtggaaactttataggccagaagagtgtgaaatgacatatttaaagtgcttacagaaaaaaacttcttatcctagaatagtatatccagtgaaaatatccttcaaataggaaggagaaataaaggagaaataaactatacaaacacatggaaattagacaataagctcctaaatgactagtgggccaatgaagaattatgaaggaaatttaaaaatttattgaaacaaataatatttttagaggaataattttattgtagaagagtcttatgtaagcataagagcaaagaaagatcccaccaaataaataagcattatatatgattacataaaacataacatttcaaaatacatgcacacacacacatcacaatatacatgacagagaaaagactaatatctttactatatgaggatattttataaataataaaaaaggtaaatacatcaatagatcaatagaaaacctggcaaaagatataaacaggcaactcactgaagaagagctagaaataatatatggtaaaatggatggcaaatatatgaaataattttaaaaccttatttgtgatcaaatgaaaatttcaataattccaacacatttatcatatgatatatatacacacaatttccacatttatcttataaaactggccaacatttttatttttaatgaatatgcccagcacttaataaaaatgtaggaaaatgaacattcatgccagctcatggaaatataaattggactaaccattctaatccacaatttgacaataaatataaaagccttaaaatgtattctgtatgaagtaggatatacgttaggatatcagattctcctagggataataccaagggtttgaggagatgatattcactacagcatcatatgtaactgaaaaaaaaggatagggcaatctaagtatccagtagccaaaatgtccaaaccaatcatgaaatatgtgcacaggattggaataatatgaagatgacacaaattaagtagtagacaaacacagtgaactatggaaacaattgacagtgtatttctaagggaaaaagtatcaaaaagtacatgctatcattcatttagccaacacatcgagtgctgaacttaattatataaataataacagcttatgtgtatatgtaaagaaaatacagaacagacataaggataataatattacctttaagtgttgaatattataatgaagatgatggaaatcatccatcatctcactattgttcactgtaataaacgtgtaagactttggaaatcagaaagtaacaagttataaggaagttataaggtgtcatgctttaccatatcttacttttttaaacatgccatgctctttcaatatgtcatgctatattgtcatgcttttccccataagttataatatgtcatgctttttattttgcaaaatcccttctcctaagagtttaataataatgataccaatgggatggcaaaatggttccagctgcttttttttccttttatttattttatttatttatttattttattattattatactttaagttttaggatacatgtacacaatgtgcaggttagttacatatgtatagatgtgccatgctggtgtgctgcacccattaactcgtcattcagcattaggtatatctcctaatgctatccctcccccctccccccaccccacaacaggccctggtgtgtgatgttccccttcttgtgtccatgtgttctcattgttcaattcccacctatgagtgagaatatgcggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacattcgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaatagtgtaaaagtgttcctatttctccacatcctctccagcacctgttgtttcctgacttcttaatgatcgccattctaactggtgtgagatggtatctcattgtggttttgatttgcacttctctgatggccagtgatggcgagcattttttcatgtgttttttggctgcataaatgtcttcttttgagaagtgtctgttcacgtcctttgcccaccttttgatggggttgtttttttcttgtaaatttgtttgagttcattgtagattctggatattagccctttgtcagatgagtaggttgcgaaaattttctcccattttgtgggttgcctgttcactctgatggtagtattgaaacaaataataaaagaaaaacaatacaccaaaacctcttggatacagcaaaagcagtactaaaaaatttttccccattcagtgcaatactagctgttggttggttatgacttttattgtattgaggtatattccttaatacctagatttttgagggtttttaacatgaagtgatgttgaactttatcaaatgcttattcagcatcaattgaaatgatcatatagtttttatccttcattctgttcatacgatgtgtcacattgattcatttgcctatgttgaactatctttacatcctggggataaatcccacttggtcatgatgaatgatcaagtttataagatctggaacatgacatcaatgcccactttcaccactgttattcaacacaactggaagtcctagccaaagcaatcagacaagaaaaagaaataaagggaatccaaattaggggggaataagtcaaattttttggttgcagatgatctgatatttggaaaaacctcaagactttaccaaaacactattagaaatgataaatttcagtaaagttgaagaatacaaaattaacattcaatgatcagtagtgtttctatatgccaacagcaaacaatctgaaaaagaaatctagaaagtaatcccatttacaacagctacagataaaatgaaatccacagaaattgtgtatttcacaaaaatgtgaaagatatctacaatgaaataaaatacataaaaatatgtattttacaaaaatatctacaatgaaaataataaaatactgatggaagaaattgaagagaacacaaaaaatggaaagatatttcatgtgcatgggctggaagaatcaatatggttaaaatgtccatactacacaaagcaatctacagattcaatgtaatccctgtcaaaataccaatgacattcttcacaaaaataggaaaaacaatcctaaaatttatatggaaccacaaaagatccaaaatagccaaagctataccaagcaaaaagaacaaaagtaaaagaatcacattatctgacttcaaattatactatagagttataataaccaaacagcatggtactggtataaaaacagacacatacaccaacagaacagaatagagaacccagaaacaaatccatacatctacagtaaacttttgacaaagatgtcaagaacataccttaggggaaagtacagtctcttcaataaatggtgctggaacaactggatatccatatacagaagaatgaaactagacccctattgctcatcatatacaaaaatcaaataacaatggattaaagactaaaatctaagagctcaaactgtgaaactactacaagaaaacactggggaaattcttcaggacattggactgggcaaagacttcttgagtaataccctataagcacaggcaaccaaagcaaaaatgaagaaataggatcacatcaagttaaaaagcttctgcacagcaaaggaaacaatcaacaaagtgaagagataacccaaagaatgggagaaaatatttgcaaactatctatctgacaagggattaataaccagaatacagaaggagctcaaacaactctctaggaagaaatctaataatccaattaaaaaatgggcaaaagatctgaatagacacttctcaaaagaagacatgccaatggcaaacatgtatatgaaaaagattctcaatatcattgaccatcagagaaatgcaaatcaaaagtactatgagatatcatgtcaccccagttaaaatgtcttttagccaaaagtcaggcaatagtagatgtttgcaaggatgtgaaaaaaagggaacacttgcacactgtttttaggaatgtaaattagtataaccactagggagaacaatttgggggctcctcaaaaaactaaaaatagaactaccatacgatttagcaatgccactgtgagttatatacccaaaagaaaggaaatcagtatttcaaagagatatctgcactctcatgtttattgcagcactattcgcaatagccatggtttggaagccctcaacagacaaatggataaagaaaatggggtacatctacacaaggagatactattcagccataagaaatgagatcctgtcatctgcaacaaaaatggatgcaaaggaggtcgttatattaggtgaaataagccaggaatggaaagacaaacttctcatgttcttacttatttgtgggagctaaaaattaaaacaattgtactaattgatatagagagtagaacaatgatcaccagagactgggaagaatagtaggagcagggggaaggggagtagttaatgggtacaaaaatataattagatagaatgaataagatctagtatttgatggcagggcatggtggctcaggcctgtagtcccagaactttgggaggctgaagtgggcgaatcattgagcacaggagttcgagaccagcctgggccacatgggaaaaccccatctctactaaaaaaaatagaaaaattagccgggtatggtggcatgtgcctgtagtcccagctacttagggggagtaccgcttgagcccaggaggcagaggttgcagtgagctgagatagtgccactgtgctccagcctgggtgacagagcgagaccctgtctcaaaaaatacatatatatccagtatttgacagcacaatagagtgactacagtcaacaataatttattatacattaaaaaataactaagaggataattggattgttcgtaacaaagaaatgataaatgcttgaagagatggataccccatttaccctgatgtgattattatgcattgtatgcatgtatcaaaatatttcatgtaccccttaaatgtgtacacttgctacgtaaccacaaaaattaaaaattaaaaaaaaaatcacagagtattggattaggccaaaagtgtgcatacagagtttgtgcttattgtgcatagagtttccttctttattaatgaagctttctgtttttcctttctttagagttatcaatataccctaagtaatttatttgtaaccgcatagtttgttggtaaaaagttccctacaattttccttattttcaaatattaccaatggcagtaagttaacacattcatgggagcaaagctacaaaaatgttaagtctggccatatagaaaaccctggcttgatgtgtgtttagtgcttaaaaatccccaaatatatgagatacattattacatatcatctgaccaacaattttgtagagcaaatattgcaaatcctgaatattataatactcattatatgcatgtagataagtataaaaactgaagctcacagaggttactgctcaccaattagggcaagtacagttgctgaagtcccagcctgcagactcaagaccctactgctctttctaatgcatgatgctgattctcttgaaggtaagtttggaatcttcagaggtatgtgttaggcatgggtagatataaggattctctgataaaacctctggtagagacatcctgtgaaatgtctgtggtctttgtctctgggtaatatctgtctaatcctctcttgagctcagggagttgcaatggcttaaggctggaagcaccaagtcactgagcagagaaacatccaggaacaggcatgcatgtatgatgcagaatggctgggaatcattccatcatgtgacaccactttacgatatcttcctttgttatgtgttcctgaaaaatactttagaaacatatcctcttcactaaagacatttcagtaattgactccttaattcaataaatgaaagcatcattattttgaggtctaagaatgggtacgagcatggggagggcaaagtgtcatttctggttgaatttcctgagaataagaacaccggactttaaacaatatgatatgactttttccccgaaactgaagttatttctatcctatttaatgtcacatatattttaactattatgtaaaaaacattgtgttagatgtcaaaggatataaagatgactgagatcatttcttccctcaaggaatcgccaatccaatgaaaagatgaaactcatctttctagaatacattttcccgtgtttatctttgaaagagtacactgaatattatacaacttcttcttgatgactgagggacatcattccaagccagctgatgttctgggccacaacaataagcacagctgcagctagaaatgagtgtgacaggagctcagggctactggtcataggagttaaccaagaactgccttctgccatctcaaattgggtggatgaggggctggatagataacagatataaataccctgatgtcatgattgctttttggtcttttccctttttcctcccatcctatatatgaaccaaagacctgcttcatgactaatgtgctttgaaccagcacaaaaccgccattagccatcagtgaggtatacaggtagcaacagctgaagacctttcctgtcgggcaccctgcagagtgtccaggtctgacctaaatgttactccttattgctgggcctcctctaacgtcagtgtcagctacccacctcctttcatcacttgaatttctaaaccaactggcatcaccccttctaagctctgccagttattctgctattcagaactctccgttctcaaattacaatgtgtataaaatgtccagcacagtgcctgacacagagcaggcactcagtaagtgctagagcccctttccttgtattttatagtctaatctttgatctgacatttttcctgtctctgtgtctttttacgatcaggtggatatacataggtacttctttatggttagcaaaccaaaaaatcacaatccattactttctatttgtatgtatctgtgaatgaagctttttttccttttacccctgcataagatacttcttaggttatctacaccttaataactcatttgcaactgtatagatagcttaaaggttcttttttattttcataaattttctccacccagtggttataatttaataaagtagtcactgtggctgtatttatattttgtaagtaatttatgttttggtacaatgaataattctggatgtgagttatgtgactgtgaatatacagtttgagctttctagaatctcttcactaccattctgatgctgcctcctctcatctaatgacaacaacctcatagaagagataaaagtctaagattcaaatctaaaaggcaaagcaattataaagtatagcacatgtagcatctaattatttttccacatataatgtcacacatgcaattggaaaaatgttcttttgttatttgtaacataaaccatgtcattttattttattttcacttccttgcagactctcattaaagcttgcacacatattattattccattgaaaagtaataacttcattattatggcataacaattaatgtaaggtgtatcaacacaaatatttaaaaggaccattacaaaagtaagaaaaacattaatctactactagggacttacttcattcatgtaagaaatttttccatcttctgtccatctggagaagagcaagataaattaatctttggttccaaacatttttagagttgttttatcaggaaataacttcctattttcccaagttttgaaattttgcaccttctcataagtataaaagaatctcagcatttcactttgacccatttcaaatttatatggcagatttccaaatgctgggaattgcaaagtgcctgttcttagcacatgatatctaccatctgccctggccatcaggatagggtccagatagttctccaacataatattgtaaagtcaaagtgctcttggcatttatgtaatatttttgcaacattttgcaggtgataaataaattgtaactttttcaaactgggactcatctaattacatgcatgggagcacttttcttgtgctgtgtattcaactgtgtatgcttgtacctgctcattcatcctccacacccaccccacacaatctgtccaactgagatttgatcatgtgaatgctgagaaaggctaaaggtttggtacccattcaaaatgatatttttaaagtacttattcaacatttattagatggagttggggaaaacttattttccattaagaaaagtatgtctctctttatgcttagttaacgaacaggattagttcacgcactaaatgaacatatcacttttatttgggtcagtctttcatttcacaattttgtggtttctcattaagggacagcattagttattcatattcaggagggcagaggtaactctcacagatatggttacaaagttacaaaatagatttcaaagttcttttatttactttcatgttgttaaaacatttcccatagttttttttttttttcagttcagttttatgacttaccgatccaggaaaatgcttggaaagcacagtaacaacttttaaacttaatattaaaaacaaataaaattgctcattgccaataaatatacctatgtaaaatactactcagtgtaagaatttcaactgacagtgacctgtcaaattcaggcaattctaaaataggatggtggtggttacactgtgcaaaatattcaatagagagagttcaggaatgccaataattttttgttattattatcaaaacattcaataaagatagttcaataatggcagcaactcttactgttatctccctcctatcccaccttgggggccttgtaataaattttgcttgcaaattgcctaagtgttatatgtggaaagctaagttaacaggtgtcatgtttcccatttataccactgatgttccaatgcaaggtgcccggggaaactgccatcccttaatccagctctgctcacccagacatacacatatacccatcaatccatctgttaggcattaagaattacaatagtataaagaacaatcctttggtgtacatatttaaatgttaaatatatactgaagggtttgaagcaaggatctggcaaacacgactgcatcacacatttggttcagccctgtctggatgtcagaatgcatccgtcattttggatttatgtataatgacagaaatcaagtcacgacccatgtagtctcaaaaggctacttagatgatgatgaagatccacaatactccctgaagtactgctgattcttcaactccattaagaatatacatctctgacattttaaatatcttaagtcagtgattttggccatctaggaaaaacaatgttgcagcatgtaatttaggtaatttcaacagagccagttcaatcttaaatcattatttctaatgcattctggcaatactttttttgtaaagtgaaattatacaacacttccagaaaccacagaatgtgacttaacaaccaattacttgtacagtttgcaaaacaagtaaacctcccagcagctgggagcttggctgagaggcctaggcttgcccttggcatggtaccttgctcttttctatgagttcacattgctttctagcctgctaatgcactggccttatgaacacagattccctaaatgctctccaagagtctgatatcacattcagggttaacacattttttcccttgttgcaattcagcagttttttacagtcattcatatccaaccaattgctgtcaacaggcatcttcacatatgaatgttaatagcatattattaaagagttcctggtaatttgttttgtgggtagagttgatgaggggtgactataggaagggaagccaaaggaaaaacatttcaactactctggaagctgacctctggaaagcagtcagagagaacagatgaaggagccaggcaagctctttttgaataagatggtgtgtattacagctaggaagagccaacagagtagatctcacagtgaccagcccagctaacagcagttgaaattgttagtcatgaaaatacagatgccccctgtatggattaccctcatattttctcagtcactagtttgagagtatcatatttgagagacagagtttttcttgataattgagaaagatcaaaaagggaactgaattttcattggcaaaaagactacataaatagaagcaacatctttgttggtgcctacttgtcatcagctagaaaggtccgattttttttgcaaaaaccttaggaacaggattcagggtaccttccaaaagcgaaaagtaaaggcagacttcagggctcctagaaagtttacatccaagaattccctataatgtaaacttgaaaattaatgctttttcctccacaagaacttgtttcaaaaagttagtctggtaactcattctcataaattgttcttagtatttttcttgcagattttcatgatatggttcccaaaataaatcagtagcaagcattatgatctgtgccttccacttcagcatagtactttgctccataaacataatataatgaacatttatgtatcactacctttcttacttttctttactcacttcatcatatcaacaaaatgtatttgatacacagttgcaaataaatattaagctttacattttgtaataaatatttctgagtaataaaaatgttccaactgatcaaaaaatttgatatttgatgatggcatttgaagagatgcatgtttattagctcaatttagccatttcacattgtatacatttttttaaaacgttgtacatgataaacacatacaatttttatcaattataaaaaattttgagtgttatatttgagtgataacaaatttagatgagttaacagaatacatacatacctccttaataaattttattgtttactagtccatcttcaaaagttcatcatattaactacagtcagaaattggttcccaaagttcattatatttattacagtcaaaaacagtttctaggaagtctattgtatttatacaattaaaaatgactcaactattgggtacaaggtttcttttaggatggtgaaaatgttctaaaatgatggttgtacaacctgaacgtaaatgaaaaaattatgtactgctgaactgtacactttaaatgagtgaattttatggtatgtaaattatatcccaataaagctatttttaaaatgggtcaatcaaggacactaagagttgtttatttgaaaagttcaaaaaaattgacaaaccattagctagatcaagaaaaaactcaaatcaaatcagaaatgaaagaggagggattataactgatgccacagaaattaaaaggataagaggctactatgaaaaattatatgccaacaaattagataatccaaaagaaatggattaattcctagaaacatacaacctaccaagactgaaccataaatagaaggtcttaacagacctataagtagtaagaagattaaatctactaaaataccaaaaattagccgggcatggtggtaggtgcctgtagtcccagctactcgggaggctgaggcacaataatcgcttgagccccggaggcggaggttgcagtgagccgccgagatcatgccactgcattccagcttgggctacaaaataagactctctcaaaaaaaaaataaataaataaataaaggaggtatatctcattttacccatttcattccacaataatgaaaaataaaagtgtcagctgtcctaggaatgcagaatataaaaggtggggcaacagggcatgtggtgctttccttagtttactttgacaataaaaactcctatctctgttgctgctggaatagcatttattggaaatcagcctctcaacagtcctcacccatcaggaacaggaatctgccattagcttgacagcatacagagcaccatatcagggttactatgggaagactctattgtggcatcagaaacacaaaaaacactggatacagttagtttctgttgacagtttcagaagaaaatcccacagattggacaggctgcctgctgaaagggttgtcactacacacagcatgccctgaaccctggaatgaagttacccctatctgtgtgatcaggaactgaacaactctgaggctctttttctaagctcttagattcctgcaagaacctcacacttacctcctcacctggctttggacctcaagctaaaagtgcaaacagtctgcctactttccccataaacatttccccaaaataaagggcttttttttttttttttagcacttgcttacttgtgttctcactttctctgtcttcctctccctccctccttctctccctgctcactgtcatcagctgggtcccaatccagtttctacacctacattcatgactaatgacccaccagcagcccctaagagccactaggctgtaatgaacattttcctaccagttacatgtggtaggtctgggaggagccccccatttccaatgagggtatgttaaatacagttagaatgatgcgggatgtggactctggagccttgctacatacaaaatgtggtctgaggaccagcaacaaggcatcatgtgagaacttgctaagtatgcagaaccttagaccccaccccagaactactgaatcagaacatgcattttaacaagatctcttggtgatctgaatgtacattaaagtttgaggagccttggtataaaatttgaatatattttgagagaagactgtggaatttggtgggggatggggaagtggtaggattcttatgtacagggctatttacagagaaaacaaataacattcattaaatactgaataatttactttctttaaaataagaggaataaataaatccaattactatatgtatagggccttgagacatcagtgagcttaaggaatcttcagcagtaaggcttaaatacctattcttattctttgtattttaataaatctgtttgcataagagctttaaattgtatcagtgacaagtaggtatgttttcataatggaataatagtgagcaataacgccccccaaaagaggcggagcaaggcataagtaaacaaaatgtatgtgtgtcgcatacatttcaacaggtgaatccagcatggcatgatggaaacttaagttccggggcccacacaggccccttccaaggaccaggaactaactttgcattcaaaattttgttctctcttcttacagacagcctcaaaaattacataatcttaaaacttcacaaaacctggaaccatgcctgatctaattaatcatgaaaactcttcttaagtttattattattattataatactttaagttctgggatacatgtgcatagaacgtgcagttttgttacataggtatacacgtgctatggtggtttgctgcacccatcaatccgtcatatgcatcaggcatttctcctaatgctatccctcccctagcccctcaccccccgacaggccctggtgtgtgatgttcccctccctgtgtccatgtgttctctttgttcaactcccacttatgagtgaggacatgcggtgttcagttttctgttcctgtgttagtttgctgagaatgatggtttccagctacatccatgtccctgcaaagtacatgaactcgtcctttttttgtggctgcatagtattccagggtgtatatgtgccacattttctttatccagtctatcactgataggcatttgggttggttccaagcctttgctattgtgaacagtgctgcaataaacatacgtgtgcttgtgtctttaagtttgacattatatatatatatctatatagatagatatctatagatctatagatatctatctatctagatatctatatagatagatatctatctatctatctatctatctatctatatatatatatatatattttttttttttttttaggacggagtcttactctgttgcccaggctggagtgcagtggtgtgatctcggctcactggaacctctaactcctgggttcaagcaatcctcccacctcagcctcccaagtagctgggagtacaggtgccgccaccacacctggttaatttttgtatttttagtagagatggggtttcgccatgttggccaggctggtctaaaactcctgatctcaggtgatcctcccgcctcagcctcccaaagtgctggggttacagacacgagccaccatacccagccgacatataatatttttaaatcctttcaatacactgggaaacatttagaattatatcactatcattcaaactacaaatgaaaataacaatttaattgacacatgacctaggaataattctgctcatgtgtaagaaaaactgtttgtaatgatatggttcatatcttactcttctttccatgttatcatttaacatgattaaatttaacaaatatatcgtttgttgacatttctctctcttcccttcttcttttcctcctattttaacttaaaaacctaactactgcagaggtggggaggtactagaggaaatatccaaaaatgttcctcaggaatttttgtttaattttgttttattattttcctcaggtttgaaactcatatctacttacattttttaaagaatgcaaaaggtaaaacaagtaaacacacacacacacatatacatacatacacatattaaaaagataaattctggtgacattttagtgactagtatttcaaactatttaggtaagatgttaacagtgtggttttgagagttacatgtgagtgtatgtatgaacatatacataactgtatgagagagagatctagaaattgctgtcctgcccaccaaaccactgatacacctttttcatacagttaaagtagctgtgcctcatcatgagctagaatgtattccgtatgtatggttatcaatataaacaatctgccaatgctgggcattccgtgtgtttctgattttcattttataaatgaagctgctatggatatccttatgcacgctccctcttgctctttccttattttgtcctgaggacaaatccctgttatgaaaattgcgggataaaactttggaacacaataccagtgtgccttctgaagagtttcatcaatttacagtacaatcaaaagacaatttcacttttaaaacatcatttgctaatttgagagacaaaaaagtctgtttttgtttatatgcttactttttaaacttttaaagtaaaatacacatacagaatagcacacagcttgatgagttgctgttaatttattcctttttatggctgcatagtattccatggtttatatataccacggtttctttatccacttgttgactgacaggtatttgggctggttccacaatttcgcaattgtgaattgtgccactataaacatgcatgtgcaagtgtctttttcaaataatgacttcttttcctctgggtagatacccagtagtgggattgctggatcaaatggtagttctacttctagttctttaaggaatctccacactgttttccatagcagctatgctagtttacattcccacaagaagtgtagaagtgttccctgttcactgcatccacgtcaacatctactggtttgttgttgttgttgttgttgttgttatggccattcttgcaggaatgagctggtatcccattgtggttttgatttacattcccctgctcattagtgatgttaggcattttttcatgtttcttggccatttgtatatcttcttttgagaattgtctattcatgtccttagcccactttttgatgggactgattttttcttattgttgagttcgttgtagattctggacatttgtcagaatgtatagactgtgaagtcctttgtcagatgtatagactgtgaagattttctcccactctgtggtttgtgtgtttactttgctaactgttccttttgtcatgcaaaagctcttcagtttaattaggtcccagctatttatctttgtttttattgatttgcttttgagttttggtcatgaaatccttgcctaaaccaatgtctagaagggtttttccaatgttatcttgtagaatttttatagtttcaggtatcaggtttaagtccttagtccatcttgagttttgtataaggtgagagatgaggaaccagtttcattctcctacatgtggctagccaattatcccagcaccatttgttgaaaagggtgtcctttccccactttatgtttttgtttgccttgtcaaagatcagttggctgttaagtatttgggtttatttctgggttctctattctgtttcattggtctatgtgcctatttttgtaccagtacaacactgttttggtgactatggccttatagtttgaaatcagatagtgtgatgcctccagatttgttctttttgcttagtcttgatttggttatgagggctctttttttggttccatatgaattctagaattgttttttctaattctgtgaagaatgatggtggtattttgatgggaattgcattgaatttgtagattgcttttggcagtatggtcattattcacaacattgattctactcatccatgaacatggaatgtgtttccatttgttcgtgtcatctattatttctttcagccatgttttgtagttttccttgtagaagtctttcaactccttggttaggtatagtcctaaattttttttttttttttttttgcagctattgtaaaagtggttgagttcttgatttgattttctagccactgttggtgtatggaagaactactgatttgtgtatattaatcttgtatctggaaacttcgctggattcttttatcagttctagaacctttctggaggagtccttagggttttcaaggtaaacaatcatatcatcagcaaacagtgacagtttgacttcttctttactgatttggatgccctttatttctttctcttgtctgattgctctggctaggacttccagtactatgttgaagagtggtggtgagagtgggcatccttgtcttgttctcatcttgtcagattctcagagagaatgctttcaagttttccccattcagtgttatgttggctgtgggtacgtcttagatggcttttattacattaaggtatgccccttgtatgctgattttgctgagaattctaatcataaaggggtgctggatttttttcaaatgcttttttttgcatctatttaaatgatcatgtaatttttgtcttaaattatgtttatgtggtgtatcacatttattgacttgtgtatgttaaaccatccctgcatccctggtatgaaacccacttgatgatggtggattatcttttcgatatgttgttggattcagttagctggtattttgttaaggattttggcatctatgttcatcaaggatatcggtctgtagttttcttttttggctatattctttcttggttttggtattagggtgatgctggcttcacagaatgaattagggagggttccttctttctctatcttgtgaaatagtgtcaaaaggattgggtatcaattcttctttgaatgcctggtagaattctgctgtgaatcgctctggtcctgggcttttttgttgttggtaatcttttaattacaatttgaatctcactgcttgctattggtctgttcagggtatctaactcttcctgatttaagctaggagggttgtatttttccaggaatttatccatctcttctaattttctagtttatgtgtgtaaaggtgttcacagtagccttgaatgatcttttgtatttctgtggtgtcagttgtaatatctcctgtttcctttcttagtgaggttatttggattttctctcttttcttgattaatcttgccaatggtctatcaactttatttatcttttcaaagaaccggcttttttttcctttatcttttatatttttttggtttctatttcatttaattctgctctgatcttggttatttcctttcttctgctgggtttgagcttggtttgttcttgtttctctagttccttaaagtatgaccttagaatgtcagtttgtgctctttcagtctttttgatgtaggggttttgggttatgctttccttttagcactgcttttgctgtatcccaaaggttttgataggttgtgtcattactgtcgttcagtttgaagaatttttaaatttccatcttgattttgtttctgacccaatgctcattcaggagctggttatttaatttccatgtatttgcatggttttgaaggttccttttggagttgatttccagttttattccactgtggtctgacagagtgcttgatataatttcgattttcttaaatttattaaggctcattttatggcctatcatatggtttaccttgaagaaagttccatgcactgttgaatagaatgtgtattctgcggttgtcggatgaacttttctgtatatatctgttaagtccatttattccaaggtatagtttaaatccattgtttctttgttgactttctgtcttgatgacctgcctagtgctgtcagtggagtattgaagtcccacactattattgtgttgttgtctatctcatttcttaggtctattagtcatagttttataaacttgggagctccagtgttaggtgcatgtatgtttaggattgtgatattttcctgttgaacaaggacttttaccattatataacatctctgtctcttttaactgttgttgctttaaagtttgttttgtcttatgtaagaattgctaccccagctcgtttttggtgtccatttgcatgaaatgcctttttccactcctttacttaagtttatgtgagtccttatgtgcgaggtgagtctcctgaaggcagcagatggttggtgagttcttatccattctgtggttctttcaagtggagcatttaggccatttatattcaatgttagtattgagatgtgaggtaccattgaattcatcatgctatctgttgcctgtgtactttgtttcgttttgtttttttgctttttaacttgtatttttgttttataggtcctgtgtgatttatgctttaaagaggtcctgttttgatgtgtttccagaatttgtttcaagatttagaggtccttttagcagttcctgtagtggtggtttggtaatggcaaattatttcagcatttgtttgtctgaaaaagactgtatctttccttcatatataatgcttagtttcactggatataaaattcttggctgataattgttttgtttgagaaggctgaagatagggtcccaatcccgtctagcttgtaaggtttctgctgagaaatctgctgttaatctgataggttttcctttataggttacctggtgctcctgtctcacagctcttaagattcgttccttcatcttaactttggataacctgatgacaatgtgcctagatgaatatctgtttgcaataaatttcctgggtgttctttgtgcttcttgtttttggatgtgtaggtctctagcaaggccagggaagtcttcttcaattattcccccgaatatgttttccaagatcttagaattctcttcttcctcaggaagaccaattattctcaggtttggtcatttaacataaccccagacttcttggatgctctgttcctattttcttattcttttttctttgtctttgttggattgggttaattcgaagaccctgtcttcgagctgtgagtttctttcttctacttgttcaattctattgctgagactttccagagcaaaaatgtgtccaaagcttcctgaatctttgattttgttttcctttaagctatctagttccttgaatattcctcccttcacttcttctatcatgttttggatttccttgcattgggcttcacctttctctggtccctccctaattagctttataactaacctcctgaattctttttcaggtaagtcagggatttctttttggtttggatccattgctggtgaactggtgtgatatttttggggggtgtcgaagagccttgttttgtcatattaccagggttgtttttctggttccttctcatttgggtaggctctgtcagagggaaggtctagggctgaaggccattgttcagattcttttgtctcatgtggtgttcccttgatgtagtactctcccccttttcctatggatgtggcttcctgtgagccaaactgcagtaactgttgtctgtcttctgagtctagccacccagcaagtctacctggctccaggctggtaatgggggttgtctgcacagagtcctgtgatgtgaaccatctatgggtctctcagctgggataccagtgcctgttctggtggaggtggcagggatggggatcagggatgcaatggactccatgagggtccttagctttggtggtttaatggtctatttttgtgctggttagcctcctgccaggaggtagcactttccagagagcgtcagctgtggtagtatgggaaggaatgggtggtggggtggggtcctagaattcctaagattatatgccctttatcttccgctactagggtgggtagggaaggaccattaggtcggggcagggctaggcatgtctgagctcagactttccttgggagggtcttgctgaggctactttcagggatgggggtgagactcccaggtcactggagttgtctacctagaaggattatggctgcctctgctgagtcattgcaggttgtcacggaagtggggaaagtcagtagtcacaggccttacccagctcccacacaaaccgaagggccagtctcactgccaccatgcccccctcaacagccccacgtctgtttccaggcagagagcaatacgagtctgaaaacctgccccaggatacctgcctccaactacgaaagaaaagggtttggttttttgcctgcctgtggagtctgcacaccggatttgcgccctcctttgaattctggccaggaggcttctcatcccgttcaaattgttacaaagttcagctagagatgtccttctccctgtgtggttttaccccctgctcctctcctgttggatccccatggtgccaggcaggaatggcctgctaggggacccagtgagttcccagggcccttctcactgtttcctctactcctgtattttgctcagctctccaaactgactcagctccaggtaaactcggaaacttcttccacgaacagaccttcagcttctccagtgggagtgtgtgttcgggagaggatggtctcactttcacggttggggcactcaacagttttgcggggtggtatcccgggtccacttccttcagagggtgtgtgggtcctcttgggatggctggtttgctcttgcggtcgatctggagctaaaattcacagtgtgagtccccgcacactgctctgtccagagatgcaatctagtcctgcctcccatctgccatgatgatcccgctcctccttttcattgttgaacactattctatgatatgtgtatatcataatttgtttaaccatttgcccattgaaagacatcagggttttttccaatttttgagtattgtaaataaagctgctatgaatatttgtgtacaaatttttgtgtaaatgtaagtattcatttctccaagataaatgcccaggaatgccattattggtctgtatgatagttgcgtgtttagttctttatgaaactgtcaaatcatttttcagggtggctgtaccattttacattcccaccagcaatgtagggatttagttcctctgcatcttgctagcatttgatgttgtcagtagtttttattttacttattctgattcatatatagtgatactcattgtgattttaacttgcattcttgtaatgactaatgatgttcagcatctcttaataggcttattggccatctctatatactcttcagtaaaatatttctttgtgtctttttcctattttttaactgaattgttttttactgttgacttttgagagttctttatatattctagggtactagtcctttctcagatatctgctttgcaaatattttctccgaatccatagcttatattttcatctactcaccaaggtcttttgcagagcaaaatttttaattttaatgaagtgaaatttttccttgctttgatatgaagtctaagaactttttctatttttagataccaaagattttttcgtatttttccaatagttttatagttttgtgattcacattaagtccataatccatttcgaatttttacataaggtgtgctactgagaatgaagttcatttttttgcccatggatatcaaattgctccagaaccatttatttaaagagcatcttgtctctagtgaattgaatttgcacctctgtcaaaaatcatgcaaatatgcacttctgttcatatttgtgtgggtctttacctgtgttctctattttcttacagtgatatatctctatccatcaccaaccacagtcttgattactgtatctacataatctcataaaattgcctagactaagtccttccactttttaaaaattgttcaaaatattccagttcctttgccaatccacaaaggacttagaataattttgttgacatcctcaaaaaatattcttgggattttgataggaattgctaccaatatctacatatcagcttggggagaagtgacatcttccactccataaacatggtatgtctctttgtttacttaaatcctttttatttctttcatcagtattgtatagtattcagcatgcatttcttatacatgttttgttatatttatgcctaagtaactctttttagagcaattgtaaatggtatcatatttttcaatttctgtgtcaatgtgttcattgccagtatatcaaaatacaactggcttttatatgttcagcttgtatcttgcaaccttgctgagctaactccaggatttttttatagattctttgatatattctatatacacaatcatgccatctgcagataaaaactttttttcttctttctcagtctattgctttttgctccttttcttgccttttggcactctgttgaataagagtagtgagattgaatatccttgccttgttctcaatcttgaagagaaagcattcagcctttcacctttaactaaaatgttatttctaggatttttgtttttgtagactgtcatatatcgagtttaagaaatcccactattccttctttttttccaagaattttcatcataaataagtgttgaatttaatcaaatgatttttctgcatcaatcgatatgatcacgtggcttctttcctctaacctgttaatgtggtggattgcatagattgattttcaaatattgaaccagcattgcatctacaaaataaataccactaggttatggtaaacaattcttttatatactgctgaattctatttgctaatatttgctaagtatttttacttctctatttatgattgatactggtagacagttttcttttttgtactgtttttgtctggttctagtatcaaggaaatactagcttaataaaataaattggaaagcgttgcttcctttcctattttctggaagagactctgtagaattagtattaattattcttcaaacatgtgatagaattctccagtaaaacaaatagggcctggatatttctttggggggagttttaaaattataaatcatatttccttagtaattacagtactattcaaattacaaacataatattgggtgagttgtggtagcctgtgtttttcaaggaattggcccatttcttctaagttgtcaaattcatgtcagtgaattgctcacagtattatcttaatttccttttgatgtctgcagggtcttcagtgacatatacaatatatttggtgatacagtaatttatgtatcctcccttttttgtcagtcttgctagaagctaattgatctttcaaataaagagcactttattccactgattttctctactatttttctgttttcaatttctttgacttctgctcttatctttatctccctttttctgcttcaagtttaacttgttttgttttagttttttggggtgataaattattaattcaagattatttcctcatttttaatgtatgaatttagtcctataaatttccctctcatcactgctttatctacctacaaattttatgttgtgtttccattttcatttagttcaatatatttttatgtccccgatactctgacccacgcattgactaaaagtatattatttagtttcaaagtgttggaaattgtcctcttatatttctgttatctctagcttgatttatttggatcagagaacatactctatacggtttcaatggccttatattaagggtttttaaaatcactcaagctattatcttttttgggatatagtccacaggcatttgaaaaaatatatatattctgctgttattgggtggactgttttataaatgtaaatttgatcctattagttgatggttttgtgagatattctatatccttactgattttctgtataactgtcctatcaacttttgagaaaggggtgttgaactctccacatataattgtagatttgcctgtttctcctttctattctatcagttttcacttcacgtattttgtagctgttgtctcgtgcattaacatttagaattgcaatatcttcctagtagattgacctttgcatcattatattatgtccagctctgtctctgacaattttctttgttctaaagtctactttatctgatattaacatagccactcttgaattccattgattaatgtttgtatatcttttctgcccttttattttcaatgtgcatatgtcattatatctgatgtttcttgtagatagcatacagttggttcatgtttttaatcaccctgacagcctccgtcttgatcgttttagactatctgcatttaatgcaattattgatatgttagggcttcagtctgttatcttttgtttttttgttctgcttttcatctctgttttttcttgtgttccaagtaagttaatcattttagaattccattttgattcacctatagtgttttaaatgtatttcttatattttaatggttgctctggttattacatatatatgtataattcagacagtctattagtatcattttatcagtttgagtgaactatagaaaccctatctactttgaagtctctttgccttcccccacttaaaatatagttgtcttaaatatttcctctgcatttatttacaacctacatcagacagggttataatttttacttcaactaccaaatatatttattaaattcaaaaggagaaggaaagcttaatgtttacccatgtttacacatgcttttgtttactgtgttctttcttcctttctaatttcccagagtcccttcttttattgtttcttttctatttagagaactttttcaaatcgcatttctagggcaggtttaaggtgactaaatcccttcgtcttccttatcctgagatggtctttatttctccttcattcctgaaggataattccactgggtttagaattatgagttgataatttttctttcagcacttgaaaaatattgtgccactttattctgggtttcattgtttctcaggagaaacacgctgtccttctaattgatttttcctgtgtcattttttttctcactttcaagaatttttcttgaatatagttttcagaagtttaattataatgcatcttagtgtaaacttttttgtgtttattctgtttggggtttcctcagcttcttgaatctgtaggtttatatcttttccaaatttgagaaattttcagccattatatcttcaggtacttttccagcactgctctctttctccttccttctgggacttcgatgccgtgaatgttagatgttttgttataatcccacaggtctgtgaggtgctgttcattatttgcttatcattattctctttactctcatcattgagattggaatttctattgttatgtcttccagttattgatgccttcctttctccccttcactatgctgttgagtctatctgctgagcatcttatttcagtttctgtattctcagttgtaaaatgttcatttagttcctcttcatatttccttggtgagactttctatttctttgctgagctttctatttttgcatttatttcaagtgtaattgctagtttaagcatttctaccatagctgctttcaaatccttttcagataattctgacagtcatcccaatgttggcagctattgactgtctcttttcatacaatttgaggtcctcctggttctttgtataaagagagattttcaattgaaagctgaacatttttatattatgctctgagaccttgaaccttatttaaaccttctgttttcactggcttttcctgaccttgctcccataggggaaggaagaatgccatctcatattgccaggtataaaggtccaggttccccacttggccttcgctgacacccaagtgggaatttattttaactgctggatatggttggggtttctagatctctctgtggcctcctcagacactgatgtgagggtagcaccatgaccactaggcaatggtaaaagtcccaagtctccattaggtctccaatatcacagccccagcaagaaggggcaggggtacataatttttgttaggtagaagtggaaatctaccatctgatactgcagcatgaatgaggagaggggacaagtcgttaccaaccagcagggatgaaagtcctcgctccctactttgtctctgatattaccccacaggagaatagttatagcctctggaaagtgaaagaaagtctagcttctgcactcaggcttccctggcacgggtaagagtggggccacaattatttctgttgtttggcaaagagattagtgtctaaaagtgttctgtcttgctgcaatgtccctttttctacatttctggctagagagagtaggcttcactgggggctttttgtctgtgcccattggtattcccagcttgctagcttcttcagtgtcaagtcttggatatgtaagataagaagacaacacagggaacttaccaccaggttattcctctgggtctcatgtccttaaccagtctactt

SEQ ID NO: 1648 - DNA, 573452 bp, Homo sapiens
tttctttttctttttctttttttttttttttttttttttactaaaacagaaagactttcaggaaaatgtcatttaatgatttcagctatacattacatatacaactctgtagcctagcaacaatcattgctacaccatcattaactttaaatattttgcttggtgagctattctcaaatgtagcacattttaagattttgccatcattatgactgtggaatcattgtttggttttcataggaaacagatctgtcacagtatgaagctttgtttattttaagaaactggtacacaattacatttccacttacaagagaacgccacagatataactaaaggcaggcttcgatggctccacaaaggttgcgtgctggaccaaccccacacctcctgcttccccgtcgcaccgccctggccaggttcacatggtttcatttccagagatgctttgctcttcgcagttaggtagttttaattccttcaaaggcacacagcttccatcttttttccagcgtggctcccacacccgtgaattcctgtttgaacatgcgtggcagcctcatcaaaagcatttctatttcatttgcagatatctgttagaaaggaaggaaagtcactttggggaaaggaactcatcttaaaggaggaatggattggggaaggatgagctttcccagtgatatgaacagcatttagttttctactgggctgtcagggggatgtccttatagaaggaacattcagaagtactgaatgtgattatcccacctcccgagcagctggcggggtggggcgtgggttggctgggcggaaagtgccaagttcacccttcatatggatggctaccttactggcagcaccattcctgaacagccctcccctgatataaaaggagatggggagggaatttaagagggctcccagcaaatccatcaccactcctggaaagctactagtggcttcatcctcatctatgaaggacagcaattttctttaatgctgccaggagcagaagacattcgggtggatttcttgccacccaaatttctttctcttccttaattttcacatagaccagagaccataaagcttttggaatggaatctaaactccaaaacctacaacaatacaagtcttgatatctagtcataaaattcaggtatattttttaatgcaacttttttcttctccatatttttatttgatgaatttttacaccaataattcattttaaagaacaaatcagccataatccctctgctctagcacagtgattgcttttgttgtcctgtgttagcatgccaatccatgtgtatgcatgtggattttatacagcagggcggccaatttggggtctgatattctgtttgaatatccccaaaatttggggtctgatactctgtttgaatcctgtatcttcattctcacaagttaaatgacccttacagagataattagtctctttaagcctcagcaaatggaaataacatttaataaggatagcatgaaaattactggcttaccacagatatgggcacatagaaatgttcattgaatcagagctattacactttttcatggtgtaatcactgtagagatatcattttagagtctacactttccatttaacaatattaggattcatttaaaagagacaccaaatagaccaagaagtcaaatcaactgtttatttaatattctcatggaaaagacttcatatgacacattcaatattcctgggcctataatacaaaactttagttaaatagaggcagttctgaaaattgaaatacattgtattctaaaatttttgggaattgttttgaaatctgaatgcattttctgatacacaccatattagatggatggttaaattcccaggtcaaccgacaaaagcctatgagacagattatgtgaaggttcataataactttgagaagtaagttttctttcagtcaccaccagtgttctcatttcattctcacagcactctggtgagattcgtgagcagatattaagatgcatctccattttatagttcagaaaacggtgtgagctacagagggttaagtgttttatcaaagacacaacttgggaaagaacccaagggttctttcatgggttggggcctgggccttgattggtgtgccttaagcacttcccatgattgtcaacagccaggggtgaacaaccaggggtgctgggaggtctttctcagtagcggtcacctggaggcacttgttaaaaaaatcagatcccccagccagcctcttctctggagatccggattcagctggtcttgggtgtagcccacataatctatttttaacaaccatcccagatcattcttatagtcaggcatatttgggttaagaatggggacttaggccgggcgttgtagctcatgcctgtaatcccagcatttggggaggccgaggtgggtggatcatgaggtcaggagatcgaggccatcttggctaacatggtaaaaccctgtctctactaaaaatacaaaaaattagccgggtgtggtggcgcgtgcctgtaatcccagctactcaggaggccaagaggcagaagaatcgcttgaacctgggaggcggaggttgcagtaagccgagatggcaccaccgcactccatcctgggggacagagagagactccgtctcaaaaaaaaatggggacttaagccagacaagcttggattttactctggctaggcctcaagctgtgtgactttgggaagattacttaacatttgtaattctcagtttcttcaggtgtgtaatagaagtcatatctctcagggtattgtaaggattatatgtaaaatgtaacacagtgcctggcacaagttctctctccttatgtagacatgtatatgtgtgtgtgtatggaatattgatagaaaatgacactattatctaaccttttgtagtacggagtggtatgtggtcaaaactagtttttcataggtccaggaggcagctttttttaagcctcatgagaccaagttatcttctcaaagagttcccttctttcttttggaggaggacagcacagatcatctatggtgggctctagtctccagtcaaattcaagtgccacccctggcatgtccttccccagatcaaggagaggccatagcggaacacacaggccgaggtgcctgccagcccaccagcaccttgtttacagtgtaaccgccacctcccttggaaatgtagggaagaaggtttgtgccattcattagggaggggataaaaagctaagtttttgagggtaaaataaatatctgatttaaatataacgtgtaggaggccagctggggtcagaaggggcagtgccacccagcagccctgcagctggctgtaaaaagtgtgacaacttacaatcaccaggaaacttttccttgccaaactcttctgaaaacactatttaattctcaccacactctcataagatagggaataatttaccaataagaaaactgaggccctgagagactcagtaaatcccacagggtaacacaggcagtaagtgtggaccagacctcctggctgtggtgccttgttcttaaccacccctgcccacctccaccagggagaggaccatggagtaaggacaggaaataatcctcttggtcactgcctctctggccctgggtgggtgtggatgccatggcaggcatctgtgtacaggagggcagggctcctctgtgatgaatactattagagtgatagcaacatcaacagcaaaaaactgaaaattcccaactcacctggctcacacacgttcatattgctgatgctcgggcacccccacattaaccatccatcaaaacggtaagcaaatcatgggaagtcttggctagcatgtactgaaatgtggcaacatcttgttttccatggtgtcttttgacctgagcctagactttaaccacaaaggaagcaggacaaggcttgcagcgggacagaggtagctaccatttaccgagtcttcactgtggggcagggaagagtaaattcttcaccagcattatctcatcagaaagctcattaaacaagcaagtgcccccctcacttgctggagtaaagaaaaggagacacaaaagatttggatcacagtgatagaacaatcagtaacctcttccagtttagtagttaagtaaccagtcacttaacttctttgggcctgtcttctcatttccaagacaagggaattggaaagaaacacagggaatgccctgaggacttggtttgtgtgctggcctctccatatcctagctctagccttaggacaagccattcaaaatttatctgtcaattaggttgtggcaaagatcttaaaatgagaggatgtgataggtcttttgcgcaccttaaagcacaaaacaaatgacggtccccactttagtagcacttattgtgtgccaggtactgttctggaatgcttttcatctactaagtcatttaatatcaaggataaccccccaaaaaccactttacagatggtggaacttaggcacagagatgttaaataagctgtccaaggtcaaacagctaagaagtgatgaaactgggatttgaaatcctcgtaattacttaatacatacttcagattttgagaaagccagaaattagtgtaatgggaattaatctcaaatgtattagctgtagtttctgttggtagtgtaagatataacagctgggttctgccacaaagatgcaaataatacagagttgtgtcataattatggaacagaccacttcaaataaaaatctatctaaaatatccatttaataaggctctcagcagctgggcatggtggctcacacttataatcccagcactttgggaggctaaggtgagaggatcacttgagcccaggagtttgagaccagcctgggcaacatagagagacccaatctctacaaaacatacaaaaattagccgatatggtggcatgtccctgtggtcccagctactcaggagactgaggcaagaggattccttgagcacaggggttggagcctgcagtgagctgtgattgctccactgcactccagcttgggtgacagagtgagaccctgacacaagaaaaaaagggatctcagctaattctagaagaattccttaaagttgtttaaagatatttatatctcatgacagaagaaagatcagggagaaagctgtatcaggtaagttagttttatgattttcaaacttttcccctaccctgacaaaataacctttatgatattttatcttttgggatttttaagacaaattcaagagaaaattcaatttgtcctttgttttctccctatggccaaagaatttttactttataaatacttccacttacttcagttctgttctcttcctaataatttgtcagctattatcatcttgccatcacaatatcctttgccttcccaccagtacattctttgtctagagaattgagactctggagtcattacttaaaccaagcacccagacctcactggctgagctctgagtgaagtttacccctttcctcatctcctgcacgattttcttccctgaatcacttctgagaccagggattctctctaagctcctacttctgttcacacatggagccctgggttcctgggaagagctgttgcttgcccagcaggtaagtgaaggggtagaacttggagcaaggattatgaatccagcccggctttcagagtgacgcattccctcactcccaagcatattatgaggagatgattgcaatacacgtggttaagggagcactgtgtagcactgtgatatagattagagatagatgccatgactatgaaatcttttccccatacaccatgtatttggtgctctagcaagtggagaggatagtcataaccctgaagttttgattaccctcttacccaggtggcttttgttccaagaaatttgtggcctatatattttcaatctttgatattgtcagtggattcttctacctgttttgtttgaaactttcttaaatttattcttttaggaaggatttatttgctacaaatacaaaaaagaaagaaagcaaacatcagaaggaaacaggctgtgtgtaactaaggagcttgtgtgctgttgataccgcagaggtcatttataaaatctgcttgatttattttttaatttgctcactctaggccaagcctactgcctccttgcccggcctctaatcacatgtacaaatggacacaagcagatgcaaatcaatttgttctcatcatggttggctccataccccgtatcatcaggcaagggaagcctggtgaagaggggctcctgtttgggctactgaaaagacgccggcagaggccggagcgtcagggaagccagttgaaaaccagacttccttccatgggcaaaactgacttctagcctttaaatgcacatttaaatcttgttcattcttcacatcctgggcagggcacagtgttagcacacacagacacctcacaacaaatgttcacagagagaaatacaaaatgtagatggggcaaagggaggggaggaaggaagggagaaagaaggaaaagaggaaagaagacaagaagtcaggaattcgaaggagtgaagcaagaaactggtagaggaagggaaggaggcagaaaaaatgtgatgaaagaaggtaaacaggagagaattaaaaggagaaaagaatatggaaggaaaatgagggcaggaaggagagaagaaagggtgggtagaaagaggagaaaggaaagaaatgtggcaatgttggctaaagcatcccagagggaagccaccagaagaagcatggactcgagggtaccttgctgttaatcatgactcacagatttcacccttctctaactcctagttcagagagtatcttccctacccaatttagcacttcattagttcatgtctgagtctcaaatcatttcataactaggctacaagcttgttgagaatagggttctatcttaggtttcttttgtgccttggtcatctcctgttcttctctggtccctaagacagtgctgggtacatgaaaagcagtgaattatcccagcattcattaggtccctggtaaccttaccaacttctctcactgtggtgcacagccttttttttgttctttatgtagtcaagtggggagtattgttatctctgctgtcatatgctttccagaagtgctgtaatatctaaaaaacccattcattatagtctgtctaaaggatcactcattgatattactgtgacaggctgctcttaaggagaaccccagaatatgcatactattaaggatcattcaggtgggcaatctcataaacactactgagagcatttccccaccctcatcacctggttatagtctgggaaagaatgctatccaattaattaaacaggatctgaatctcctttccatagccaagacatttaaattttgtgtttgcagaggtatgctattagtacagaagtgcgaatgattctcccctctgtgggaaatgtaacacatgcccatgacctctcaagctggtcacagtggtgtcgtgccaaaatagcaggtccttctatatcctccagcctctgtggccacattacgctgagtctggttttcagaaccaaatcttccacaccatgggccttgggaagaggctgcaggtgtgtagagggggcaaccagacacgcttggaaaactgagccttcatctcctaaaggatatataaacagggaagagcagacgaaccctcctcttgactgtaagaagtattcatctgctaatgctcaagtcaaatgtttcttctgggctgcttcggagagacaagaggttgggcttgatgggccctggggctgacatgggagattctatgtactgatagaaaccattttcatcatagtgctgcctattttaaagagtttgcctgctgtgctctgggcatgatttttgactcagcaaagcttcagaagccatggctgcccccaacccggaccctgttttcctctgaatgaatcttcctttttcaagtgtttctgatacaagagaaccgggtgaatgagagtgggtaatttagaaaaggccaagaagagaaaaatatgcaaatatgcaaatatcaacagcaggaataatatttaactggaaaatagcttattattgggctacatggttttaggaagccatgtgcaatgtacatgcccggcataatttaaattaattccttccattcctagtcattcttacacccatatgtagcctttggggaaatcctgaccacaacagtgacattacaggactgggtggagcctgctttccctgttctcatcagtacagggtgggcactggattttgctctctggattaaaaagtctaaatatcctctcagcctcactggaatagaaagcatgtggtctgatccctggtgcccagcagttttagagtactttttcaatatactttctaccccaggcatgagaaggaacctgacagctctgtgggcgtttcattcagaagatggagagctatctgggagtaggcaggggacacctcgtgtgtttcctctgtgagggaaatactttcttcatcactctaaaataaaagtaccagtctgcgatgagatacaattcctttgactgaatcccatccagaaaggcccatcatctaatggccagggacaaggcatgtgaattctctctcctcagagactggtaagggaacgtcacaaatcttacctgagccctgaggataagaatagaacaagagcttctacccgccaccccctccccgccagccaaaacaaatcaattcattacttatcaatccctgcccattcccaggagatgattttacacacacacacacacacacacacgcaggcacacacacttcactggtgatcatcatagattctcagcctgcgatgatggagtggaggaaacaaagtgtcctgaaattctttgataaacgacaagtggattgttggccattttagctcctactaaaacaacagctgcttctcaacaaaggcttctcacttgggacttgcagaaagggagaacagaaatgtcaacagtacaagggaaggatggtagcaacaataggaatcatttcttgaggggttattctttgccaaacacattggtgcaagcagtgttttgtttaatcctccaggcaaaggtggtggtgatattaaggaacaataataccagtaaaggggaaacaacagcagagaaatccttcaaatctatatgacaacaaaggaacattgtgcagcaagtccttcttatttcatctgagtttaacatgaatgctttctctttcttacctgtgcatgtgaggggaaaccacaatgaaaaaaatagatgattctgaacctctagaattttaaaattctctaactcctttcaccctgttttgttctaccctgtcatgaaaggcatgaaatctgtatgactgaaaagattcctctcaaaggggaagtgttagatccatttaagaggttaaacagttttgggatcatgtattgggaagattatttgaatcaaaataagaacacatgatagtcatttgatgcatgctagccattgaaaatttagcatgatttagctgtgtctgttcagggacacagcactgcagtctgctggtctggtcgtaccaatcccatgcgttttgctgtgctctatggaggaccttcttacttatttccattttccttcatgaccagaaatttgacaggcaactcgctggcttctctagcttctctgttttgcttctgtgtccaccccgctcctgggcttccctagtgttggttaatgatgttgttttattttgtcagggccccttccattgttcacatgaatttgacacataaatcacattctttttgtctcttctctatgggtacacaaatactgcggtggggtaggagtacagctaatttgtggatgggaaaaaccgagcttcagggaggtgaggaatgatgtctggctctggatgtgagcctggaggggcacagctgagaagaattttgcagccacttttttctacttagagaacaacgctggaaaacagccattaatacagctttcttgagtcatatcagatctttatattatttgggatgatttttcctcaattgtgtgaagtccagaacatggaatcctataagaatatggtctgaggataatgccctattagccacactcacctgatttcacccttattttgggaactttcaggtgaacctatatttttaaatctctcataagctttccaaattaacttggcatctgctaaaagtcattgtcattttagataactgctcttctttttacaaagacaaaagcaagcaaaaagaggagaacaagctgccaaaaactgaggtccttgcaaaagagaagggctgatcaacccccataggctgctacagccctagttcagttcatgcagagtccacctgcaggcagcaatcaacatgctaaatttgagcaacgaaagttcactcgagcaaaataatttaccttggagtccagctgctgcatgtatgaccaaagatattctatgttggctccaaaaggatggacgtgaagaaacgttgatatgatacctgaattaaaaaggcaaacattggaaattattcaaaggcatatgagagtctctggttaaataatgctgtctaatcccagtgactattttgtcaggctgagttatggtcttgccatttctagcagcactcaacaagcattcaataatagcacattctgaaggcagtaagagtaacatggcaaacagaacactttatctcctggaatgatagtagttagcaaagctagactctgagataatatacagctgaataaagatatttcaaaacaaagactcctggaagcatttcaactaccaattttatgcttgatttaccaatataaaattatagttattggaaggataaaattatcttttctttccctcagtggactttgcagtatgaaaatggctcatacaactgtgtcagaaatcacactgcctcagattttcctgataattacaattgctagatatgaaaagtatttaatctatatttcccccaactgccattgaaggaagcccaaattcttcctgaaacatttgctgttctctctggttgtcgctcttgtttaaaaggagccagctcattctccccttcttgctgctgtaatttacaagatcattttaaaaggtctgggaatggatggtttggctgcagtttgattataaattataaggctcttccatcgtgcaaatcagctgtcaacattgtactgacaaatgaaaagctggacgttgaagtcaggaatgaagtaaaaagcattaccttcctcttctccctgctcctggatccaaaatcaaaatagtgaacatgaggaagtcaactccaaaaactgtagactgctttttgttaagaagttgtgcacttgttattcacgatagcaaaaacatggaatcagctcaggtgcccatcagtggtggattgcataaagaaaacgtggtatgaaccatggaatactatgtagccataaaaaagaaggaaatgatgccctttgcagcaacattgatgcacctggaggccattatcctaagtgaactaatgcagaaataaaaccaaatattgcatgttcttataagtgggagcttaacagtgggtactcatggacataagaaggagaacagtagacactggggactgctagaggcgggagagagggatgagggaaagggctgagaatctccctattagggattatgcccattaccagggggatgggttcagtcataccccaaacctcagagtcatgcaataggcctctgtaacaatcctgcacgtgtacccctggattctaaaataaacgttgaaaaagaaacaaaagaaaagttgtcctcagactgatagttttagctttctgttaaaaaagtttcaagatgaattaaatctgagggtaagccttcatgttctgttttttgtgagccttcatgcttgggagccagggaagaccctcacctgtatgaaatgccatctgggtgggcacaggtgcacacagcattcttgtactaggtcatcctataggtgaccttggattgatctgccatagggtttcatggctccctgatgctatgggatgagtgtcaagtttttaaagaaaagttcccagttcatcctcaggctgagaacagaaaaccaaagggactctccaagacctatcctcagaatgttgctttcccagggcttctagaggatgacagtgagatggggaggtagaaacaattcccacatttccctgtaaaggtagaatctcagtttttaaagactgacctgttcttcctgagatacaaagaactaccacttcattctgaggttatattcttccttttttcttgtcaaaatgtccttttttgaaataatggcaatggtagaaggcaatgatgatactttaaaaatatctttaagtggaaaaatagccacttttaatgtactcagggagcattgtgttgtcccctccccttatttatttacttatattttaattttagagacctgacagctacttccctgtaactgaaattctcaattctggtgaagtggcattctaagtaattctattactaataagagttaaaatataaaagctcaggagtgatttctttaaaaaaattagaatatagtagaactatttaaaaatgattattttcatttgcatttccttttttgttttacaaagttttaaattgatatataatatttgtacatattttttgggtacctggcatattttgatacctgtatacaatgtgtaatgataagaatcagggtaatttgcatggccatcacctcagacgtttatcatttctttgtgttgagaacatcccaaatcttttcttctagctattctgaagtatacagtaaattactgttaactataatttccctactgtactatcaaatactggaacttagtccttctatttgttgaatgagagagtaagggctgaatcacagttcgtgtagagggaatcccctgtttcacgatggtgagtggggctttcactgaccatcccaggtactatggccactgctttccacagagagcctcccacaagtgatgggcaggagaaggacaggggagggagaaggaagagtcagctttggctttgtgagcaggtgagggggtgctcctagtcggaagctttttttctcctcctcccctgcagggttctcccagggaggtgagggctgctgcaaggtggggagcagcattcctcgggtggacatctgcttacgcagcagggctgagacagggagtggcagcagcactgcagactttggggtgacaagggtgtataagtctcccatggagaaagagggcataagacttgagcagtcttaagtaaactaccccaggcaaataaataacaatatttttcatatttaatattccccctggccagagagccttcaacatctcctgcataacctacagccttttgtaaatgtccataggtgtatggttatcaacataaatgtctttaataggatgaatagaacaagtcagaggaggatggggtgggttgggggagaggttgataacccttagcctaggagacgaagtgttgacatgggtcatttagggacaccagaaatgggaggacctagagtgcctctgtgaagttggcaccctctgtgaacatggatttgctcctccactgtctactacctttcaaccctaatcctgggtctgcaccccaaggagctgtgctcttagtctttgtgtgttctggttccatatccagaacatagtacacattcataagaggtatatgttgaacgtatttatttgccagaactggaaatctccagtatacttgtttaaaaattctattagtctattattgataaatgggaataaataagaaccttaaacatttctacaagtagtaacagatctttcaaaaaccaggtaactttgagatattattcactgaaaattcttactcttaacccgtcctgtcatggatttagaaggatggagtaacttggatgttttgagcaaggaaaattttcattgaaactattttgctcataactaaggggaaaatcagattctaaaatcagattagaagtcctgacgtggacttgagtgttcttttaggagggtattcagaaccatctctgtggtagctgatattaagaagccattagcttttccttataagagttcagcaattgccactagatatatgtagggccaaggcaggcagtcacaaataggcttcccaagcttttcctgtggatgacaacccaattatccagtgttgctagagacacagccgaaaggaaagcatgagtcatcatcctccccggtaccttgcctctcctcagcccacctcccactcctgcatctgtccatccctgtagcaccacagaagcatcagtcatgccacttgagaaaatgtttctaggccctgtgattttggatcaggttcatttgagggaatctttctaaataaacaagtaaagcctctttgcagcttttttttttttttttttttttttttaaaggaactgggacattccctggggatggaaaaaggatggctgtaactcaaaagttaatgaaaaatgccacaaacctggaatatggagactattttatggtcctctggaatagacctaaaggcttggtaaaatgaacactaggaatggagggtggtggatttagctgttactgaactggtggatctccaaggggatggctcaacaattggacttgcttgtttccatggagatgtagaaggcctccatattggagaatgggtttccaaaagtggaaaaaaaattttaagtgcctaatttaaaaaaattttaaaagaacaaaggaggttcagtaccattgggctttttgcacatctcagaatcttaaaaactactttagaaagagtaactagctctagaggcctgtgccaaacctcgttaggaaggtccatttaaattggctacccaaaagcactctgagcttctcccatcaaaaccatctagtttatttacattattgggtctcactaagactaaggatgcagtatttaaattaaccaaatagtgccagatttgtactgcttcatcacttattttaatacttgaaacacttagcagccaggaggtggcaaggtgctagaggcacagcattgtataagataggcaaggggctggtcctgtggaacttttattccaggtgagcaacacagataataaacacaaagatgaaaaataaaaatttttagatagtgcttagcacaatgaagaaaacacatcagggaagaggacagaagagacagcaacctgcagtttgctggaacgctaccttacacaaagcgattgatgtggtttggctatgtccccccaacaaatctcattgaattatagctcccataattcccacatgttgtgggagggacccagtgggagataactgaatcataggggcagtttccccatactgttctcatgctagtgaataagtctcgtgagatctgatggttttataaggggaaacttctttcacttggttcttctctcttgtttgctgccatgtaagacatgccttttgccttccaccttctgccatgattgtgaggcctccccagccctgtggaactgtaagtccattaaacctctttttctttataaaacacccagttttggatatgtctttatcagcagcatgggaatggactaatacagcgattacgtgaagccctctccctgagaaagcagaccttctcaagtgtgagatgagaaggagtcagccatggaaagcccgggggagaccattccaggtacaggccacatacagtgcaaaggccctgaggtggaagtgagctggcagaacacactgggctggagagtggcacatgtgtttagaggtaggtgggggccagatcacgcaggaccttgtgtgccaggggaaagagtttggattagatttaaattctaaatgtggcaggaaaccaaaagagtggttctaagcaggtgcttgacatgatctgaattatgttttaaaaacttccctcaagctgctgtatggagggtagagcagagggggaactgggaggccagttggaagtgtttgcatgagactggagtggtgagtcatgatctggactgcaaagggagaagcggactccaaagggagagccagggggctggtgtgagcagtgaggctggggaagaatgaaagatgagtaaacagtttttcacttgagcaactgggtgggactattttctcagatgagaatattggggaaggagcacattagggcaggaaaaaggggaatcgggagttctgttttgtcctcattaaatttgagatgtgcattagcatctaagtgaagaatattaaatggcagctggagatggtatacatttgcaatggcaacaaaaagggatttgaagccaaagtattcattgagattacctaggtagagaagaggcctcaagactgaaggctggagaagcccaaaatttagaggtaagctgaggaaaactcatcagaggactctgagagggtttaatcaataagaaagtgtggcatcatgatggcggagagaagtatttccagatgtgagtagtcaaccacgtaaagtagctgccaggtagagggagttgagaaattggtgacataaaattctctggtgatgtggaaaagaatggttttggtgtgaggatgcaagtcagactggaggaggctggagagagaggggaggagggaatggtgactgtgagcatagtgcgttggaggaatcctgctttggacaggggcaggaaatggactgttgctggaaaggggtcatggtgtcaagacagattttccttctcgtttgttgcaaaggtacaagatagtagagttcatgtttatatattgatgcacatgatgctccacttacatacaagatcactaaggggtaatgcagctttcataatagtcctcatacattacagagaattgagttgaaaaggaccatctaatcaaacttcctaattttatgcagtatgagggcttacacacttaccacagtggtttggataagtgatttgccttagattacccggtggatgaaatgcctcaatccacaaatatttaggaccactccccctcccccaccgctcagggctgcttagagatcattaggtattatggtttctcctttgcatccttatacaaaagatgggagtgggatgggttagccctgttatagtttaattatattggttacccgatgagaataaactatcactttgtgcattcagtttggtcagcacattattctctttgagtggaatgagaaatggaatattgccagaatatactccccactacccccaggctgcttggagttttcattccaaactctctgtgtcaggttctaaagttctggctgagatttgctttctctacacctacactggttgatagtctcctaggaagcttcaaaagaccctggggcccatcagctcactgggatagaggagcaccttggggctttccagagaccttggctctgcagatgaacagctgtgtctctagacacagtcacatcttgctgggaattaccagaggcctgaccataaaccagcctgaaatagtcttgtttcatgttgacacccatataaatggtccacggatgttggagaatcagcaggaaaaaaagccatgcaaaatctgggtctcctagtaagccctgaggggacagttgtctgtgggcagctgcagagtgatgaagcgtatatgggaagtggagagaaactgtaggaaaccgatcaaacacttgtggtttgggctgatgcttctcagtgccttgggattccaaaaagctttaattttccaaaaaagtttattccgcttacttggtgagtacaaaacctaatcttgtatggttggttagttagttttgtgttgtaatatttgtctgtcttattttttcgattaaacccctcagactgtatttgaacctcttagtagtaaattgttcctggtacctgaaatgcccttaacaacttctttatccatccagtgaaaacctcttcatcctttaggactagctcagctgtcctttcttctgacaaggcatctgtagcataagtagctccttctctgtgtctctgattttactacgaaccacagttcattgtaattaactgcattctttctcattatctatgaacttcttgaggggagatcatctttccaccatcagttaatgcatgggatagcataaatcaggccagcgtttctcaaaacatagtaccagatatgcctgctttagcatcctctcagatattagtattgcaatgaacaggatcactttcttttttttcttttttgacagggtctcactctatcacccaggcagttgtgcagtggtgctgctcacagctcactgcagcctgatgctcgtgggctcaagagatccttccacctcagccccccaagtagttgggactacaggtgcatgccaccatgcccagctaacttttttttttttttttttttgtagagatgggagtctcactatattgcctaggctggtcttgaactcctgagctcaagtgatcctcctgccttggcctcccaaggtgctaggattataggcgtgagccaccacacctgtgtgtggggctaaagattctgccttataaataggctgcctagataattcttttccacaatgaagacggattattcttatcgtaggctcttgataaatgtttgttgatttattgatatggacatttgtgccttggaaacaagatttaggtcaatgactcattctttatggtcagtagttttcagagaggaacatactcccaagattacttttctcaggtacagcctaaatatagcctcaactttattcactgaaatcaccaaaaattattgcttaaccttctttaaaaatatttttccatattctactcagctgtttctttatacccacattaggaggagccttctgcttctggtatagtctggttttgtgcacgtgtgagatggtgactgtgatggaaatgatgtgtatgtcctgatctgcagaggactcaggatatgtaagaaagtttgcccaatcattgtcaacctgaggacagttctcaggggaccagggaggttttagagaaaagctgctttgttacagttaaaagttgtggagaagtttttgactacatctggatagtatttacaatgactagcatcaacagggcgtcaatcagagctgctgggattgaaatctattgtgttggaattattataaaaagcaagagaatatagagtgatacggacccagagagttatactctcagctctctgcagaactattagcttgtcaataaaaaaaatttgatccatttttcctttataacaatatccagccaaacacagctcccaaactttggccccaaatcaaaagtaatgactcattctatcccaaacaacttcagtgtatgccaatccaacatgcaggccatatgtgaaataaactagttctggcatagacattgagcaatgtcaagctgaccttatgtgtggttactatagcattatgaaacaaaatgctaccctgcaatgcccccataaaaacagaattctctaaggtccaattatatgtcaacctgtctccacaaaaattgattacaaaatgaataacccagaaatcacaaaaataaagtattttccaggggcctgtcttctttagttgaattggaagacccattaattgtcaagaagaaagtccatcagaatggtcgaactctaataatactcaggatccagatctgcaaaattccaaattatgtcaatgaaatcccacggatcctctctaataaatatcaactttatgccttgaaataaagactctagttttatacaatagtcataagaatgtctgggcagaatacacccttttgcccagataaatcagtgtcacaaataattatatgtaactagaattgctcattgtttaggaagttctagcctcagttttattctttctgtagatggaatccatttgaagagcttttttctcactccctttctcttccagggaatgctttctgccagtgtgcgtttcttatataacatttatgtgccccaagagggcactgatcatctgactatattggcatacagcatacactataagcatgcagatatgatgaagattttgccaattaatgtttccaagttgtgggagattttctgctgtgtccttggccttctaggctggcctagagcatgacttttgtgtcctctctactgacttaattattccaagggaagatttcagggggaattgcaaagagtatttatgactgctccagatgtaccagaaggccagagggctcctagaatcattcagtgcatgagaattcttcagaaaagtgtagccccagcaccaggaaatcctttttctctattctgatccagagcagttttgtccctaccacagtctgtatctagattccagaagcttcaggggagctctttatggacgcaagattcaggtatctacaaagtatgaatgaccaaactcaatgagtagataggatcatttagtggcaggcagaaactgcagcttttggcaggatccattttgctggtcttggaaactctttcccattgtggcattcttttggaggattatcctcttttggaggattatacaaaagagtagaagtatatagatgttttggaagtgggtttggcaaggaaatcacatctgttgccaaactgtcattaagaataataaaataaaatattgagaaaggtagcaaggtaatggataactgaagggaaagttaaactcctaagtttattttaatcacttaagtctctggcctcccttctacctaaatgttctcatatattgattcaaaataagtgtcaccccctgtttctcttttgctctactcctaacttcaaatgctaatattagtaaactagttcaaaagaccaacagtgaggggaaaagtcttggaaaatttagaattggttgtatatgctttttattggagatcctgactaatatttttctttctaacacacttgatttaactaattttatatagttttttgtgataccaaagacatcagcaggcatagcatgttataaatgtaatcttcctacctactcccattaatgtactgcatataaagcacatcatttaaaaatatttgaagtagccaactgaaaaaagtacatgtatgtgtatacatatataaataaaacctaataactacttagaaaacattttaaatgaactgtgttctccaattaaaacataaaagaagcagctatctctagtgaaaggaaggaaataaaaaaatagagactggttcccatttttttaaccttcaagtggacagaattcttcctacttaaagagggaaaagtttactgcagatcattaattgctttgttcataccctaaaagcattatagggaaaaatcacaccttggtcacactgagtgacagagaaacagttgtcagacttggacatgttttccaatagaagaaaaatccagttaccaactacatatgggttcgttttgggttcctggaactgatagcacatcagcatgtcttctgagactcatgcatggcatgttattacagctgtatatcatcagagcaaaaaaaaaataattggttttcctgggagtatctctaagttgatgtcatattcaataaccctgtagttgaaaaatctatatatgatggatggactctggactgtcttttgaatttaattcctcatgtgccagcttctctaggtcctgttgtacctgtcatttttaggtgagcacatgcagtatttacaaaatgcacccagggaccaggcgcggtggctcatgcctgtaatcccagcactttgagaggccaaggcaggtggatcacctgaggtcaggagtttgagaccagcctggccaacatggcaaaaccccatctctactaaaaatacaaaattagctgggcgtggtggtgtgcacctgtaatcccagccactagagaggctgaggcaggagaatcacttgaacccggcagaaggaggttgcagtgagccgagattgtgccattgcactccagcctgggcaacagagtgagaccctgtctcaaaaaaaaaaaaaaaaaaatgcaaccaggcactatttctgccagataatgaactgctgaagaacagtttgtcttgcatgtacattggcctcattcttcagtcttaaccatgccaccatggagccagtctcacctggcaaccccacactggggtcagtgccaaggtgcagcttgaatcagttctgtgcatcacagcatgagggtggtggcttcccttcctctgaatttgagggcttcaaagacagccttaaacatacaggcatctaagatgggcttccatgcacactgccggcacatcctcatcaagaattcttcctcgtgaaaataagtaagacatctggatccactgaggatgcttcttttgttcatcctggacaaaaggatccatacttggacagggaagcctgaagccgattgtcctggattagcctagcatcagtaccctgcatggccctatttgtcagcattgcaggtctagccttgggagtgactttaggatgtggcctctgctaaggggcttagagtttaatctcagggttcaaagctgctcttgagcctggggatatggcttggtttggaactagatgcaacctggcctccagttggaagtgacatgcccaagctttgaaattcagatttgtaacatgtgagatgcaacttagcgtattcttgaactcagtttcatgtctgacaatcagttaatatatacagttacagaaaggcaaaacccccattagtttgtatgccactaatttgaaatgtatgtaatataatcttgatgaaattaatctcaccttttaccagaaggcaatgctgtttaaattaataagttaataactaaaatattaagttaattacctaataattatttaagagaacagatgaagaaaacagaatttccttacctattagcagagcttctttctctgattttaagccttggcttcttttctcaatattgttctctcggtcttggttgactaatgcaactgtcaacacattgatttcctataaagttaaaagccaaaaaccatatatgggtttatgtagattctgtgcatgtcaataaaaaacaccagatctcttaaactctataaataaggtcatcacttctatttataactaaagatcaaatcttttatacaattgatctatttgcccaagagtagaaaagtaattatgtaaagttaggctcctaggtactgctccccgcataccaagtaattctctgcacaagtggcaaatttggcacaagttatcttagatttttgtccatgttttcattaaactctgttcattaaaactgtgtttgattatagctactttaacatgttttatttcaaagatgaataatctttgggaaagcatacaggaaactgatttataataccatgctaaaaatttctgagtgtgtggagaaatagggcctattggggagctaagatagaattgttagaagtgtttttaaattgagtaggtatggatcctcatgaataaatgcaagaggcagataaagcaaagcttggtaaattcttttttttgaaaactaaaaatgaagagttgtacaacaagccaataacacgtgaaacattgaggctggactatttttagttctttctgtagtcttttacatttaaaaacagagatgaagatttaactcatatcatcctagacttttgatattaggactcaaaatggagagtgatttaatggaaagtcaaattaatgatctgcatagatgacctgcatatatgggatagtagaatcattagggaagttgagtcttactggaggaaagttgctcactgaaagatggctccaaagaaggactagtatatgagcagtggtggggaacctgcagggatgatagagaacaggtacggagagccgaatggacgaagaattcagaaggtttgaacaaatgtgttgacaggtgtccctagaactggaagtggttataggagagatatttagatagttagtacaaagtaacaaaactggtcagatccaagagtacaggaagtattgggagcatgccgagcctgcaaaaagtgaaaaccacacccgaaggcattcaaagaaaaataaacccagcacatgccatcaaaacagatctttgagcttaatttaacttatgagctaccactttgtaatccaggggtaattagaaattgccatgaaagaaggctctactgagaaattgcagttggtaatatctgataagcattttagaggctccacttaaggtcccacttatttgctgaagaccaagtgatgaagactgaatgagaaatgaaaatggataaggtaaagaattgagaaaatcacagtgatgtgatgatatatcacagggaagaacttggttggctagagggtataacaggcctcaggctgatggtaggaaaatcccaataaggacaggagtcagaaagagtttggggagtggtctaagctaagtctggagccagctgtacatcaaaggttactagagatgaaagatgctcttacaaatcaaaaacaggatcttgggagcaagcctcaatggaaacacaatgaagaattttaaaatagaacaaatccaaaggcttattatgtagatgggattagaacatttataaagaggaattgcaggaaaggaaatagaaattcctgctatgataaaataacatttggtactttccgattaggctgattaggcactttctccattggaacagagcaggtctgtgtgtacacatcatctttctagggtagtggggtcaatgggcctgctgaattctgttagttgtatgccctaaggacaaataggtcccacagggacatggcagatggacttccaggcctgggaggttaagattgttgagcagacgcaagctgaagctttgtaaggtctcccaagagaggtgtaggaagaaagtggatggaagaacattaactaggataatgattgcatcattaaaaaaatacaaaaaatgaaccctggagctgagtggaaataatatctccaagagagggtgatctgttcacagcctggatgataattggggccaaatgaaattattcagaatgagtttagcagataacaggcccacattaattgccaagactgagtggtgtcctggggccatcacacagttgaagatccaggttcattgagggaaatggactgtagagggcaggcagatgtcaggagccagcagagaaaggcaagggtggaacagacagaccacctgagaatgctgttttctccccaggtccaaaagtggagtcacatagaaagggggactctgagcaaggttcaaagaaatactgctgcatcaacaatgtctacaaggagccagataagacccagtgactcttgctttggtgatgttttagggttgaaaaaattagtatggagagataagagtcttagggtcaccattctgtggaagtatttcttgagattggatactggagtgtgtgctctgctgaccacaaatggtgtgttctcatgcagtcatggccagtgactggagtggacacatctctctgcatggctcccacaacagtccagcaggccttggcttgatggacacctaaggcttggcagacatctcagcttttggggacatctgtgagttttgtccaggttggagatggagctgtttttctgactcctctaggaggcagaagaactatgctggaagtggtacagtatcattgaagctgatcaggcaggctccaaggaatgcttgcttgcatcttataataaactggcctcaagaatctccaaaagggaaaacatcatttccattagagtcaagggtgtgtccaagcatattaaatagtctatagcatagcattgagtgaagtggaccaacttgtgaccactcaaaagagtcactactgactaagctccagatgctaagcctgccttgggcatggtataagctcaggctcttgctgacaaagtcacagagctaattagatgggtgaatgcttatgtcatccattttgccaaagagaacagttaaagttaatatagctgtgtttcaagggatagaagacaggatagtgattttagacagccacattatatgttgtagttttaccttttccaattattagaaaaggagagttttgttttaatgactcactaatcatgggttccttagaaaaataaggttaatttgatttgtctgtatttatattggtattgttcagttgaacaagataaggacaattatcgataatctccaagtatggggtagtctacaaagtagatataagcaacaactgtaccctctctctttgtttttatttaatgtctagaaatctaagttatcacatttgtcaaaagagctccatcatcatgattggttaaggcgaagggaatacacagagagaatgtggaattaattaattcccaaaccaattccctgttgcacttaagctaagcctgtttttactttcagccaccaaataaatatttctgctacatatatacatcacatgcctactatatgccaagaagttctaagtttttaaggatatggcattcaaactgatcagaagtgcaagcttacccagggaccagcaagcaattcttataaaaggtctaaaagaaagaaatatgagaagatgaagctggagaagtaggtagatcatggtaagaagtgtagattttatctgggaggcttaacaagtgaagagttttcagttctgcattttaggacattggtttggaggcaaatgaaactggagtcagcctactgcaaaaatgtatccatttttgccttttgatgatgacagtcaaaacccatgcagagtgcaaacagcatttaagaggtggaactaaaaaaaaaaatctggtgacctggtggctgatgaaaatattgagaacaagtaggtggctcagtgaataggcaaatggagaaagaagctagtctgggagaagattgtgtgttcagttttggaaatgttcaacttaaggtttctatagcatcttgtcaaaatattttggaggaagtaggattagccaggaagtaggatgtgcacgtttctgaacttagaagcaaggctctgacagctctttttatggggcctttctctggttttgtttgcagcaggaaatcttgatgttttcttgtgggacaaagagcaggcttgcttacacttgatataaaaaaggtagattcctaagctcagtgtttctatcttgtaacacaaaccactgcatgtgctggcatccttctggacccctctacggagatactgaggttataagatccatgagagtagactggtgaagccaaaattcttctgggaacagtctctcagtgggatttcatattctctacacaggacattccaacttatctttttagtaattggggaacacataaggacattgaatcataaattacacatggttttgctcctttcttaaaaagttcatggtccttattactctctccaccccaaatctctagagaatggaaaggaccttatcagaatgggaaagttttatcattagaaacataaagttatgaagaccctttatccttttatcaccttaaaatcctttagcctgatagatgcaacatgcccagaagaatgatgagtctaccagatattccagaaaagaggttccagatgcctagcaattacaaagtagaagtgagtgagtggggatggagtgggaggtgaggaaggttactatgtatgaattgttagtggtatacaaagtacacagcgggacgggaacattaggatggagatcaagagtttcctctcagtgagatctattggattatgaagtagtctcccaaaggaagtgggaagaacacagtaaaagcacaccagactagaaaatgcactgcagctaacaattctgcacttgacatgagattggagattacctaataaatcttttctcagcctaccttttaactctaatttctgtgatacgtagaaggaatcattaaagggctggagaagaggttttcagtaactggaaactagatgtcacagactttttaaaagacttcttaaagagttagctacttgaaggcagaaatttcccttctaagagtcctcatcacttactttgagaaatgatcaaagtaatttatcatttagaggagctctttttcaatagcttattgagctagaatcatgctttgttattttgtttttgtttctctccacctacccaagcccctaaggaccaagaaaatggcttccctgccttataaaatccttctgctactgctttcacttaattattcctgtggcttccttacctttagggctgttttctttctgttgcaaagcttcttgaatacatgttgtccacctgtgtctactgcctcatcatctgaaatctcagctttttcatcagtcactccaacaaatctactctgagatatttccagtgaccctcttcttgccaaatgattattttcccagtcctcttaccatgtgatatttgacacccttgacattggcccctcttaaaccatctgcctcacatctgctacacaggaggtcctggtctttttcctcttaatttcctgtttagtcttcactggcttttttgtttcctctgctggcccagtgaatgtaaagaagaggctactctcttcctcctcttctctagctttggcccttgccaaagtgtgctccccaatttttcttacctgttccctttctttcattctcgtgggttcagctatgatcaatcttaattctttaagcttctgttctttaccaccaactgaccactgggcttgtctgcctgaatttaccaatgcccagttcaaattcagaatgagaggtggccatgaggcagtggaagagacactaaatacttgggtttcagccttggctcttcctccagcagccaggtgaccttggcaaattactcaacatcttcaagacccagatcacttgtctaaaaatgaggggctgggtagggccaatcatctttgaatagtacttgatggaacctcattagctttatagaggtgacatggatggtccaaggggacacatctctggaattctactctttcactcctttcttttgcttaatgatacagggctcctatgtaaagcttcatttaaagaaatgtccttaggccgggtgcagtggctcaagcctgtaatcccagcactttgggagactgaggcaggtggatcacttgaagtcaggaggtcaagaccagcctggccaacatggcgaaaccctgtctctactgaccatacaaaaattagccgagcgtggtagtgcatgtctgtagtcccagctacttgggaggctgagacaggagaattgcttgaacccggaaggtggaggttgcagtgagctgagtttgcaccactgcactccagcctgggcaacagagtgagactctgtctcaaaaaaaaaaaaaaaaaaaaaaaatctgagtccaggtccttcctaatgtaattttctaaaattctataattttatgactaaaacccagttcatctcactcgtcaaactgcatcctcttctaacttttctgtttttattaaagtcagcatcattcttccacttgctggcgctcaaaccctcattttgtctttgattcattctctactatcccctaagtgcttttaagatgtctctaaatccaaattctctcaagtgtctgtgagatgtctctcctgctgcattcccatttccactagtgctctactctcggttctacgtgtttcatactttgttttagggatgcggtctcactatgttgagcaggctggtcttgaactcctggcctgaagcgatcctcttgcctcagcttcccaaagcactgggattacaggcatgagccactgcacctggcagatttcacaccttgaccattttaaccgctgcaggaacctcctactttgtctctgcctctaggctcttcctcttccagtctatcttacataataccaccaggtcaattttctaatatgtgacttttatctcatctatctctggttaaaacttcagatgctttctgataacctacaggaaaaagtcagatgctgctgcttggcattttgggcttactcctatcaaactagcatatcttctttctatgctatgtccagaaatgctcttggaaagctctctcctccttgccttgccacttcctacttacattttacacacagcacaagtcctgtatctcccagaggcatctgtttcaggccacttgcaaggcttccttatctgcacacatttcctacgccacttatatggcagttcatcacttatacatcacatttcacctatttgtttcctccacaaaaccactgccttctttagacagtaatcacatctaagcaagtgaggcagaatggccgaatggaagctgtgttctaaatctgtcacattatttacatactagataactttaggcagggcatttctctaagccttaactttctttaatgaaaaacatggataataccatgtgcctcttccccatggttgctgtgaggaccaaatataagtgagacagcgctttcaaaaactataaatttctaggaatagattgtggcatgattattacaaccattactcacttttatgattcacaggattgattggatatggaacaagtgttaatatatacttggggtactgaatccatgcaacaattctgtataagactttgactacaattatataaaaatatttatgcaaaaataactgtggttgtattcaaaaatagtggatattttctattttctctatttttctgtcagtgttgttgttattatccttataagtaaagaaagaaaaagaaaccaatgatatacagttgttgttttgaagagctataggtaaggacagccagttgctgaatacttaattaagtaacatactgagtgacatcacccacaccctaaatagagaaaccaccgccatgtgacttcccctatgaccctccaagggctggcggcctccatagctgctagtgcaagatgagtgggacagtcgacaagatctatgtggtaaagattctccatgtcaccccggactctgccagcagcataccacaaggctcgttttccttccctgcctgcttgttccatggccttcttgtgctgttggctcagttctgctaattgctcataggccctactcttaaacatcacacttcatgaaatcgggggccctatagataattgtcaagatgtgtatcagctacattcttatcctttactcacattttgcaaagtttcaaaagcaatccatcaaatgatgtgccagttgccaataaccttcaaattattccttatatgattagaactgtggttgggggaggatggagaatggagatatcccttcacactttcctttatgggcacatagcaggtgcccagtggctgataaatgaaagaatgagcctcaaacaatggcctggaatattgaaaacatgatgatttggacatagaagacactggttctatttgccgctggcctgctgtgtttctttgtttcatttttgctgtttgtacaaagacaggattgaagtggatgacctccacagtgtcttcctgctccctgattccatgcctgctctgtgcccttttccctgacttggaccttcccttcagattcaggtagccagcttggtacagaccatataaacttatcctttatttctgatgccagtaagaattagagaggaaagaggaagcagagtgagaaaaacaataaaaaaccaaatggatgaggaaaggattgatgagcatgagtgactaagctttagaattttttatggtttcttatgggaacataagaatgcatccatcccccaatagtgagcaggatcgcaggaatttcctgtggggcagcaatcccaaggccttgctgatctaatcagttgtgaaatcttggcactgcccatcccgagggtcgtgggctctcaccacctctgccctttcccagcagcctttgatggtcaaggtctgtataaggggagcctcagaggcccaatagttttcagcatcagagagataatctgaaagcagatgtgtggggctccaagatgcagtgattcatcatgatgtgaccatattttacattctgagatgttccaccttattggggttcaattgccggatcggaagcacatacattatgtctttagacaactccaagaaccgtgttttctaagatttccaattgcaaagattaaaataggcgagaactagttacggctcacacgaaggaccctttaaagaaagataaaaactcagtgtagtttactgccagagatatccagatacagcatttatcctggtggccttctttctaggtcatctttggttatatttatttaacaaacatctgtacagtacttactatatgcaggaagtgttataagcacttgacaaatataaactcaattgtcataagtgctcttcgaagtcaggctattacattcttaatttacaggttaagaaaatgaagaataatgaggctaatgacttgcccaaggtcacaaaactagtaagaagcagactcaggatctgaaccaatgctgtcttgctccagagtcctaaccactacactaggttgccggttgcgtggatattgagtgcctgtggcgctctgtgaccaaatccctcctgagggctgcctatagtcctagctcactcaggagccagccaggctccaggcaggcctggtgagctgtggttcttgcataaacatgaaaggaaaggggagcagggaggaagccacccacgggctggctgaggagcagcattagcagggactgagggggctggctggctgctgctgtttgcgggtgacggacttctttagtgtgacttttaaccacagtctgcaacagggagggatttcaaaggcagagtgctggggccaatgaagaagaagaggtgggacacatgctctcttgatttgaaggatgtgggtaggggaaggccaaggtcagaggagcactccaaaagactgtggttgggccacatgcaggattggctgggcaggtggagaggctcaggcaaggaggccccaggtgcttctccagccacaccccaaggatgtggcaataaggtggaaccacagaggtgacaggaagagaaagaaaaggtggatagagaagccattcggaaggaatggaaagaagccattctgaaggaagaatggaaagattctatgtgtgaagcagagaggggcgagctaaaatcatttaaacaagtcaggtctacacagctagcagaatattgataccagaatcagagatcacgaagaattagaagtattgcctctaggctgggtgcggtggcttgcacctgtaatcccagcactttgggaggccaaggcaagtggatcacttgatgtcaggagaccagcctgaccaatacgttgaaaccccgtctctactaaaaatataaaaattagccaggcatggcagcatgcgcctgtaatcccagctacttgggaagctgaggcagaactgattgaacccaggaggtggaggttgcagtgagccgagatcacaccactgcactccaacctgggcaacagagtgagactccatctcaaaaaataaataaatacataaataaaaaagtattgtctctaatattttaaaatattggagctgaggtcttagaaaggcagctggaaatagggaagatgagggtgatgagctctcaccacctgtgccctttcccagcagccttccatggtcaaggtctgcacaatggaagcgtcaggagatttttcatggtagtacttcaggctgtgaagggcgtggacttgagtagctatagcagtgtgagttacattttctacatactgaagagaaacagctatttttgagatcaagtgtattttttcatttggttatatctaccgtggcattcaggctgggaatacccctttccagcctcttgcacggtcccagtgcacctgttgtccccacagaagtagcaacagtgctgcctttcaccctcaaagacatctgtttgaattttatgtgatgactgtacctataatctctacagagcaacagtgtcctcagtacctggcacagtgctctgtacacagatgcaacatatatatatatatatatatatatatatatatatatatatatatatatatatatattttttttttttttttttttgagacggagtctcgctctgtcgcccaggctggagtgcagtggcgggatctcggctcactgcaagctccgcctcccgggttcacgccattctcctgcctcagcctcccaagtacctgggactacaggcgcccgccactacgcctgtctaattttttgtatttttagtagagacggggtttcaccgtgttagccgggatggtctcgatctcctgacctcgtgatccgcccgcctcggcctcccaaagtgctgggattacaggcgtgagccaccgcgcccggccgcaacttatatttttaaaagaaaaaatataaatagtagaccctctaatattacatcaaatgaatttgttactacatagacaggccagacctcatgggtgaaaatgactggccatcataagggtttggtcagtaccctgggcctggagtcagctagaagtctatgaggaatatatatgtatggtggatagtgaaaaaaactatgcaatcgctttggacattttacagccttttggtccctaaatacatttattgtagtatcattttaaaataacacaatttctttaatctcgtaggctgaaggaggtaaggaagttaatttttcatttgtatctattatcaatgctttcaatgttttaagtattaacttttaatttttttggagaccaaaccataagcttataaccttttttcctttcttttccaaaatatataaccttttctctttcttttccaaaatataagacatattttctagttgactttcttagtaataacctttgttttctcattacaaataaaaatatgtattcactgtagaaaatatacaaagtaaagattaaaaattaactgaaattctactaccaagatataaatgctattaacattcagatatttgccttttatagtttatatataaccccctcccacatacatataacatatatatgtgtttgcatatacacatacatgtatatattgttgtttaactcttatttgaaaaataggattatgatacatatatagcccccaagtagaatattctacataaagaacagagactttgataggaaaggatcatttcaatttcttaatgtttcccattaaatactaagaggatcactgctgcctggatcataacttaataatgactatcacagttcacaccatgcttaaattgtggtctcaagctggcaatgaaatgactttcttttggtctagttttgtgacagccatgttaaacaaaaatgatctaaaaatgagaaaaaaaaaattcctttgtatccagtaaccccattcattatttaaactgttgtagtattttatttttagttttactatatgccactgtagacataaccaaatgaaaaaatacacttgatctcaaaaatagctgtgtgtttctcttcagtatgtagaaaatgtaacccacactgctatagctactcaagtccacgcccttcacagtctgaaaaagtactaacatgaaaaatctcctcaaccaataaaactagagcagcaaacagaagacattcaagtgaaatactttttaaaaatgtatgtatgtgcatccagaattagtcggtttgatttatcttgtatgatactaactctattgctggtaaagattaattttattatggtgctcctggcatgttattttctcagttcatttctcagtatgacatttcttatttttctctgctacaaagcacccactatcataattttcacctgctgagtttatgttactgatgataatattaaaatttagagggttttttgacctttctagtggtaaattaggtcataaaaatagatgggacacaatctgataaatgagaaagagaaagatttgattattattaaagtaaaatcaaattttacaaggttttcctggcatactgtgagatcttagtaaacattgaatatcttccttctctcacacccccaaattgaattctctctattcaccgctgccttgcatatgccacacatgagaactattccaagaaccaagcgttcctgattgcttctgcatggtgcactggagatcttctgattataaaccaaataatacaaataatagtggtgataataatactaacagcttttattgagtgcttggtagatggcaggtgctggtctcttactatctccattttatagattaaacactgaggcacaagtatgcctcgctgtttaatctgtaaaatggagataataatagtaagtagcttccttaagttcacacacctggaagttagtggcatcatgactgggccccaggcagtgataccccagggcctttagtccatgctgccttctgtctgaatgatctctccggaaactatagcttctccacttggttcaagcccttgatcccaccccaagtctgttccttactgagaagcctgcagtcagtcttgagtgagttcccttttcagttgtgtgccctctcttcattgggcatgtgctcctggaggacagtgactgctctgtgatccaatgtgctcccaacaggcggcattgtgcctgtcatgtggacttggatggaccttgttaggagcggctagttatgggtccactgactttttttgcatattatccaaatcaatgtgatttcttaagaaccagagtctcacaattactaatgatgtattttcttttgggggctgaatggcagcaaaattcaacatttggattaaatgaagtatctgtacacctcagttcagtataatttgattgaatttattgagcctcctcctcttttcatttattgagtacctacaataagggtacattttgtgttaagacaacaagattcaaagatgaataatagtggttcctgctatcaaagaatgtaggagtctatagggcagccagctatgtaaaatgtattaaaatacagtatgatataagccatataaaatatattaaatacagtatgatataagccatgacaaaggaagagccagggtgctggggaagcccagagtggcacctagcctgtcctggggtggagagtttgtggaaaagtatggtccacagactggtaacactggcattatctgggagcttactagaaatgcaaattctcaggccccagcttggacctgcccagtggaaaactctagggtagggcccagcaatctgtgttttaaaaagctatctttgattcgattgcttattaaagttcgagaagcatagcctcagagaacataagactcacaggcacaacaattagacaagaaaacatatatctaattaaaacctgtaaaataagaaagttggatgatgtgatctctaccacctcagttttaactgtcagtccacgagacttttatacacatcttaaagttaactggagtgatgtgtgtttatcttcaagatcacctgcagataatatgcagaaggaagatttgtacttctcacctaaccactccaaacagattcatgagctgactgaggctgctgcacttccatcaatgcaatcatcaatcgatgagtgttactaatgtatctacctgcataggctcattactgtgttaggttctgcaaggaatacatacaaattctccactttaaggaacatgatctgagttggggagataagcctgtcagaagtgggttgttcaagatggttggaatgatgataaattgtaggaatctagagaagatggtgattgatttggactgatcttagggtaaggacctaagaaatgggaattgaggtaggcttaaaaacaggcagaatttgcattgcagacaaaaagggcgataagatagatggagaagctgagttatcaatacaaaatctaattacttagaatttttaatgaatggtgcaccaagctgaatttgacctgctgactcaagccatttattcaggaaatcaggccaacattttttctgaataccaggctgatggttattccattttcaccaaggggactagtttgaatactgtcatataaaatggtcaggaatgatatatatgcttacagctgtgagacttatatgttatgcatatatgtgtgtgtgattgtgcgtgtgtgtagtgaggggacagagaattatactgacacaggtactggggcttgatatagattgtagttgtatactgttcccatagtttcaagtcatcttcctaaaagttggcatggaaagaaattgcctttgcaaattagattctgcaagtctcaaacataagtagctcaccagcgtacactgaacagtctggaaattgtccagacagagaaagccactctgtaatctcacagagaggctgatagaacaatagaaacgacgtgttactgagcatcacggccacaagtctcccctgcaaggacagtttcaagctgggaaagctgagactttgaggtttttcttggaaaaaaaaattaatagatttctgctctattaagtgttccaagcctggcggaatgtcttcaggggaacctagagttttcagagaatggcctccatatacctggcaaggtgctgctgcccagagagggtgacagggaaagacttccctggctctgatgtctgcacagcttagaaatgcactctttctttttattttcttcttcaggaaactcttgctgtctttcgataaaaacataatttaaaactgtaacaaaacatgtgaatgtcttttcctttgggcaacagctttccttccaaattcaacttttgctctgcctgaattaggaacacgtggaggagataaacattgaggtgcagtttgctgaatttctgacttttgtgagaccctaggttagatttaaagccaccagtgtggggttcatagtcttggaggtttgatttaaatgcccagttatagctggctacaaacaggatgtcaggtccccctgggcatggtggcaggtcagtaaggagggaaggtgtagctgcatttggtggccatgaactcacaactggggatagttctcactgttaggccccagcaagggaaggggggatctccatcagagctgggaagagttttgaggttggaaggattaagacacactccagtttgttgtgggaaatttaaacatatttattgccaagtccaatctttgtttcccccaggaagaccaccaaacatgttacttgtagactgacatttgagcttttttgcttccaattcaagagccttattttaggataagcatttcattaagtgtggatatttgtgcaactgcaaacatacctttgatgcaagcagatttcacagctagagttggcaggagagctgcatgatggtgaaaactgctgctctgccgcctgccagggtcaatttagaagggctgacacgcagggcaccacgacacttaggcagctcttcctgttccagtctttcccgcctttcttcccttttttcttcattctatctttgtacctacttttttccttgtcattttcctacatatttcctcaaagaaatgccacatcccagtgagctatgtgtcaatgagatggatgaggttggagatgagcagtgtgtgaagaaatagagaatgactgccctttgcagcactgcagaaccatcctgggagagctggagagtaccaggcaaggaatccttgccaaagaccaatgtcaaagatggagtcagaccagcactggctggtgcatttcacaactctccccttcctggtctcacgtgtggttagcagaaatgaagtggtgcgaaaatcactatggaatatttaataatctaaatcataaaaacaaatgtctaggaagccctatggctcctgagtagcatacagaactaagaggaaggggagttcacctgctggtgcatccttgctcctggctgcttttataccactaatcctggtgccttgtcccctcccctgctgccttcatgaggcactagggtaatctgcttctgtccaccttttgggctcccgactctttccatagatgctactgaatgttcctcctgttccttgttgctcagggtatcaggcagtgctaagccatacctcttgtgaggcaggaataccgtaattgagccctctaggtttatttgactttaaaatgatattgcttgcatgcaagtcatgtctgtatgtttgtatatgcatcccttgttgatggtttggagcttacctggaacttcttggccataagtagaaataaatgcttaattttggggttgggttagaactcattttgttaaactttaaattaatcactcttcttaatctcacatattttctcgagaggatggacaagtctcatttgggtacggatggccattaaccttggtctggggtccatacagagcataggctctagaatccctaggccacaaagaaggttcggacatagagttcacagcacacgacctcaaataatatatctaagtattgttctcctaaattatttatgtagtatataaaatttgcctttctcttcaaaatgcaaatattattgaggctatttcctctcctgttgaggaactcagtctcttctctatgtggtaatatctagccattattatgggctgtttatttcattatttaccaagtaggggcttagctttaattaaaaaaaaatcagtgaatcttcctctgttcctaaattccaatcaagtacaaaagcttccctatttataaattgctttaaatgatagctgaattaaccaatacattgtcaatatccactgcttattatccatgagaacaaaaataagattttaaagtcccacagcagggactgattaaagaaattagagtacatctgtggcatgaaatattaggcagtcattaaaaatcacaaaacaactgataccacagaaaacacaaatgatccttagagtctatcatgaataactatatactaacaaatcggaacacctagaagaaatgcatacattcctggacacatataatctaccaagattgaaccatggagacatagaaaatctgaacataccagtaacaagtaatgagattgaagcagtaataaaaagtctcttacaaagaaaagttcagaacctgatggtttcactgctgaattctaccacatattaaaaaagaagaacaaatagtaatccaattgaaactattaaaaaaaccacaggccaatattcatgataaacatagatgcaaaaaatcctcaacaaaataccagcaaacctaattcagcaacaaattaaaaagaccattcaccatgaccaagtgggattcatcccagagattcaaggatggtttaacatatgcaaataataaagtggtacatcacattaacagaaccaagaatggaaaccatatgatgatttcatagatggtgaaaaagcatttgggaaaattcaacatctcttcatgataaaaactctcaacagaccaggtatagaaggaacatacatcaaaataataatgaccatatatgacaaacacagttaacatcatacaagatagggaaaaacggaatgtttttcctctaatatctggaaaaagatgagaatacccattttaccacttttactcaatactggaagtcctagccagagcaattaggtaagtgaaagaaagagcatccaaattggatggaagaagccaaattagccttgttcacagatgacatgatcttatatttagaaaaccctaatgactcggccaaaaaactggtagaactgatgaattcagtaaagctgcaggatacaaagtcaatgtacagaaatcagtagtatttatatatgccaacagcaaacaatctgaaaaagaaatcaagaaaactcatttacaatagctaaaaaaatgtaaaatgcctaggaataagtttaagtgaagaagtaaaagatctctagacaattatgaaagactgatgaagaaattgaagattacacaaaaaaatggaaagatattccatgcctatggattggaagaagtgatattgttaaaaaggtcaatactacccgaagcaatttacagattcaatgcaatcgctatcaagataccagtgacattcttcatagaaacagaaaaatactatgaagccacagtaaccaaaacagcatgctactagcataaaaacaaacacataagactgttaagagtagagaacctagaaataaatccatgcatttatagccaactgattttcaacaaaggtgtcaaaaacatagattggggaaaggacagtcttttcaataagtggtgctaggaaaacagtatgcagaagaatgaaactagacccctctctctcaccatgtatgaaaatcaagtcaaaatggattaaatacgtaaatgtaagaccagaaagtatgaaactactaggagaaaacattgaggaaatgctccaggacactggtctacgcaaagattttttgaggaaaacctcaaaagcacaggcagcagaagcaaaaatagacaaatggaattacatcaagctaaaaagtatttgcacagaaagggaaacaatcaacaaactgaagagacaacctacagaatgggagaaaatatttgcaaactctccatctgacaagtgattaagaaccgtaatataaggaattaaaacataaggaactcaatagcaaaaagacaaataatctgattaaaaataggcaaaatatctgaacagacatttcttaaaagaggacatacaaatggccaacagttttatggaaaaaaaaagatgaacatcactaattatcagggaaatgcaaatcaaaaccacagtgagatgtcatctcacctcagttaaaatggcttttatcaaaaagacaaaaaataatggatggcagtaaggatttgaagaaaggggaaccctagcacgctgttagtgggaatgcaaattactacagctgttgtagaaaacagtatggagtttcttcagaaaagtaaaaatagagctaccatatgatccagcaatcccattactgggtatatattcaaaagaaagaaaatcaatataccaaagagatgtattgatatattgcagtactattcacaatagtcaaaataaagaatcaacctagtgtccatcgtcagatgaatggataaagaaactgtgatatatatatatacacacaatggaatactatttagccatacagagaatggaatcctgtcatttgcagcaacgtgaatgaaactggaggtgattacgtaaagtgaaataacccagacataggaagttagacaccacgtgttctcactcgtatgcgggagctaaaaaagtggatctcatggagttagagagtagactggttgccagagtccaggcagggttagggttggggatgaagagaggttgattattgggtgcaggaatacacttagataggatagagtgtgatagttcagtaggttgacaagagttaacagtaatctattgtatatttcaacatagctaaaagagaagaatttgagtgttcatagaataaagaaaagtgtttaaggcagatgatatccaattgtcctgatttgatcattatacattatatgaatatatgaaaatatcacaggtacctgaaaatacgtacatctattatgcactgataaaatacattttaaaaacctatttaataacatgggcaaatgctcattattgataaagaaaaatgtaggttgtaaaattgtccatatgatatgctataaatttgataaaaatgtatatacatgcacataaacaaagataatggaaatacaaagaagtggaaactgatttgtgagtggtgagatggcaaatggttatctttttattttttctgcatttctacattttccacaaaaagaaaatggtacttagggataacagtatttatgcatatttatatgtatgtatattggctctataaaagttaccaatctccattcaaaacaattgcttttgcatttatctctggtaggattatcatgaacctttctgggggaggacattctgtctccaaaatgggtaacttttgttcagatcttggttttatctatacaggtatccatgtccatgtcagaccatttcacacagcactgaaatttgtttcctttgcctgattttctctaacctggcctggaggaagaaggtattttcacttctctaaactcaatctgtcagctttattaaacttgctaatcctgttacatgctccaaattcactaatgaccaagcaggtaccaccaactctggccctgataaaaaggacaaacttctagccccagcctccagcagtggaaacatagtcagctggcattgaggtgtctgggaaggaaacttctctgagccttgactggatacaagaacattcaccgtgagccagcttctgtctgtttttgacagcagttccctctctaatccttccttggagctctgtacatgctgggatgggggtgtcctaacaaggtacctttgcaatcattgaccttttcaagggtgctgggttgggacatgtgtggattttttcagttggaactatgggtttcacagtgaattgcagcacatacagttaattcacagcagaaaatgtggtgaaacagctggaagaaggcagctgcataggggcaggggttgtagagggagagcagggttagaggtggggaaggaaacattggcaggagaaaagcaataatgttacagggctataactgggggagaagagcaagttctgggtatgagcatttaatatgtggacagggtaatatattcaatagggtaaaggaaatattagtccacgaaaaatccaacttcttgacttcaggcatctgcagagcaaaggtgacctcagacatctacagatatgggcccatccctctctaaagggaagacaaagtggctcctgattttccagttgagcttttctggaggccgtaaagttctctgtaccactcattgtgccccactcctactagactctcctcccaagcctaccatggagccagtccttccaaaaaaggtctcgtctccagaggattgctggaaaaatacaaataaaattacttcaagctcatcattcccactgtgatactgacctacaggcagagaatgaggcctgatggaatgaaacaggactagcaggttttggtaagtgaaaggcatgaggacatggagtcagctccatgtgggggcagaaatcccatctttattactcatcactgggtctccaaaaccttgcccagtgcccagtgtgtccaaggctgggtaacagtaatgtctaacacatgctgatcacatcagcactgcaaagcaaggctcacagtaccctatgaggtaggtatggttattaccttaattttggaggtgaacaaaatggaagtgcaggggttcagtgtatggcttagggtcactcagattgaaactgggctgcttcatgtccagatctgttcttaacctctacactctgctgcctccctcaatgaatgtttgtgggtgtaccaagtagaaagtgatgtcaggctgtgtggggacacaaatgaggtctctgtacaggtcaagggcagcaaggaggaaggctggaaggagaaacatatggagcaggatgcaagagctgcaacacctttggtcccaagctagtgcttgctgggcttagtcctggtgggtctgggctcattttccttctttttttctttgagacagagtcttgctgtagcccaggctggagtgcagtggtgcgatctcggcttactgctacctctgcctcgtgagtcccagttcaagcaattctcctacctcagcctcccgagtagctgggatttacaggcatgtgccactatgcccagctaatttttgtatttttagtagagacagggtttcaccatcttggccaggctagtcttaaactcctgacctcgtgatccacccacctcggcctcccaaagtgctgggattacaggtgtgagccaccgtgcccggccttattttccttttgatagagctgtgggttggggtgaggaaggtgtgaaaccttatatttgtccctttctgctttgtctgctcctctcccagttcaagatcggggcccctaagaccaagcagcaagttctgggaagaaagaatccagcctgagttgttttttacctttagaagatacggtcccattctttcgtacaggttgtctttttcttttttgccttgtttggtacatcagtatgtattctctctcacgcctccctgcctaaagggtggaagctacattcagaaactgagcagaggactcagcacatgcagaggttccctcacatacatcattaaaatacatggttaatgatagccttctgctgtgctgtactaaacttgaagaatgttctttgcacatatctcttccatacgctcctaacgtctttactctgacagacttaaagacagctctgaggatttactttcttaaggaggtgacgtgaaaaactgaaaagtcttttttcttttgtgtttttgtttcactggtgaatgggaaggtgttctgtttgacagtggcaaccttcagcatcaccaattaaacctctttacaaattgcaaatgatttctttaaccccagtgtgggagtgtgaattgagcaaatagaggaatgtgaggtagcaactttactataacagaaacaaggacaggaggagagaaaattcatggaaagcttttagatcaaattgttttaaacattgctggctgaagctgtcactgcatttcattcctcctacctgatcctacagttctccctcctcatccttcccctccaccagacacacacatgcaaggatcataggtggcgatcctgctgggaagaaggtcatcaaaaaagatgcaagataagaacatgatatatatacatatatatttacaatttaagatgttgatatctgttatacataattaccagggaccaggttattcagcagtcctaggaacgtggagatagctcagagacagagatgaaaagaaaatttataggtttgctttccaggaaagaaaattgggtctgaaacaactgaaatccttaaagaaactggaataaaggttagttttaaatttggttacacttaaatggttgacttgcctatctgtcgttaatatatccagttccaactacaaagagaaaacaaccagcaggcatgagcgtgaactgcacaagtcctcttggagaacaaggcctttgcagttgacgtcagtttctggccctaacagttttaaatctgctttcagaaaacttctcctgggcatgcattcgcagatgatcttgtgataaggggcaagggttgggctttttaagggtgtgtctgttttgagacctcaagcatgctggacaatgtgttggtcagatcctggtggtacacagtagaacgtaaaaacaacagaaaagtaatactaacagaccatgagctagatgagtcttgagactaagacaaatgaggaaatacaagactctacgtatcctttagtggattccttcaggacgactaatagatactataagggtgcagcagctgcaccaacattctgaatgccaggcaattccagaagtttgaagctccctgtcagactccaccacacagctattaatatacagaatcccccagaaacaaatatgagatgcaaccaagatttatggatatgttaattacagatttataatagcaaaaacaggaagttaaatgcctgacacacaggcgtgtggttcaattatttcacatctacattatacagccgttaaaaatcatgtctttgacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacactgcatattctcactcatagatgggaattgaacaatgagatcacatggacacaggaaggggaatatcacactctggggactgttgtggggtggggggaggggggagggatagcattgggagatatacctaaggctagatgacgagttagtgggtgcagcgcaccagcatggcacatgtatacatatgtaactaacctgcacaatgtgcacatgtaccctaaaacttaaagtataataaaaaaaaaatcatgtctttgaggaacatttggtgacaagaaaaatatttataataatataatgaaaaatcaaaaaggtacaaaactgaagacaagatgatagtatttatttattcatttatttatgggcttttccctctggtcatatacatgactggaaaaaactaaaataaagcgttaatggtggttatctctgagtaatgagataccaagattttttttccttacccctatattcttttctttctataatttgcaagcttcaaacatacttttgctttttacttttataataaaacatagtggttttaaaaacacaattgtcagctctcacaagaacacccagctaagttggcaccagtccactgtataattgttattaataaatgataatgcatgaaattcctgcccccagatataaataattataatgaaaaataatttatttgtctcagacaatagcctttggtccagaggctttaaaccttgtgttctgccttaaaattcatcctgccaaaagtcctgtctgctatattaaatactttgttatttgttgagacagggtctcgctctgtcacctacgttggagtgcagtggtgtgatctcggctcactgcaacctctgcctcctgggctcaagtgatcctcctgcttcagcctcccaagtagctgggactacaggtgcgccatgttgcccagtctggtcttgaactcctaggctcaagagatccgcccacctcggcctcccaaagtgctgggaatacagacatgaacctccacacccagcctatattaaatactattgatgcatgaagagagaattaatacttgttgagtatgtactctaggcttggtgttaatgtacatggtttcatttaacacacaaatgaggaaggtgaagttcagaaataatttgtctcagtcacatggctactcagtgatcaaaatggattcaaaccctctcagtcgggtctgaaggcctcgtctcttttgaccaccacaaggctggtggcaacttcagatgagacgtagacttcatttcagacatttaagaatagatttgcaaaatattgccagtgctcctaatgtgagggcaaaataattgatgattaattcttttctttcacataccctagtggaggtactggggaaacttccaaaaggagacaaagttcagacagaaaagagggtgagtaagtaatccaccacctgggaaacccctgataaaacaggcagtgattgtaaagattagcccagccctctgcctagggagggaggtggccacccgcagtgactggcaaggactgtcaggttctgttacttcacaaatatctcccccaccccctaggtcaaggtgctgctcttccttcctactgagccagaaccccatctctcaacagtcattgctttgagttgataacaaagcctacgtcatagactctagacaggtatcttaaaaaagctgaaaactttcctgtagaagggacaaagacctcgaagattatctcactttactttttccattgaataataagtgacttttaaaatttttcaaaaagggcctatgggctagatactgtgttaggcctgtctatacatgtatcatctaattcaatcagcagatcaatttataatcaaaacatcttagctagaacctcacaattacaagtacttccacatacattctctcatttgcttctcacaataagccttaaggaaggcaaggtaggagttatccccattttacaaaccaggaaactgaggcctactgccactttgtctggcttattggaacagacagcagcttccctggaagccacagagggactggctgtgtgtggagtggatatgaaggttttggttgagaatgtggcagccttgtgtccctggaagacagggtgctgaagaagggttttagggtaaggatgagggtcatgaatatgagagtggaaagataaactatgtctcacaacattgcctatggggagctctgtatgaatggcttcctcctttggctttctactttctcaatcctattcactccccaaaaccaaacccaagtcccacagatccaggaaacctttcttgattatctagcacaaagaaaccatacgtgtaacaccttaaggttttcccaggccttagctcattacaatattatgacatgcttttgagataggctttgccattctttttacaagtgagaaaaaggaagctcagagaggttaagtaacttgtcaggctgatacatttaataagcagcaaagtctggatttcaaactacatcacatcatagctgcctcaacttcctgtacacttatcatgtcctgtatcttgtcatgtgtttcttaattccttaactcagttgtaagttccccgagggcagacaactagtcttatatttctttgtaacccccatttctgttcccctagaacttagcagagtcctatgagcacacaagtcctcaataaacatcatatgttaaatatctgctgggtaggaacaataatgattaagtgggatttttttgatactctgaatattaggctctctgttgtatataattaaaacaagagtgaacaagaaatatataatttctcctagctctagtgtaatcaggcattcattatcatgtctaattctgtgttcagtgaaaagaactgcttagtaagcattttctttgatgaggataatcaaatacagatatcagagagatttaaaaaagacaaaatcatcaaacatatggagaggcaatgatctacagggtataatattccatctgagactaaagaactttcaaggcaaaaagaacacttgtttactttttgacaattggatattcaaggaacactaagagaggaagtcacggtgtaactgggatcttgtaccatcacacattattctttatcaagaagatggatgcactgtgctactgttctgggtgaggaacagagaaggagtacatttcaagggctattctgagagaaggggttttctctgagaccttttcagcatgtcagtcatttaggtaccaccttcgctggcaggcaaacttaatgaatatacatgcaatgcgcaactgattaccctgtcgggtctcttgctatttccctcccagtatatcatcagttatagttttggaaatacaaagagctcaaacagactcactgaaattagaatttttgatggtggggattagctcacatacttctaaattgacatttgataaactaggctgacaatagcagtgcctgtcaatcacattttcttgccaaacccatatattaatcttaagctgctgacaggcagagcttctgatttcctttatgtggtagataaagtgctacatccccatgtgttcaaccaacgtcaagcaagaagaacaaataccaggtttgtggtacctacatttgaatcctcatggctgtggccattggtctcgaccaattccttggtaccttttaactgcaaattttaaggaaaaacaacacaaaacaaaaaaatgaataagcaagcaaatctcttaagtatatcatcttgttaactgatttatctgaggttgcattttataaaacttccaatgagataaaacagatggagcacatatttctaatgagccttattggagccagtttgagaccaatattttatgaagtttgatgcctggcaaaagaataaatgggtcttggtcattattttttaaataataagattagaaagcagttccataggcataaaatgtataaaattggttcttaagaataataaatgatttcatttcctagttggattgctattaatttaaaccctgcagtgtttgcaagttgccaccagcaaaatgatgttatattaacgattattcgtgaatgatgcattttcagctgcttttaacatgctactgtgctaccagacaggtcctccttgagaatatatttgaatgactgacatctctggaggactaaagacggttgcttctttggtagagaaagagtttggatgacatctccttggccgctgaggcattagaagaaattatatttctctaatgagatttttagcagtgaacatttgaaaacatttctctttctcagaggcttaggagtaatcagttataaggaggtttcaggaaacctttaattgtcattttatcctatcctgacgcaaaacagacatttagaatcagacggcaaaggaagagggtgagctggcttgcaactgttttgccagtattttttcctgacttaggaaagcagcatctcctccattatcttttttatacctaatacaaagtattcatggtaggaaaaaatacttaagatttgaaagaaaatcaatgcacatataccaccaatgtgtttgattcataacattggttccttctggctacttgtgcatattaaaatgaaagcttctttagttttttaaggccagtcttaaactcccagcaaaaaaaagccctacccgctccatgccaaagaaggggttttgccaaaggaatggtaacatgaagaaattgaggatcaggtagttgattatggaccaaaggctctttggctcatttccatatcactcccacttaagaaaaaagtctgcccactgttctctagggcaacatcattgatggttctacacacaacagacacaggggagcatgggcgatgtatggcatatatgacaaggcagaggtgtgccacaataataggaatactgtctattatcacaggacacaaaaggactttttaaaatcccctcactcttttcctagctgagggtttcttattgtaggtatccctcatcttcatcaacctctctgctcatcccaccttaggtcctgtagcttgtgctcccatgagttcgagtggggttagctcagaaggtcttgttctttttcagcagaagtagaggactattttgtgaatgtctgttccacctttacgtgtttaccaacataaatgtgccagttgctctcctctcttttaaataaactccattcttcccattccatgatgtcctctaactctgctctcgctttttctgctcctgtttattctcccctcactccctgtctcctggcattgttcactccgctgtgctccattgccagaaccgtggaggaaacccctccccgctgcagcccacccctctccttcctcgagctgcagctccaggacagctgctgctttgttcttctctctgctccctgttcttctctcctttagctgctactctcccccaggtagggctgaacatcctgtctgatgaaactgaggtttgtgaacaagctccagaggtaggaagctatcctcattgtaaatgagatgaaaggcaggagtcagtggggcctggagggacctagaaaagctgcatcttcgcaaatgggaagactgagagcttaggggttagcgtggccttccctggaggggctggggcctgagggtgggaaaggtctgccctcaggacctatcctttcttgtcaggattcccagcacggggcaatcctgtgaatagcaacattccaaatctgcagagcagggtgtatctttccctgcatgtgtccatttgtttaggccacatctatgtgggcactgaaactgtttacgcatagagttactctacacaaatccaaagaaagcctcaaaggcagtggtcagtggaggtgagaggtgtcatcagtgcacatctgtgtgtgggtacagggacatggaaagaaacctgtaccctgcatggccccttttgcaagaaccaccaaggggtagcaggtgaggggctcttggacaaacagcttggtaatggcaccagcacccaaaaacatttggtgtcaggcttaaagattcttggtatctgtgcttgtaaagagctatcccattgaaattaatattgcagatttaaaattcttccttctcaattgtattttctaggtctttaatgattttagctgtttcgaatcttcttcacgttctcttttttttaaaataatggagagtgaagtgtgatgtttcacccataattgtgtgtgctctgctctttaaaaatgcatgccacaacaagatatatcaatactttcagcaaaactcagaatctatttttatgactagggtttggacttcaaaataaaggatttgagtcatttagagaaaagagaaattcacccctccccactctagtcaaagctatctaaaagaaaaaaaatcggggtgagagagcagaaaacaacaaaagctcagagctatatctggttgatttggagcaaatttggaccaactcagttccactttgctgggagtcttttcataatataacagtggaaagcacagtgatttcaggtctcctcaactgcaggtcattgtgaattcagtcaactagatttttcatttcaatctactatatctgaaatcatacagagtcagcctcagtacaagttactgaatctatattcatcatataaagataattattagttttataaagcattttcttccaaagctataaaggtttataaactaatatctgtacttttctctcacaaatcactcatacctttgggagaaaataactaaaaagatattttctggaccccaaaccattaaaaaaaaatcactcataaagtgacacagagctgactttatattttctcaaatgtcacctttgaagttatgtatacagtgtaaggttatttatacaatataaaacgattatgtgtatgaaaaatttaaaacaatctgcatttgattactcacagagggttggggtaactgtatgcaactttttccttcaaattaccattcatacattgttggcagcaagtgaaggccagaaataggaaggcatttcaagagctctcctggctcctctcatgtagatagtgggcttagatttcactctgctgcctgccgagtgttccatcttaccctgctgtaagacaatactttccaatccacttatcaatgtcaggccacacttttgtatcaaagaaagccagaatgaaatgatcaggtttacaaacttcatataaaaggtctgttgctcaccatggttagataagtaccctgatgcacagggaagatactttttaaatgttgctatgaatcagtccttgttcatgtgtctgcaggagtctcatgggttatgctgaactcattttcctcactgttagacttaagaggaaaccagctgcttactttgaaacatacctcattgccagtattttgaaactttatcgaaatttgattgtcttctggaagaaactttcacacaacactggcaggcttgggcaatctaaacaagtacaggagtgaggatagcgatgctgggaatgaggttataaattccgcatagcaaagctgctaggaagtttgacagggttcagactaattgtactgcagattactttcagtaaatgtttgcacgggtgacgcacaagggaggtatgcaatggggtgtttggactgattcataaatcagagctgtttcattcacttacttgttcctgcaggacttttagtaacgcttgtgtatgggactgctcttcctttgcttgttccaattctgactttttgttgtttaactcctcctggatggttagcaattgctgtgaaattaaaggatatttagcataagtaggattgaaggtcaggtgatttaaaaatatccacaatacccattcaaaattatgagtagaagatgtttacaagtcttgaagcttaattcagacctcagttgaccttgtgtgttttccgcactaagtatcaagggcattgcagttttgacacactttaggttgtttgtgatactgatgcacaaaacttgttttcatatttgtgaaggcatcattatattcctttgagcaaatgcctatttgtaaaactatataggatagtgctaatacattacattcatagatgaaaaaattataatatagtcaacttgtccaacgttgcttcatttcacatattacagtaaagctagctttacagtaactctataaagctactttgccaagtggctgggaccacaaaagatccttttactttctctgttatgatggtgatgttttattagatcagtaggactgaagtccaaactgcaatcaatatatcagctgagaaaactgctgatataaactgtcaaaacatcaagctatggcctacactgctatttttaagcagggccactgtatggatttttgtaagccctgagcttcccttgccctatcaactgtaactcatgtgaaggctttccttgtctgccaaaagcacagcgctgcgcagtgcgaattctttgggacatggtgatatgttaatatatacataggctggagaatacattcaagagctgcaaaaaggccctggaaacagctctgactattcagagcttcttgacaacaaaggactggttcgaaaagacagagtgcatttcttctgctactgtacataacaattgctgtactaatgatctggaaatgttagtggattcctgctatgaagagacctgtctccaatagccaggctacttcttcagggccttgacaagctggctgcagagctgcctggccagttcctaaccatcaaagcctggagaaacactggcactggatttctcaggcttaaacctaccaactggaaggattaaattaaatctccaaatctactggtttggggggattttgcagggtaggaagtactcagaaaaacacactgtgctttccctgggacttgcttgttctgctaactactgtggcactgggtataaatgtaagaacctactttggtcctgtagcataaacagtgatttcttgcaattttctaaaagctcagtgtgtcctatttcaccacctgcccatggaataatcaatcacatgtgaggtaatgtacacattccatatgcgctcacttaacaatttgtgggatttaattgtgcatcattgattaaagtacagaaaccaaggagcccattttgcactttggcacagtgacaagcacctacattgtgtccagaccgtggggaatggctctgttccttcattcacattcctgactggccctagaacagttccaaagggaactggtgccctgacttgggtaatgccgagtgaattttacttcatgagacgatttcaaatccaatccttaaatctcttttgaaaaatgagccaaatgaaagataggaagttgtcttcaaaggtaggtagctcatgtttgcttattgcagcacttgaggtggcaaaaccaaaaataactgatgtccagaagaagggaggtggacattaataatcgtgtatctgtatcatcagacactatgcagccatttaagatgaagttgcacaaatgtcttctaatgacacagaagaagctcaaaaagcactgctcagcaaaaaatacattcaggttacaaaatgtaactttgcagcatattcataggaaaggatctagatgctgtctctgggtgggtgggttcatgtatctttcttttttgcttgtcagttttctggtatatctgtaacacatactgctttagtaatgagaaaaaatcaaatgaatttaagatcggggaagaacaaagagaggaatactacttggacacctctctcagctattaccaatactgtgaataaataagagggagaagtgcattggagtcttcattgcatccgcacacttacaactcttccttctattaaaacacacacacacacacacacaagcatgtgtgtgcatatacacccctttctcttgaccactctttttcttttagcctccctcttatctcatccattcttggattcacactttttaaatgaaatgtcttccctctcatcagtgcttccttttcttcttatgtgtcagtgatgtagtgtctagatttttatttcaatgtgtttttccaaaacatatattgtcattgttttgtgtgtttttttatgtgatattatgtttcttattgtttgctatgttttaaattagcattatgtttttaagatccatccatgttactatttttttgttaatgaatttatttaaaaatctaatagattttccccttttattcccaaaatgtgctatacataaggaaactttgaaattcccttgagattttactgagcttgatttattattattttttattatactttaagttctgggatatatgtgcagaacgtgtaggtttgttacataggtatacacgttactattttatgtatctaatccatgcttctgatggggtatatccaccccattttacccaacccactctcacagtgaaggccattcagattaccccaattcttcccactgtatacaagcctgcaatggaatatgctagtgcaagttcccttatggccctgtgggaggatttccctgggatgcatatccagtggtggaactcttaggtaaaagagtgaatttggcaaagctgctctctgggatggttatgccagtctacctgcctgtcagtggtgtgtaagagctgctgtgctctactgaataataacactaaaagcattgttcggctttctaattgttgccagtttaatagaacaccaagattcttcatctttgaaaaattttgtacttctttgattccctgtgattttaagcatcttatatacttgctagctataggggtttatttataatttttaaaatagtcaagagcagtggttcttaattctgactctccattaacattatctgtgaagattttcaaaaaaatacttatttctgggcctgacacaagaccaattaactcagaatattgagaggtgggacccaggcactgaccatttttaaaacaccttcacaggtaattattctaatgtgtaactggggatgaaaaccactgtatcctgaaatgcttatttaatcttgcttatttaatcttcagtctactataatgtgactttaatccctagtactctactcagactgttctcactacagtcaccagtgccttgctaattgccagctagtattccaggttcttttcttctcactacacgctctctccaggggatcctattcacgcccatggctttaactacacatcacatgtgctggtgctttacaacactgcctttacagcctctgcctctttcttaccacctaccagacccttcacttcctgtgtttacaactgtgcccattagcacacctacccttcccaccccaaccagtctaaacgtctttccctggtaaccagagttaaaaccttgaagtcaacgctggccctttcatcaccttcacaacctctttgccggttccttgaccttttctccatcccatccttgctgtcatagtaaaggctaccatctcctctcctctgggtttttcctgttccccctgccatttacccgacactcctgagagagttgacttcccatgaattaaagtgctcccatgattaaaagtactgttaattctctaacccctatagataaaatctaaaccactaaactcatccttccccagacatgccagctgcttccatgacttatgacaagtttaccactcagaattctgcctggcttattcctactcattctttaagcaccacctcaaatgttgcttttggcccaagatcaactcagatgatgcctttgtaaaactgaaaagagccccatcctctctaggtagagacaatccctcaccaggcatatggttgggcactggctttgaggcttgatttcattcccacttacccctttggcctgctgctcttgtccagggcagaacctacactacgaaatgcggtagccttgggttcttgctccaaaaaaatattctctaatcactgaagcaaagttagttcatctatcttcttgctcccaaagcacttaattcaatataccacatttcatatctgtcttcccaaccagactacattcaccaatattaaggtcaatgattaggttacctctaatatataatagctgctgaatgaataaatgaataaatgaagggataaatgaatgtttgctcttgtttccccacttctatgggattaaaccatgatccaacaacaaacaataaaaaacccaccaaaacaacaaaaacaaaaacaaccccccaaaacacctgaggaatgataaactactaatgtattgttctaaacatatggatacataaaactttttgaggaaaacagcagtttcatttaagacattttgtttcattacctggcagttccagatatcctttttaatctgaaaagaaatatttctcaacaggctaaggaaatccaatcaatgaatttataattacgtaatttattcttcaagtttcaccacaataagaacaaaatcaccattatcagaaaaataaaatcactcctagactgttttctgcattctgcaaagttaatgtgctcttttgttttcaaggtataaactcataaactaatatttatatattcaaaacaatggtgattcaaaactgccactcttcatgtgactagaggtcctataaaaacggaggtagttcacaactagatgatttaagtcagcctttctggtctttttcacttgaaatttatgagtctctataatattctttccagtttgaatttttaagtactaaagtgcctcaattatagaagttcataagcagctagaacttaatcagaagagtctcttggttggattggctgatggcagcgtaattttaacatttgagagtgtggcattaaacagatgcactattacattctttggtggttacaatggagtgtgttccaattagacaattatccatatgccaatcaagtggaaacacttgggcggaccataagcaggtaaataaatgctgtacctgacacatcttgatatttccaggccactgatttaatgggatcatttgtaatgctctttggggatgcagacttcagtatgtaatgggtctttctttctgacaaattcaaagagcattacaaatgttatttggagccctagaataagtgaggtcacatttccatttttacagatgggagaatcatgggcacatagagattaaggtcatgctgtctgggagacacctaccacttgcacagttcaattttcctacctcaacccgtggtttctatcctggcaatcacactgcactgtgaatttggaatggaaatcagaacatgccaaacttaaaaatcctcctagcaacgacttctatctaaacattcatcatttccacttaggagccaggcttgttacagacatgcttttgtgtatacttctgtgagcggtgtgtcaaatttgacgtccctttaagaacaacaaccccttccttgtcttttttcttaaattgtataattttgttaccaaggtgaagtttttatatagttaacagactatgtaagtttggttccatgaaagtcatagatgacagtgcaaataccctatatgaaatacatcagccacatcttgttgtaagctgaaattcacaggattgtgattaattcaggaatctttggcaggatagtgtggggttaggagaacttctgtgggatggaggagtaagtaccctttctaaatttaggttggtggtgggtcaggtaaactaacacaaggtagatagatatagacagtgactgacaccaacacacacacacacacacacacacacatacacacaatttcttttcttcttctgtttcaggatttccccagtgcttggctctttgtttagttctaaaacaatctgctaatatttattcattcattcctttagtcaacactgagctcctgctgtgtgcatggtactgggctgggcaatgtgaaagatacagaggaaacaacagtaaatagcctctcctctagatgctgggtcacaaaaattcttacatgtacatgataactaagtcaggacaatacaaaggactcttacaatggctataactagtatggtttccataggaatccaggagatttctggggatcagtttaggggtcaggagaatgagctcaggggatccatcttgaatcataacttgttccacttattggaaatgagccactgaatattcacgataatctgggaatatttgaacccacagaatgttatcaatttaaattcaatgtgttttttactcttttggttcagttttaataactgttgttccatctctgtaactttgctataaatcagatgtcctactcagtgggataatcctttaaggctagcagagtatcacctaaggaaatgagccccagaggtttccaaagggaattctcaccaaaggcgatggtgggtgtgactgcgtctgatggtctcatcccagcagtccttttaacatttgctctacgtggcaatacccatgagtgtcccgccccatcctgcctctgtaaccctgttgccaacctgatttttcccagtattttggcctgcaatctgaactccacctgtgaccagctctgccagatccctgtcctactgtagagcttgagatggaagtatacaccccttaatcccctttctcttggtgggatcctgttacatcccaccgccccacagcttactgtgtcttcaggtctccccaggactctccagaccatccactgctccatcaagttttggttctcactgacttcagaactctttaggaatgtcagccttaggtcccgctgatgaggtctacctatgcttgttttccatctgacactgaatcctgagctaatccctgattgttagagaaagtttgagatttaaaaattcaagtgaacattatcacaacctaagagcaaggctttgcctaaaggcaaacacatctaacaggatttctgacaaaggagagagcctgtctctggggaaggacaatcatttgccacctggtatctacaatgctcacttttctccttggggaaaaaaagaattgaactagcttgaattttcttgttacatgggcttgtaagactactcaagatctattctagtttaaaacgtcatctgcttccacctggggatgaaactgcactcaatttacactaaggcatgagggtatccaagcctatggccagtgtattaaccctggtgcccccctccctgcctcaggcatggtgacccctgggggagaaacatctcttggagagaactccaccattcagacgactgataacaggaatcctggatcatggaaatgaaattgtgttcacagcctaatatgctattacactaggctatacatatttaattccttgggtctttcctcataaatcaattcctctaggcctttaatctcgtcaatatcttttctgatattgaattttaaatgccattctcattgctaggcagaaggcaatctctcattcatgatgagatcaggcttcatttatagctgagagatggtgggagcatggccctgttccctgaccctgctgttaagatcctaatgtcagctagaccgcacagccgaggtgcaggcctgcctgggttgatctctgagaggtcaagataatgaaccctggggtcatgcctatcattactctgggagcctgggacagctatggagaggagtgagaaagctcaagtaagtgtttccaagggtctggcttctcatgggggtgcctgaggcatgaaggaccctgctgcaccctgacctggcaaggatccctgtggaccgagtaaggcatgagctgaaggatgcacactgtgtgcgtacatctgagcaatgtctcccagcgcaggggtgaagggagggcacaggctgtgtgttcgctaggggaaaagagggcatggaggaactccagagaacaaggacttagagctgaaaatgtttccaggttccctagggctggcctggaatgcagtgggatttcctctgctgcagagaaaaggaaaaaaatccaagaatctttgagccatgaaaaatctccaaagggaggagtgagtttttttaggacctcaggaggcacagagaggttgagaaaacacaggaagccatctgagatacagatttgagggcctaagtctgcagcaagtggcggggcaccaaggacggggcctgggctacctgccttggtgtaggagttaagcaggtacaattgtacaaaatgtaaaaacaataataaaactaaaggtgtatccatctatcatcactatgcaccagcaattctaagcaaaatcattgataaaactctccttcctcataacaatcttttgctgatctaaattctaattgttgccattactgttaagatttaataatatgtatgtaatcttcaaattagcatattctgttgcttaccctttaacaaacattttatgtggcaactgatttggaaaatttctagctttatacagtctgccccagctctctctcacacatgacttagctgcacacatttgttctgatttgagcttgctttggatacagtgtctccagcctcctgtagcactacatatattctgcatttctatactagattcaaaataaacaatgacagcacagttttgcaaagacgatgaactagaacttgagctacttccattcatcccacaggaccactctgagaatttttatgtttaaaatttaaaacaatgaaacatttttagttggcaagtgaaaattttagttcatatgtgaaatatgtttacgtttcagtatttttaaaattgaaaattttctttatagattgcttgctttaaaactaaaagacaaatcaagaaaatgttacatcagagacacaatacttgcctaaattgtgccctttgcatttggttttattaatacttatgatttactggacaattatttatatacagcaatatgttaactataatcaagaatcaaagttctaactgttaggtaaagtaaagaaaactattgaatagatagttgcaattttttccttttatcacactatttaattttcttactggcataaatatacatgaagttcaaaagaaaaaaattttagtctgcatttctttcttggccattattattcattccattttatgataattaatgaaaataatgttgtctaaatttagaggaggaaatatttaaaaaaggatcctctgagtgttaaatttcactaggtgcacaattatcaggcagccagtgcctgagacggggagagtcatgaccttggcctgttgggctaggggctggggagaactgtttcatcagacaagattttagagaccatttcctttgcttgaatgtacccctgggagggactggtgtgaaagacagatgcttcgtggcattcccataatccactggagttattaatcatgatatactatatcccaatatggcaacattattctgaaaagaaatatagtcaaggactggcaaaaaggcaaaaatgaagctgcatgtcggcatttcaaaggctagcgtgattagctccattatcagcttgctgtgcaagcttgaacaagctactgctctggtctcctcttttccccaagccttctatccttacaactgccaaatgaggaattattgatcattcacaaagcaagatatcaatgaatttcttgactacagaacacagtaaaggtagatgtaaaagtggtttggaaggctctaaaatctattttctcttctacagatgattttcttaacactgtaatttgcagggtcatctcaggttcccgtttttcactttcttcacatgttaaataaatataagaatacttaccagtgggatattgtatgactaaagaacatgtgttaagtatgtgatgctccttgaatgacaaaaggtgcccgctgagttaaatgaaagtgctgtcattatcctctttgcaaaaatggaaacactaagtcccacgaggtgaagtgacatttaagtcatatgagtgggcagtactggggattaatattcagagagaaaggtcggttgttcagccccagcctagccatgctgggtgcactccttcagcccatgctgaaaacataggccagccaacttgaattaacaccattcatgcaattcacaagagaaggtgtcaaataccttgctgaagtaggaacatgtatcagtgacattctctcccttgcctttgctggcagttcttctgcaaatggtaatccaatttgcttggatttatttattcttatcagttttgttttttgcaattatgtgaggtggtcatcacccatcctctgggcacgtgtacagttgttaatgtagaaatttaaaatattaacatgctttccagccaggttggcccatttacttcaatcaaataagaacttgatggaacagctgggtcttgcactatgccctgaaggcctacagaaatttgttctttctttacagattttataacctagtcatgatcagagattacagctagaaaaacccctatgggtgacttgtagccaaagacctgtggccctctttggaggtaccttttgcaagcgatctgggcctcattcagtttaaccactggagaaccaaacaataacttgttttagcatcattaacaacagatattaccatcatcactagtctctttggttgcaggtttaggaaagaagcttttgccttaatcattatggaataagaatgtgttggagtccagagagcttttagttgaatcttaatggtgagagttgcaatgatctagcctgttttgcagatcagtgaagagagaaaatacagctgaaggtctgatccatcagccatagatgtctgactaaggatggaaaactttattatggatttagaaggtctgtatcacctatattacttaactcctgataattgtagaactttagtgaagttaatccaatgattacaatattcccaatttttctttgttaatacaagtaaacatttttacaactaggagaatcacacatttaggagcagggtaaagagagaagaatagctctgaacttagcacatttaatctttaggtggctctggaacaagatatgtaaataaatgggcacattcatcaatcactaagggaagtgagagggagaggaagtttgctccttcccccaaagtttccaagttatttaaacacatttaggctggtctggaacccaacattttaggaatgtcagagtaactagaacctttggaggtctccaagtttcacctatgccctaatccagggtcaagccctggataaactggtgagggctgcattagacaggaacagtttccccataggctttcaaccacctatagcaactactgaacctctgaactatctcagatttgccctgtctttgaacttcagactctctgtaaggaaaaataataataatagcagcagcagcagcagaaaacctcaacaaatactgccattgtgaaatgtgccacatattcttaatacctgctgctgaaatctatctggcaaaatacaatacagcaccaccatcttgcatagactccaaagtgtagaaaattatcatcttaaaccaatctcctctgcttcagaaacattaaatatagaaagcattaaagaagtgagccgagttagaccttttgcaataaatggtgtcagcatggccatgaatgataacagcaaaaaaggcctccaagatatgaaaattaagagaaattagagccccagcttcacacttattattaatatccacatgcctgtgatgaagtgctcctctagctttagcagtccccctactctcagttggcaattgcatacattttaacattgcatgtgatgtttacccgtgaaaatttccaatcacaagttttgctgaagtcatctgaaagtccagctgctcacagtgatggcacaaaaaagatgatcatttgtgatatatgggtatttaagttttcactgtagaaatacgggagggataacaccaaggttagtgttgatgacttttcaaaagggaagaatagggagaccacgtttttagggtctgctggtagactttatgtagcaatctttttctgcttccagggacaatttgaaaatgtaaatcatgatacaaagcaagtgacataaatcagttgcattctagtccaagtgattatatgaggattgaaagagattatatcgggattaatctgggaaggttaaaaaaatcacattttgtcactgaggttgctggggataacctttaacaggataagaaagttcctttctattccaagttgttaaaaccttcatttttcttggttgttttagtttaaaatcatgaatggatatttggtggccatcaaaatgtttgtattattctggttttgcctgttaatgagatctattacattgatagatttttcaaatgttgaacttaccttgcattcctagaataaatccaatttggtgatttataaaataccagattaattttgcttttctaaaggaattataaatctttgtttataactgagcctggcctataattttttgattttaacttttaactgtccttgttttatttcagtattaagtatactagccttacgaattagttggaaagtgtgtcttccttttgtgttctctgaatgagttagttaaagattggtattcttttttctttttttttttttgagacagggtcttgctctgttgcccaggctggaatgcagtggctcgactgcagcctcgacctcctaggctcaatgatcctcctgagtagctggaactaccggcatgtgccaccatgcctggctaatttttaaattttttatagagacagagttttgccattctacccaggctggtctcaaactcctgggctcaagggatctgcctgccttagcttcccaaagcgctgggattacaggcatgagccaccacacccacccttggtattatttttcttaaatgtttggtagaacttgcctataaagcaattttgggtctgttgctttgatataaaattttaagctattggccaggcgcggtggcttatgcctgtaatcccagcactttgggaggctgaggcgggtagatcacgaggtcaggagtttgagaccagtctggccaatatggtgacatgccatctctactaaaaaaatacaaaattagctgggcatgcacctgtagtcccagctgctcgggagctgaggcaggagaatcgcttgaacccagaaggcagaggttgcagtgagccgagatcacgccactgcattccagcctgggtgacagagcgagactcggtctcaagaaaagaaaaaaaaaaatttaagctattaattcgagctttcaatttctttccaattcagttttgattagttattttttcctattgaaatttgtctgtatctccaaagttaaaaaattgtcataaaactattcctaatattcttatatttctttagtctctgttgcatctatagttataccttatttttaatactgtttttaggttgttctctttttttcttgatacatgttgccaaagattttccattttattcatcttttcaaacatttggctgtgttgatcttctctattgtatggttggttgctattttagttatttttattctttgtattatcccctctactttgtgtttattattttttgtttgtttatttgagacaggatctcactctgttacccaggctggagaatacagcggtgtaatcatggctcactacagctttgacctcccaggctcaagggaattatcccacctcagcttcccagttatctgggaccacaggcacgtgctactatgcctagctaattaattttttttttttttgtacagatggggtctcagtatgttgaccaggctggtctcaaactcctgggctcaagcatatcctcccgccttggcctcccaaagtgttaaaattacaagtgttagcaactgtacctggcctatttttttttcaatagaaattggatgcttacctcactgttactagttttttttcctaaaacaaagttttaaatttttcctttaagttctgctttagctgcgtcccacaagttttgatatattatgttttaattatcaattacttctaagtatttttaagttaattctgatttctttttgaagctgtaaaaatgatgtatgttttaaactttccagatatacaaaatttattttagttatttttggcactgatttctaacaatttagtgtggtcaaaaaaatacaataccactcttttgacatctgttgagatttgctttaaggcctagtatgggattaatttttgtaaatgttcccagtatatttgaaaagtatgattttctttatatgtcctacatattgagcttatagtagtatatatttacaatgttatggacttcacagttaggcctttacaaaaacttcctgaaagtgaagttaagtggcactgaagataagaaatacaaaccgttaggaaagaaatataaacaccagagagaagaggacaaggtgcacggagaatgagagaacaaaatcatggcataccaccctatgtttaaatgactgaaaaatgtgtaacacactgactcagcaaatgactcagtataaaatgtaaatcatgggtggaaatatacatatcttaataccatgaatgagaattccaaagctggccaacgaaagccactctgactgaatctgagtgatacctggtttaaaataaattaagatggtaatggtggtggagggcataaaaaatagaatgcagttgtctggtgggtcagcaggatgaattaagagaacaaaaggaagaagaaaatatgataatttatttttatctctttgaaaagtcactgtgttggtctttcatttataagcgctacttattacactcttccttggaaacttactgacaaagttcaaatatactttcttctttattttcttccccagtaaataaggctgttgtggctatttgttaaaggtgtgtgtgtgtgtgtgtgtgtgtgtgtgtgtgtgtgtgtgtaagagagagaggggagataggaatagagacagagacacagagaagaaacagaaagcgcaaaaactggaaactggagaggtaatgagaggcaattataaaagaggagatagaaatatgtagagaaggagagtcagagacacagagagaagaaacagaaagtacaaaaaccagacagtaattaccagatggaagaagctgcacatagataagaacttgaccatgcagggtgtattcactgatcaattgagtgagatgggtggtctgtaaagtgaggaccagattgggcactaacttgtttaagtttcccttgatgactattcagggtgctttgttaaacagaggagaaaacatagtctttaactaaccatctaacatcttggaactgaattcccaattccacactttggttacaattccagacactttaactgactaagtttggctgttctattggccagtatttaaaaatgattaacactctatgtttatatatatatggagaaaaagactgaaaggctatatgtaaatgttagcaatagttatatctaggtagtgacattatgaatgatttttatttccttttatatggttcttttatgtttccaagttttgtgcattgagcataaattcttttgtaaaatgaaaaaataaaacaaaaatttaaatgacaaaccgagacccaggaaaactgctactcccacctatatttctcttcctctgtgctttctcttagtcatataagaaggattttttttgccgaggcaggcagatcacctgaggtcaggagttcgagaccagcctggccaacatggtgaaaccctgtctctactaaaaatacaaaaattagctaggcatggtggcaggcacctgtaatcctagcactcaggaggctgaggcaggagaatagaatagcttggacctggtaggcagaggctgcactgagccgagattgcgccactgcactccagcctgggtgacaagagtgagactctgtctcaaaaaaaaaaaaaaaaaaaaaagaggaattcccccctcttcttctttcttctttgttccaatgctgtatttctttgtccccccatcaaatttctccctgcattttcttcactgctttcatttctgatgagaaggaaattggctggtcttcctaatcctgttgcctctcctagccagctgcatagaggaaagccctggagcatgaagacccccaactgcggccggagttgaaatgggtaattacatcagtctggctgggagcaggacacctgctatagacagccaaccatgttgctggcagggttcagggcttcagtgtgaatgagtcggcttcttggcattggtagactagaaagaaatgaagtcaaagccagaccacaaggaatcattttagtgtccatagctggagggagaaagatgacaatggtcagcgtggtaggccagtatatgtctgcagcaaaagtccgctttgatgtattacatttaagaaaagatccatttcactataaatctcgtactcatcatgtgatatagactgtaagtcaggaggcagtttccaaaagaggcagtgaaagggaaggtcattcaaaggtcatttaaagactgccaggaacacagcgttgggaaaaggagagttcctttatcctgggaatggaagtctactggagagtcaggatttcccattgcagacatcagggaaagcagcaaaaagcagaagtcaaatgattttaatagtctgcagggcaatgccattatttttgcccctggctcctacattgatttgtctgctagcctcattattttgagaaggaatgattactaatgaggatgcatttgatgatcaaattaattaatggcagagcaggataactaatgatgagatgaagcctctcatagttaaattttattagggcttctcttccccttcccagaagtgaattcagagatttattttcatgattcaaatttaataaaagctgcatctatgttactttcctttcgcaggttcttgctctgctaatgcaaagaccaaattaggggctatgacacagagtcagaaaataggcaatgggtttttgccagtaatattttagcaatctatctccaagcatatgaaggagggaacttcttgtcttctgctgtcttgatgactgcagttctgaagcactgctttcagggtacactctggaaagccatggtgtggggttatagagggaacacaggggctcagacaggcctaggctgcagttctgactctacatggtgtacctgtgccctgggtcagtcacctgacacctctaggtctcagtttcctacttgacacactgggacagtcacatacccctgagttgttgtgaggaccgcataaaataacatgaaggtgcttttgtgagttaactggagagactggccttcctgttgtaaggggcattggagtaaacagcacaggccaccctgtgtcaggaaattatgacctagacttgtcccgactaactctgtgagcctgagtcttcttttaagcctcaacatcttttcatattttcacctggaatatggcaatgacagttcacacttgtgagtagcttttcaaaatgtcctcacgtacatgatcacatgtgatgtatgattttatcgtagcaagcccttactgaggttggaggcacctggtctccaggagaagaactggaggtccagacatcctgagtttcccaaagaagtacagaaaacaaacagtgaagctgaagtcacattttccttctactagttcagtgttttcatttcattattcatgcccttaggtggcatcagtacggcttatcttcttcctcatcttatgacctctggtcagtgaagacggcaagatactcagtgggccatcctcactcaaaactgctaaaaaacatataaggaggcttcctctcatcttcatttttagtctttgtatcttgtccagaatcaaaaggaaaagtgctctgaaaagtcccaaacctcttacagatgtcatgtgtgatcctttcaaacaggtagggctttgtaatgtaaagccctgggccgagaattggagaattggtttctatttctggttccaaatggagccaaccgttccttcaagagtctcacactgaagtgagatacttaccttcttaggatgtaccaggagtgtaatctgcaaatgtcagaaaatgcacacactgccagcaggaaccctacaaatgaccttgaacagcctaaagaaaggtgccaaggaattatgaggattatcatcttgtggcctgttattataatgcaccatcccaatattcttggccgaggaatggataaaaaatgaaattacaaaccctggaatagttaaaggaagaccatggtggaccccaaatttggcaactcttgtgaaccttgatgtttaagtcactaaacctttttaaagccgtgtaatctgagagatgtacatgttttaagatttttctgattctagtaaaatgtcggtggcttttaatatgaatgtgggaaatgtcttctgcatttcccacagccatattctattctatcctattcagaaagaaagaaacttaatctgggttgtcgaagaatcagataaacatggggtatgtctttgcagccacagcttgtaaagactccaggtttttatatgtgtatgtctatttatacatacacatatttattttttgagctttttaaagctgaatatttgactacttgtacatgagagtctaagagaaaactcctttctctacactgttaataagattttcttgccctgtccagtgatactgaattattttctgcactaatgtataatctgtcatatattaaagatattaggatatcattcttcctgaatgagccaataaccagatcattgtgtatgggctattccttccttctaattgaacatttttgaggctcatgaactctacttagaaggtagatcctcctgatacattgcaacttaatttccaaactttctatctttagtttttttttacattctacatctaagtatttacatctttcataatggctcttaaaattagtaaagtttcaggatacaataactgtgtacaaaaatcagtagcacttctattcaccaacaacatccaggctgagagtgaaatcaagaatacaaccctacttacaatagccacgaagaagataaaatacctaggaatacagctaaccaaggaggcgaaagatctctacaaggagaactatgaaacactgctaaaacaaatcagagacaacacaaataaatggaaaaacacttcatgctcatgggttggaagaatcaatgtcataacaatgttcatactgccaaaggaatttacagattcaccactattcctatcaaattactaatgtcattctttacagaattaaggaaaactattataaaattcatatggaaccaaaaagagccccaaacaaccaaagcaactctaagccaaaagaacaaagccagaagcatcacactacctgacttcaaactatatactaaaaaaccacagcaaccaaaacagcatggtactggtacaaaaacagacacctagaccaatggaatacaacagaaaactgagaaacaaagatacacacttaacaaccatctaatatttgacaggactgacaaaaacaagcaatggggaaaggactctctgttcaataaatggttataggataactgactagccttagacagaagattgaagctggactcctaacctttcactgtctacaaaaattattaactcaaaaccggtcaaagatttaaatgcaagacctcaaactataaaaatcctagaagccaatctggaaattctcttctcgactttggcattggcaaagattttttggctgagtccccaaaagcaattgtaacaaaaccaaaaatagacaagtgggacctaattaaactaaagagcttctgcaaagaaaaagaaactatcaacagagtaaacagacaacctacacagagtgggagaagatattcacaaactatgcagctgacaaaggcctaatacccacaatctctagggaacttaaatcaacaagcaaaagccaaataaccccattaaaaaatggacaaggcacatgaacagatacttctcaaaagaagacacacaaatggtcaacaaacatatgaaaaaatgctcagcatcactaatcatcagagaaatacaaagcaaaaccacgaagagataccatctcacaccagtcagaatggttatcattaaaaaagtcaaaaacaacagatgctggtgaggatatggagaaaagggaacacttatacactgttggtaggaatataaattagtaaagccactgtggaaagcagtctggagatttctcaaagaacttaaaacagagctatcattcgacccagcaaggccattactgcgtgtatacgtaaaggcaaagaaatcattctaccaaaaagacacatgcactcacatgttcattgctatgctattcacaataggaaagacacagaagcaacctaggtgcccataaatgataaatttgataaggaagatgggatatacatatatatatatatatacacacacacataccacagaatacaactacaaccataaaaaagaatgaaatcatgtcctttgcagtaacagggatgtagttggaggccttaatcctaaacaagttaacatagtaacaggaaaccaaatactgcatcttctcaattataagtgggagctaaacactgagtacacatggacataaatatgggagcgacagacactgtgggctgctataggggagagagggagaagggcacggctgctggatactatgctcactacccaggtgatgggatctgtacgctaaacctcagcatcacgcaatattcccatgtaacaaatctgcacatgtaccctctgtatctaaaatagaagttgaggctgggtgcagcggctcccgcctgtaattccagtactttgggaggttgaggcgggcagatcacttgagatcgggagttcaagaccagcctggccaacatggtgaaaccccgtctctacaaaaaatacaaaaattaaccaggcgcagtgacacacgcctgtagtcccagctactcaggaggctgagacaagagaatcacctgaacctgggaggtggaggttgcagtgagctgagatcacaccactgtactccagcctgggcaacagagtgagactccatctcaaaaaaataaaaataaaagttgaaaaaaatttttaaaagctcttagaatacaatttatcattaccaaatgttgaatttttcttttaaaggggtttctctttttccatttttcttgtccttctatgcttgtgcattttcctttgaaagcggtttttaactggagaggaagaactgtttgttcttctgcatccctcactacttctgcacatccttcccatccctgtgtctggaacggactctactgttctgtgtcctgcacatgcatgggggcttaggcgtgccctgctctggaccattagtcctgccaccttctcttctagaacagggaaacagaaatagtgtggagagcaagttcactatctatctttgttccatatttcaacctcttcatgtcaccttttcctatttgtcttcctttctcactttcagaaactattttactttgtgcatctgcctcttcttgctgattcagctatcttcactccaaagtgtgccaccttaagttcccttgtccttcctcctagacattcatgaacctgcttgctgttcctcctttctctatatgtttccgggcagccagaacaatttgcaatactctccatgcttcccactgcaccacttccccctgccccaccccagccacatggtaaccaagaattcattcaaagactgggttaaaggtaaaggcccccgaaacaggctcctgttcaagatgtcagaggcaatgtatgtgtttgtattttcttcctccagagactcaattaaaatatctgtcaatgaataaacttacaaaaacaaggagaaaggaaagtgagttccaggagttcctagtgtatgacaggttctggcattcaagggatccccacatctccttaaaatgaagcctgcctgtcaaagagctcttggctggccactgcccaggagaaagactcggccacgcagcagatccagacacagcaatgagcaaagccacagagcttcacagaaaagcaaaccaagccctccacacctaaatatacacagactgccagccatcaccttgctcatgaagaaacctgtacataaaagagagagactgaaacacaatagctaaacaactaatcctggagtaaagagagatgattcaggaaccacaaagatcttaaaaatcctacttagtattcttaaaaagatttgagaagatactgcacccataaaatacgaataagattgcatgagaagataatgattagaggacaaaataacctcttgaaaataaaataatatgattaccaagcagaaacttcaattggaaggatcaaagataaagttaaaatggaagatactaggaaaaagatgatgggcatggagcgcccacctattaggtccattatctgactggtgggtatttcagatagaaattaaaaacagaagacaaaagtgaaaaatgatcaagaaaaaggaaagcctcctgtcacaaactctggtgacactctgtgctcctgcctgcagccctgcatttgctcagttctctggagcactaccttctgaagttggctgggagcatctggtctgctgcacttttgaggctttccacaatttttaagggacaaggtttaaaaaaaaaaaccctataaaatattagtgaatatgctcattttatctctttccctaaagctttctaatcattaaaagcaccaataatgctaccacagcctccttcaccaccatagccaccaacacagccatagccaccgttgccactatggccccttcaccaccatagtcatcatcctcaccataactacccttcatcaccacagccaacattaccatcacagtcaccatttctaccccagtcaccatcttcatcacagccacctttaacaccatcctcaccatggccatcaccacaaccacagccactagccccaacatggccaccttctccaccaaagtcaccatccttgccacagctgcctccatcaccacaaccaacattagcatcagagtcaccatccccaccacagccaccttcaccatcacagccaccaacacaaccacagccaccatcctcaccatggctgccttcattaccacagccactacagccattttcactaccatagccaccattctcaccacagccagcaacacaactgaggttaccacccccctcacagatgccttcatcactacagttgacattaccattagtcaccatcctctcactacagtcaccgtcactaccacagtcaccacagctacctttaccaccatagctaataaggccaccacagccagcacccccaccacggccatcttcaccaccatagttaccttcacaagcacagttaccttctccaccacagctaccttcatcaccacccccaccatagtcaccaaaacaaccacagctaccatcctcaccacaatcaccctcacctccagagccaatatcactactgcagtcacctttaccaccatggcaaccatcacctccacagtcccttcatctccagagccaccatcaccaccacccctaacattattatgatcttgattttgacatataacatcagacttaattacatgtgagttttggggaggaattgagtgcaagcttttctctttctctaaaaaaaacgtacttactaagcaactaaatagtttaaacaagattgcagaagacatgctgaacttacccaaggggtcagatgtaatcactatgtttaatttcaaaaatactttcatttattccttagcagatattccaaagtctgactcttacccaacatctgacaaaactaactggggttactttgtattttaggaaagtagtaatgttatatttcttcatcttccataaaattagtctaagtgggtgagattttaacaatgcatacacagaaaatcacacatatgttctactttgagtataaagaaaaaaatgcttgtcacttaatttctaaaatgcttttgatcataatcatcctacttttcccattttttttttcctgatcttcccttgctgaaagttgtcaagacagtggaccaggcctgcaccttactaatgtcaagctaagagtgtgagagagactgctccacatgggccactggcttgctggcctaagacagctggtcttcagactagatttaacactgttcaaaagcatcggcttatttaggaaggagccctttgacataatcatcattagtcatacgcacttttatgatcagcagtttttaatggtatcctgcagttatccaaatatttattagtcctgtcaatatgatttacacaaggcttcaaaaagaattctgatttttaagcggattattaaaaaattatgacatgttgacctatcctcatgaatgaaaataaaaatactgcaaatttgtgtgtaaataaaaccataatgagatatcactataaatttactacagtagtgaaaaaagacaaactgaccatgccagtgctgcctgatgaggatgcagaactggagtttgcagacagtcccgagggaatgcatgatggtacagacgcttgggaaaagagtttggcggtttctctgaaagtaaaacacacttgccatatgacccaacaatcacattcctaggatttactcaagtaaaatgaaaaattatgtctacacaaaaagcctgtaagtgaatgtttatagcagatttattcccatttgtcctaaactggaaactatccatccactaactattgactagacaaacaaaccacagctctttcttacggtggaatactgctcagcatcagaaggaatgaatgcctgatacgtacagcatcatggatcagtcttagattcattatgctaaagaaagaagcccaactcaacaggttgcctactgttcaattccccttatatgatattctggaaaaataaaagctataagggtagaaaacagagcagtggttgctgggagtggggctgactcaaaaggggcaagaggcagcgagtgctggaactgatttatatattgattgtggtagtggtggttacgtgactgtatgcatttgtcaaacttcatagaaggtatgtctaaaaagaatatatttcattgtatgtaaattttacctcaataaacctaacgaaagaattcagtgtggtaacctgaagaaaaataagagtttaaaatatgtatagtctttacttgtacacctaaaagtacaaatgaaagtcaaaagcctcactatccctgtggcagagacaggttaacttcactgccagtttaagatcaggtaaaggctaccgtgttaccatggatacaagctcttattctcttttgtatgaaacctttcatattattaaattgtgactcacatggtgcaggggtaaactcggaaacttccagacaaagtcacccaagagtttttccatgttaggaaccctgcccatagtgttttcttcatgaacacatgcaaaactgtgtgatgtcagtgaacatatccttaaggggttaaagaaagaaaggttagaaaatttttggctaaactgaaggcgattccaaaagctgtctgctagtcctaaggtcattaaggctctttctttttttgttgtttgttacagaaataatttcccaaacatagactggaaatggtgacatatgggaggctgacccctcctctctctgtcatctttcatgtgaaaccatgattttctgatttatacagtggatagtgtggagattgaaggcaggttttaaagtcaggctaattctttgtggtgggattcaaattagcaaattgtggtcatttattcatacaaggtagatcatgatagaaacaagactttaaaaagcacttatattttaaaactctgtaaaagatgttctgccacagagatagccatacaccgcctaacaaccagtaaacattaacatcatagcagccaccggggacccagtgctttctgtaggttaaagaggcacacctctcaggccttggctctcccgctccctgtcttgctcttcatgatccaggatcccacacagcccagagctcccataggcaccatgctaggcttgcctccaggtctttgtctattcattccctcatttgacacagatattttgactgtctactacgtgtctgttatggattgaattgtgccctgccccccagccccaaatccaaatgttgaagtcctagcccctactaccacagaatgtgaccttatctggaaataagtctttgcagatataagtaattaagatgaggtcatcctggagcagagtggacccctaatcctacatgaacagtgtatttataaaaagcagaaatttggacacacacacacggagaatgacaagggatgatgaaggcagagagcagggtgatgtttccacaagtcaaggaaggccaaagatttccagccaacctccagaatctgggagagaggcaggagtcagactcttccttacagcctcagaaggaaccacccctgcttttggaccctagatcttggacttgtagccttcagaactgtgagacaatacatttctgtctcaactacatttttagctatataaagtacatttcctactgacaaggagattctgaaaagttatgagaagctcccttaactgaatccctccatcaggaggatggctcaggtggtgatttggaacactgctcctttgtggaccaggcacgtggctcctcagtgcttctgcaaccctgactgagcagctcaccctcgcctcctctgacttcttttaggtttgaatttgcaataacctaaaagactttatacacttttaaagcaactgggataatcttttctagagggagaaagggagagttgtgtaaagtgtgacatagtggcttttgggctaggtctggcgtcatggtctttggggaaatcgacggcctctcatcttggcgagggtgccaacaaacacccaatgttggggcacatggacaaccccagaagtctcacacagcagctgttacatcgattttcaagtacagagacttgagcaataactgtaatgacattttcctggctggctctgacctctgaatctcactgattagtctaacacacactgtgaacatcaaccagttaggactctaagccaagactcaaaaattgctttaaaatggcagaagatgtttaagatataatttgtacgagttggttattaacttgttcacttcccaatccgtgattcttttttatactctccctctcaattatttttccctgttaggttgatgtatctgtagtagttacctctaatcactaagatacttctgtaggcaatccatgctctggatgttacagagcagtcaatatggatgggggaattaaaaaaaattgactctatatattttaactttccatcattctacttatatttcccttgtttaaataaaaacaatcttttttttttcagaaaatattgattggatttgtatattcagagggataatttaaaaatacccatgatgataatatatgctctgttattctaaggtaactcaaaggcccaaacaccttaagaatatcaggtaccaattgacgttttcagatacaaatctgactgtgaatctttgactctattccctcactgccaacagtcagattttcccctcctgtcgacattttatatcccacagtacctgttccttttccctactccaaagccctcaactttcatttcctttttaacaattgccataaatatacatctttaaattcagtatgccaggatgaggtctggcactcttcaacaaaaacacagctattgccctgtttctaaagttatttatcccccaaaactctgatgcttcatgtattccatcaacaaacacttcttaaacacgtaatgtgctcaaagaacctgactagatcctaagtgtaatacagaaaaagtggaaacaatataatttacatttacactaaccttgaagacagacaaacaaactgcttttgtaaaatcagttgtcgtgctttgaagttaaaagttctaagattacaaaatgcttgtatcatgcagggatctgctaggtatttgccatggggctatatttcacatgcagcctttcaatctcctaaatccaaatcattttcctttatttcctacctccagggtgatttcttcaacatattttattggcttggcttttctccagattctacccttccacaaacagtcattagcacttttctgtcctagtaacatagctttttggttgtcatttcttctccttcaccctttccagcacacggctgcctttccattttcatttaatacacatatctctttctctcaaaaaaaaaaaaaaaatctgggccaggtacctgctgcatgccttgcatggtttgctgcagaaactgcagttgctggtccttggtgaggttttcttctgttcggaaaagctgttctttttcttgtttcagcagctccacctcattcctgtaggcatccagctgccagcggagactgtcattctcctctttcagagcgtaggcctgggcagccagggctgagggacaaacagaacgagttcaggtgagctaccttcttgcttagcttgaggaggccttctgtgggaaagggagtctgtcacccaagttcttaatgtttgtaccagctcagaaataaaagcaaaatgccactccctgggcctctcttttgtagtcggtatgcatcacttctctcggaacttttatctattctgtttgtcctgtcttacatgtgaatgtttcttatgggcacaggattaattcctcccaaattctcatcccttgacctctccctcaatgctagacaccctcacagacattggtatgtggtgctaggtggtgacaacatttagaattccaggcaacaatcatatctactaaatattgtcttccccctttctacgggattgcttagctacttggagggctgcttgctttcaaataatcagcagttccacaggttgagacatgcggcagcatcccaggggagagaggaaattatatgcacaccactccttcctgctctactgctgggacaaattgcacagattgttttcctccaactcctatcagaatgggaagctagttccatctgtttcaccaacagattaaaactcttttcctctacaaggctgagtggttactctaatacctctccctgaaaccccaaattctccacatttagattcagacttcattcatatgtctatcttattaagaaaccaagacagttaactcagggtctcacacatctcaaggcttcagaaatagccgaaactgaaaaagaaacaaatggtaccaaacaaagattgagggtagggaaatccctttccctagtttctaccttattgcttaggggtctctccgaaaatcaacatagcctgctgagcactcataaagcactggatcaagagctttgtatgaactcactcacttcatacccccaccaagcctgtgatgccggtgctggtcttatgctcatctttacagatgagaaaaatgtggcacagagaagttatgtaactcatccaatcccacaaagtaagtagcagaaagccttcacacccaggctgcaggctccagagtctctgctctcgattaccatcggtccatgtgtttagttcttaccaggctgttcaaaaccagtctcacattcccccaccaactctcccaccactctccctttaatcttccccctcacagaaaagccattccccacttgtgtaagcaagagaaaagtgaaagaaaatttgaaacgcttgttaccagaaacttcaaacatgtaacttccagtagataagggcacggtgtggagcccactgcacaccaggtcgtcagtgcatgcgcgtttccagcccccgctccccgtgtcagaggaccaaatcaaggtcgcctcctgagtgttctacctgcacattacagttccatggtgataaagctttactgaggttctctgagaccacagtgaattctctcctcaaatatcaaatgtcaaattatgttaataatagttttatagttgagtgttttacagtactccatcttgcaaaatgataatctctgtgtagtacacactgaactactaatcagacagaacatgcaattacccagaaatttccctacctcaagccagtagggatcaattacttaacacgcatttacttcatatttactgtgctcaggtccgtgagggcatctcagaccacaaaaagaggagacagaatacatctcttctctcaaagagcttaatctagtagaaactgacacatttaaaaagaaactattgctttcaaaggaagaaaggatagtgtgatgtctggaatacagcagacactcaataaatgttggttgaatgaataaatgaataaataaatgagtcgagatgcatgacaaaaaaatgcatcctataggagttcagagaagagaaataaaaattcagactgaaggaataaaagagggctttggaagatgaaaaccccaagaacttggaaaggatgtctctcagtcagaagccagagcataagcaaaagcccagatatgaaaatcaaaggtagaacacttggggcaagaaggagagaaactcgaccaaaagccaagtgtttgcctggaagcagtgagagaaagggaatccacgtcaggtgatgggagaagatggggaaggttaggttcaatggagtggccaattgagaaccactgacagcgcttggagtagtggaaggacatgatgaaattgggatttaggaacattagtttggcaatggtgcatggaatgaactggaggctgaagagaatgaataaaggagatttcatttggtgtatgtgtgtgcaaaaccaaggagcagccacttttacagttttcagagacctactcataaaatcagaaattatccagcacataacccgcagcatgagccagtgctttttaacattgtgcagcccagcttcagatcttgtccacaccctgagataccacctcctgacagctccgtttaccaagccataaggaaatggttatgaggattcatttgtgagagggatgttgtaatagggcaaaatcacagaaaatgcaaatgatgaagaaagtgttggcactgcataggcacattactacatttagtagcattcaaagacacttaagtcatttccttaggaagctctatttggccctttttcaattcagagtggcatttttattatcataactgatagcaggtgtttgtgaagaaatcgattagtacgcagggatggaaattacattttccaaatgaattgcatagtctgcaagatatgctgaaatctgtatagcaaaatgcaagcagctataaagcatgtgccaacagcattatttaaataaattatctgaacataaatacatataggaaagtgtaccatccattattttaggggatctcttacaaacctatggaatggtactgctgagagttcttattcttggctaagccaagtgactacagtgcctgccaagcagtatataatattgtttgcattcccggaataggaatgtgatatcatcatattaaaaaaacccacaacagctgtaattcccccaccaaaaaaaaaaaaaaaatcaataccatagcaaattccatcaacatttttataattggggcacataactgatttacattcctgattaaatgatttcaagcttggtttttacaaaaaaattttcgttactcatgtggcagcaagtagttatcttctaaagggtgagaaattgtatattgactccacttagcttcaggccacctgtttgtaaacaccactcagtgtcatactgcagccctgaatctattcctcagacaaggctgcctggaagaggctatattatgtttcttgggccagagcgctaacagaaaaaaaatcctaataatttctgacttaatataacttctcagtatattaaaaattcagaaattggaaagggaaactttttatttctctctcttctctttctttctttctggaatactgtactaaattaaagagttttgaaaaaatgtgtcatcaagcttccataataaaatttaccttatgagactgcacaatgaatccactatccaaataagtataaggattaaaaaaaaaaaaagtacagtgtgcatctttcggtaggaattcctaaggagtgcaccgagtgccaataaatggaatatgtaagagacaccccatgtggattaccaatttccgataataaaaaaagaatagaattagacaccttaaatgtcaaccggactgaatgtgattaaatattttgttggtgattttaaaggcactgctgaatctagtggtgcctctggattaccatcaattaattcaccagccacccatttatgtatttattaagaaaacatggtgaggagctgtagcattcacaagaagcttaaggccagcacagtcacccatttctagttactcagtaatttagaaaaattctgaatactggaattttctgattggatcaaaaatgaaataataaaattggaaaaattttgctaggcaagattgttatacttcaaaacttagcactagactaaaaaatgaccaaagtgacactaatgtatgaaaatcaatccaaaggttgaacggcactgctgaagaaaaggcttaaaggtattgcggcatcttgttatattctttactagattctatataaaccattattctttatattaattatggtcaaagtgacctcctcttctgtctcctgtcttactgtgtttccatgggaacagataatgccatgcttaacttctttaagtaaataatctggagaaagccttgaaatctcttttaccagcctgagccagcctcagaaaaatagttagcaatatatgaaaaatgtaagttgttttgggttatgtcccagtaagctgacagtctgttaatatctttttcatgctcaggcaagatgtaactaaataataaaacattttaacatatcgtttctaacaatatctgtgtttctccagaactcttagtctttgtgtgtttggggaactctgtgtttaacattccccctccactttgccagatgtcctcctgaaatgctggaaggacgctgctgaactgtagatttccttcccacatgcaaagaaagtctttttcaagaatttcattggctgctacccaggaaggcagttgtaccgatagcccctgaacacaggagggcagaggcaggctggcctggcaaatgtcaccacaatatctgtgtgccttcaacggctgcctcctcagccacgatcctgcctcctgctccactaggaaagggagctgtagttatggcccagtgacagggactctctccagcttctatctgcttctctgcattctgaatcttcttgtgaggtgccttgaggcctttagaagctattctgtggcagagacattatcacgctgtgtactcaaactcatgcttctctttgtatagagcagtgttgctcctgagaggtgactgccctagagggtgccatgtgagcagtctcatcaatggagtgtgagggggagtgaggatgccttctgcacagtccctcagtctctgcctgctgctggaataggcttgggtctctgagtcaccacatggaggaaaggtgcccacaggcccagaatatctgccttggactgttgtgtgcccaaaaagtaacacttttttttttggttaggccatctttatacagcagctggtgttactctaacccagtgttctccaaacattggcctgcattacaagctcctggcgggcatattaaaacacacttttctgggccctaccctcagtttccagttcagtttgtctgggaggaagcccaagaattagcattcttccaagtcccccaggtggtgctgatgctgctggtgcagagaccacactttgagagccactgctcagaccgctgctcattctatcccgattcctaaactggggttgtggttggcttgtttggagaaatgcttctgaaagaaccacatgcttggcttgtcattctggttttattccttgatctccttttgtatgagccccgactccatgttctgcacctgggaaggcagccctgttgcatccctgtgcccaggtcccatgagctcagcttgccccgtgccctggctatctcctatggaagatttgggcaaaaggcacagtcactattctgctttcttcaaataacagtagcagtaatgggaatagcaacagtggtagtgacagctaatgatttttatgtgccaggcactgaggtaagcatattctttacacagtatcctttcaccatcatgaaaacatgatacagtcaatatgattattatttctattttccagatgatggaagtgagtttatgggagacagaggttgctggttggaggtaaaaggtgtggctctaggactatattcctccatgtaatgccaccaggctagcttagctccatgtaagtgccgcccatcccagagaaaggagtaaaccagggaccctactgtagtggctagtttgctcctaacagaagtaaaacattcaatttctggctctatctggggagtgttctgctggagagagactctgctatgaaagcagagaggatgatcctgttttaaaataaacatgcaggtattttctgcaggacaaacttggggatgatttatggagaagttaaactcactcttcaggaaatcttgaggcctggctggaaccacttagggatcctactttctgccctgtgtccctctcctctcaaacggccacactgatacccactaatcccagagctcaagagcctgagttgctaataatgctttattgagagagttttgtccatagacccatgctgatctcaggattcccaaagatccagtatgagactattcaccccatccatctgaactcacctatgtttgatttttaaggtgtctgtgccttcagttagaataaaggtgacagaaactcctctgcgttatgctgacctcccatgaactctgtcccctgagtctactttgcttgggctaatgaaggccaaagacaaggaccagtaccatgtcagaagattaacagaggcttggggtccttcatcattggtagcctcattctcagtggctgctgttgccatcagtgcctcccagtggccaggcacagagctggaaagtatcctaggatgacatctgccaacagccagtctcctgctggagagcctcttatggtaccaacaaagtacaattgatctgcttttcaataatacctgtatcaccactgatcaatcttcctcaaattgctcacggaaatttcttctgctacatttttgcaggattattattattacaacttagcattgacataacatttcatatgtgcagtgtgtattcgaatctgcacattagctattattagggaaagctaaacagaagcacaatgcagtgtctatttccatctttgtgtgaggccagcggaataagggtaatttcgggagtgcagggtaagctagatcctgttacgatgatggcttaaatgtgagtctggaggcacaatgggcagcaggtgactcaggaaaaaaaaattctctgctccttcctccagagagctcttcctgaggaagtactctgcaccagcagcagaactaggaggtgctgctgggctgctgccactatggagacttcacatcatgcctcatcacttttccatttacattactatcctctgctccgacccaaaaccatccccattttcctcagaggaaaataagcaaaggaaagagacatgttcacttcttgcaaaagcaggataagtctgtcatttaaaacactgttgaaggatgctctgtcaggtgaggatgcctttagagtcctccgggaaacacatcagaagtgaacgctgcaagcatgagctgagctccctactctaagccaagccggggacagggcagggaagcagagctctcagcccctgcccagcctggcctgcgcagctcccagcccagccgcaggaagagctacagatatggaacctggtagaaactggttagaagggctccaggaggggccatcctcacactgtgtagtgggagtcaaataagggagagaaggcttctggctggaacataagagctgggggaggctctttatggaaggcagtggttgagctcacacattgaaaagctgaaggaaagcagagtgggactgctgcacagtggacactgctttaccaaaagattcggcgatctccaggaggatgtgccatggctatggagaggcgagcaggctgcttcctactgagccccaaggccaggcaggagcatctcaggagggggcacttttccccactcttccttttcttttaattcgattttagttttctttttcactttcagtccctattttgatttccaagattatagggccatttaaaaaaaatcttctaaaggctttaaagattcttttttaggaaagtcaggcttagctaagccaagctagacaataaaatgacactggctttcaggaattgtaccccctcccctgcagacagtgcacctcccttgggtgtagtactccaccatgggcttggctctgtgtgacttcatcctaactgacagtagttggtcttggccaaagacagaaactttaaacagcaatccttccctccaaaacaactcctctcattttctcaccaatctacagtataaaagcagtgatctctttttcctcccatcttacaaatgtccttcctttttaacaagtggtcatttctaattttcatcaagaaactttccccttaagaagtgtatttcccctctcctgctctaccctctacatagaaacacacacacgcacacacacagttatattagtatttgaattggtgcttctaccatataaaacacatccacactatgaaatgtgaaatgatggccagctcaaacctaaagtatatcttctcagttctatgcattgctctttgcaaggagtagcatctttttttgtaaagtttttattttatagtgccaaatacttgcaataatgggttgaacagaaaactttttttgaaagttacttccgccttaggtaaaccctaactatccagactagtaagtgggcaccaagacttcacttttatgcttgggcaatgactctgcttgggctgtctctgagcctcctcctccccactgttctcattaccaacattgaaattgacttatgaacacttacttgtgtctggcaataggatagaaagtatctgcatcctctctaaatgtataaccaaggtgggaggacccagtatgaacaggtagctggcatcttgaggtatctgtaccactttggtatctcttaaatgagaaacctgggactcatcccagatgttacgaatctgagattctggaatggggcccagggatgtgcctttcagcaagtttctagggtgattctgatgcatgccaacattttagagccacctccctggcctttagggaccaggtccccacttcctaatgctttcttcatgactttcttctagtcttagatttctttcattagtttttcatatttgctttctttcagccttttccaacagctgaaaggaccttctctcctgcttttacaacccaacacagccttctgggcttctctgcctctgccatgtcttctcacattccattaacctatcggcctgctccttgctgaatgctacctcctgcctctccaggaatgacactgtgactgaatgcttgcgtaaatcctacaggcagtgtctccaaaacacattgtcctcaactgctcgatgttgttgtgcattacttttctttgcagccatatgtctggagaaagtttctgctatggcaggcttgtggcttgcacccaggagaggccaggctgaacctctggaactaattgcccttgaccgggccccgggaacagccttttcactgtgggagaggaggcccctcccatgtacacatgcttaccacaccagtctctagattcgcagaggcttttctccttggcgagtggccaggcatgcctgcttccctctctcactgctgacggatgagcaaacagttcctgtctattctcctagaggtagagaaaggcagagactctgtccttggcttgcatcaccactcatatcaggccaccctccacactttgccctcccttttcaagccgcccttttttccagtgaaccagaggatactccaaatgtgcccgacacagacctgtgaggggacttctccacctgggtctcacacgctccacttaaactacctccctctcacttctcctttctttgctcctttatcattgcctatgtcagtcacttcctgtccactacagatttttatactttactccatttttgttttcttctcattcccacattactttacctcacctcaacccgttttgtccttctttcccacctaataggtgggaaaagaggtaacctttctcacatcctcacaaaaaaagtttctgctttgttcattaaaatgatttgttttgcatttctggtgagtataatttttcaggtagcaatattttattcttaccagtgcctccttaaaaagcctttgcaagtgctgaggtgccagttaagcactatatgacagccatcatcctcacattacaggccagtggttttcaatcctttgtgcagcgaatcacctggggactgttttaataacaccgatgcctgggcattaacctgcggccattggtatgtgtataaagtttcccaggtgattctcatgtgcagacggggctgtgaaccacacattcacaccttctgctctacaccagcatcaactctccacattgccacagtgcctggtatttgcaaaatgccacagaatcccttaattgtttatttctcacagtcttattgaggaactctcaggatgagcctcatgtcattgctgagaaagctgaggcttggtgaagggatattatttgccaagccatgccagaaataaaaccaaggtacttcaagggccctctgacctcatctgctcaaagttactttttttttttttttttttccagagtctcgctgtcacccaggctggagtgcagtggtgtgaccttggctcgctgcaacctctgcctcccgggcttacacgattctcctgcctcagcctcccatctagctgggattacaggtgtgtgccaccacacctggctaatttttgtatttttagtagagacagggtttcactatgctggccaggctggtctggaactcttgacctcaaatgatccgcctacctcggcctcccaaagtgctgggattacaggtgtgagtcactgtacccaggctcaaagttacttctttactgtactcactgactctaaactccccctgccaacaacacttgttctcactcatagaggtccctttctcagagccattctaacactcttaccacccagatgagcctctcttccaaagagagtatcatagtgagcttggcagtgcttagtaaggcccgacagtggagaggaaacgcagaaggaagccaaggacttattttcggaattctcaatatttcagtgattcagatggcttcagttcacattcttcaactggacacatcatcacttctttttatccccagagttcgagtgccacaaaatcttgctttgacaaactcagcattagtcttggagtccttgggcagggaaaatgcatgtattttataaactgtctggatggataaattacagcaatttttccctgggaaagagttgttcagacatttaaaccctctatatattgagcatgataacctttctcacatccccacaaaaaaacagtttttgctttgttcattaaaatttgttttgcgtttctggtgagtatagtttttcaggtagcaatgttttattcttaccagagcctccttaaaaatcctctgcaactgggcgtggtggctcacgcctgtaatcccagcactttgggaggctgaggtgggcatatcatgaggtcaggagatcgagaccatcctggctaatacagtgagaccccgtctctactaaaaatacaaaaaattagccaggcgtggtggcacacacctgtagtcctagctgcttgggaggctgaggcaggagaatcgcttgaacccgggagaggttgcaatgagccgagatcacgccattgcactctaccctggtgacagagcgagattccatctcaaaaaaaaaaaaaaaaaaaaaaaaaaagcctctgccagtgctgaggtgccagttaagcactattaatcaaacactaaatgctttttaaacagctctacctttttttctaattgagaaacagagctgtttgggcaagtttatgaggtgaccttgattgaattaaagaggtcagcgatggaacagacttcaaacccatattcaatgatttttttaaaaatgacttccttccaattaagcagaaattagcataaaatattttgtttctgaaaggttaaaagaattcctctgagaaggcagctgtcttgttactagctttttattgaacatgagagggaagggactatgggtagtttcatctaaagtgctttgttaacatgacactgatgatccagcatcaattacaatattccttaggagcctaagtgttacgtagaagggtcaaaaagtccattttaaattttatttcctatttcaaagtccaagaacccaatgactttcaattactaagaaagaaagaaaagaaagaaagaaaaaagaaagagaaaattaaatcaacatatagtttatcatttgcaaaaattgcaacctagttctacagaaaaaagcttcagtcattacctctttaattcaatcaaggtcacctcataaacttgcccaaacagctctgtttctcaattagaaaaaaaggtagagctgtttaaaaagcatttactcatcttcctcttagccccatccttctgcttgccatagtcccccacattttaatgacctgaaagaacatcaccttcttcctaccaaaaagagtaacatacagagtgtctgatatataatgatggaagcagaattccacagaggggagggggcaccacacacaggtgatactttggggactactgggtgtgtctgaggcacagtcaccctgagagacacactcgacataacatagtgctctgcatcccacatatctacccctgccaacctcaaagagtcgagtggacgtggattatatagaggagagaggcacaggagtgctagagaaagagaaggggctctgaagccagataccagctatgaggcttagggcaagaaactaaacctccaagagacctcagggtccttatccaaaaaatgtagtcagtactgtgaggattaaataggtaatagggttttttttttttcttcaaaatgaaaaaaatatcccccaacagattaaaaattagttcttcctagttttaatttcctatccattcatttaacaaaatcttgcccccctaccatgtacaatgtagtgggctgggcattctttatgttcaagtttatgctctcacacttctttatgttagagtttatctactagtttttggctatgacttcggagggcacagtgggcagagactgtgaggacctgtgatctgacactattccaagaaaagccgaactgatgttatgctacgaggatttttcagaggagagaagcaaccctttcagatccaagtcagtgtctcagtctttcaagactttgttagctattctttccccttaatctggcactgtaaagaagacaaaggatatggtcccacacacattgtgagaatttactgaatatttgttgttttaattttatcactgctttgtattatgacattgtttaagacaattcgtggaggcaaaggattaagggtagagaaatggatggctttaggaggctcggtagataaactacactagaaaagtctagtattgcatgtggagacatttcataaacaactgactggtaaatcactacaagaaaaataaaatctctcatggtacttccaaaatatcttctaaatatatgttgtagattaagttgtgcctgaaaacttgtaatcacaaaaaaatcacaagtatcaaatataaacttgtatttattcagcagctcacctgatcattatttgggggtaccaaaattcatttttctcattaatttaggacattgggggaagggagaagacatattacttccaagatcagaatttccctgagtctgtgaatctcaagaagattgatattactgtagatgaggtccctcagactcttattttaaagctatattggaggcacatctcataaagaaaagcctcgggaatagagaaacagggagaggcacttcaataagtcttgaaattagatggtgagtcaataaactggtgatcctcaggtaggctctcccagaccctgggggtgcaaagaaaacatgggatgagatgggaaatcaaagggctgatattgtagctcagatcatttcagatcaaccatcaagcatgtgcctgaggtttgaggaacgtcttcatttttctctttatctttttggggacttatgaaatggaaaacatgggttgtgacagtgtgtatggttaccaaaggaaacacataacacagcagtgaacatccctatgcacttcacctcttcaaagcattttcttttcttctttttcttgtctaaagccatacagcagactctgctttcaggaaataaatgtcactcaattagcaaatgggtggtaccaatttccagaataatttttaagggtggcatttctgttgggatgggcttaaaaagagtttgctgggtgcgttgcctatattgaagcaaatctccttctaggtagtgggaaaatacagaaaatgacgggaagaccaagcagaagccccagtcggctttgtctggattaacattttaaggtaataagcatctccaggctacctttgcctctaaaaggcattatggcaccatgtacactgcaggcactcaaaatccttcgttgattttatttggttactgactcttatggtatcactgaaggcatttgaaagagattctggagtccttttcccataaaattcattggtgccataacagggtcattaacctgaaaaggagaaagctagtattgagctctaggctttccacttacgatcttgggtaaataacataacttctcatcattgccaatctctctgtgggtaagaactcaacatttctgcctggtttagaacttgaattatttcttggatccattatttaatatttataccaatatgattagctcttagaataagaaattataagattatgtggtctgggaaggtaagcatattatggtgagttaaatgtggaaattccctaatttaaagcaaaagaaggcaattcaataaactatcattatctgatactagttactattccttactattcttgactttccagaatgactgaaaatgtctagggagtattcctcaatcaacatggattttttcatagattctcctaggtaatttataaattaatatttattgtagttttaattatttaaataatacatgcatatattgacatttttgaaatgcacagaaaaaaaatcacttgtaattacaccatctggtgataatcagtctgaatattttgacctatatcctcacagattttcccctaacataaattgtgaatataacacatacacacacaattggaattatccatgctggtttgtaactgcttttatcacttcacaacatattgagaactttctttcattccattatatagtctaaaccatggtttctttcaagactgctcatggatatacattaattaatcaataccctagtgttcaatgtttagatgtttctaaattaattctgagaactgataatttaggtaactgctttgagctgcaatgaccagcatgccccaagtagaaagcaagggcctttgggacacagcagctctagaacttaaagggggctcattaaagaccctgcaatgccctgccggaaatgctacaattaatagactctgtcttgtaacttttgctccagaaatgttcttcctacttctctgctagtgatgggagtctaaaataaaattttctttctctagccacttcctagaaggcttcacacattgtgtcctggaactggggagaagagttgctgagctcttgctccctctttgatatcaagagcattcagtcaagtgaaagagaagggtctctaagccatttagatgtgggagagcttactataataataatttcctataaacttcaatttccagggcttctaagtatcatataatggcaagtagaatttccaagaaagggaaggaagtacttactttttaaattagttatgtggctcttaactacctacggttactagaattctacaagacatcatcctgtcttcattttctgtgttcatgcagtatccctagcatcttcaagtcttcgattaacgaagctcatgtgcaacagtgttaggagtcaaggtataatagctttatgtcacctactgtgttttgatgaacaatacagtataaaagcagaggagaattaggacaatgatgttcatcaacagcacatcactgtgctaagaggctggtaacagtgtatgttttaatgtggcctagtactgattcttttggccagtgtcctactttaacaatgttacagtcacacttcaagatttcagatggagaggtagagaagaaaatcaatagatactatttttccactaccaactggcctacatatatatagcttctctgccatactcacattcaagggacctaaaagatgcctttggaaggtctggcccagttaccatgcttttaataacctcaggaatctactctgaccacctcaaagattttagcttcatctctcaaaggtccacaggaaagagcctatgatccaggaagaatacaaacttatttgttctctattttctattccattaatatataaaaagaaaacttttaacaaaggcttgcttgttacacaaggactcttgtctgaaaccaaaatcatgtagaattttattcctgagccttaaaaaatacacggaaaaatacttatgtagttaactgtgcaaaagaaaaaaattagaagccaaaacattcttctgtaatgttataacacaattttgttttcttctttattcattattcttagttgttaggttttcaaaaatgaccaggtattatttttattcaaaaaacaactttcattttttaaaatgttacatgctgctagagcgcaatgaggtgacctactgaaagtgttttctatgagcatctgctagaatcacaggtgagcatttgacaaaattcatcgatgttgtaaagggtaatccgtttttcaaaatcagagattcctgagtattgcttataaatgaaaacggaaaatcaggaataaattctactgaagaattctctcctgtgtttaggaaagaacaacaacaataaaaagcttacaaagttgcccagattctgtcatctaaactccttcaaaaaatatcctgattttttctagaagttgtgcaaaccgcacttaaattccaacaacactgtgttaattttgctcaaacgcaagctgaaaacatattttaacatcctgtcagaatgagatactaagagtgtcgataaaatgacactaaaataaatgtaaatttggattgctgttacaagtggctgcttggctctgctaagacgttaggttgctatagtactttccatagcaactttgcatcttattacataaatattccctcagtgtccttcaagcctgctacagaaacaggattaaatccactctcctatgtaatgatcctgcatcaaaccttaccggaatgaaatgcccagaacacataataaactgtaatgtagataatggtgttcctggcagtcaataagcatcagggcactttgggctgcacacaggcggcggtgcagtgaccctgtactactccctggtcatgcgtcttaacctttcccaggtcaaggcgtcagtggctctccctttgtgaagattggttgctcatgtcctcattctcctcctctccctgccaactgcccatcagctcaagccctccaccaggctcaagggactcatagcactaagcaagaagccagggcctgacaggagctgggaacatgctgggctgtcatgcaggaaactttgtggagaccccacccaggtctaagctaggatcaaacaggtatggattgtttaagaacttcagctaggcctcagctgaatttcaccgaggtgtggcacagttgagtagttaagagtattagggaaagtccttggtcctgtagacaccaatgtcagcaacacagattaatcttacataaaataccagattatggaaagtttgtgcacatatgagagagatgtcaagaatcatggcattgataggtgctacataaaaataggattataaaggggctaagcttaaagacagtttaggctccaagtgtgaatttacaaaacaaacacagtctggttgggcagaaggagtgcttccattgaaatggaatcttctgctacaggatcaatttaaatagcatctgttttcctgcatttaaaaggtgaagcaatttacaaaaaaaaaaaaaattctacacttttcagaagcatatccattacggaaagggaattgtaactgcacatgaaattagggaacttaaaaatccacccaaaataaatatttatttgaattccttgggcaagattagcaagattaaaagaaaaaaaaaaaaaggaaagaaacaggaaagccttggctcctttgcaaatgaaactctgtttagagtttaggaagaaagcaggctactcagcccaccttgcaagatttcttttatcatctttaagccacattagttctgattcatcacatttccttgtttggcccccttgggttcccagaagagaaaatgcttgtctttaattcagtggtcagtgatggacacaccccactggtctatttctctttcaggagatggtgccctcggctgtcattacatgtgaaaacagcttatccttctatgcttccactcaacacagacacccctgcccttggggtctgctggcgcccggagctcagatcctggcatgtggcctcagactgagccatctcactttcagtgtctgaattctcttgtccctctgccaagttctgagccaatctcgggtgagcctgctttcagttacattcagtgcttcctaaaaggaagtttctaccagtgtgaatgacagagccccttgcagttggccccttcagtcagctgctgcaccctggtctggtatttagtaaccctctccttcttctgtgcctggctggtgatggggtaacagtgagcctcttcttaagcttgtgcctgattataatcttcctgatgggcatttttaaggatctttcagaagtactaccacccagaaaatacttaatcagaaaaaataggttgtcctgctattcaaagaaatcaatgggatggtcagagagccctattattattatttttattacttattttttttttaacataaatcttccagctacatatataactattcagataggctgatactgctagttccaaccaaacctaattatgagttcctaatttgatttagtggctgaaagatttggaaagtccttgtttgaattcttagtgaaattaaaaaaaaaaaattccgggccaggcgtggtggctcatgcctgtaatcccaacactttgggaggccgaggtgagcggctcactaagtcaggagatcgagaccatcctggctaacacggtgaaaccccgtctctactaaaaatacaaaaaattagccaggcgtggtggcgggtgcctgtagtcctagctactcgggaggctgaggcaggagaatggcgtgaacccgggaggcagagctcgcagtgagccaagatcatgccactgcactccagcctgggtgacagagcaagactccgtctcaaaaaaaaaaaaaattcctttgtacctatgttatggtgaattttcatgaaaaattgacagctcagaaaaacactcttcataatttagagtgtctgctcctataaggagctcagagtttaaatgaaatgcagttaaaatccaaaaacatttgtttgtgtattatggaaaggcataatgattgtctactgagcaagggactttttagttttactcttctaacatttgtgttcaaagtacactcatcaaatattgggtgaggtacatacactatgtagtgatgttcattttggtttataataaatttaatttaccagctttaggacatccctaatatttttaactgaaaacacttttttcaaatgagtcttacaccctagagaactgggtaccctgtatctaactaactctgtgtgccctgggtccacagcaccttggacatacaaaatgtagataatcaaaacagtgctgggttaaagctctctgggccatggcctgttcgccatgtgacactgaattttgtacgtataaagttctgaacattttgtttgaacatgcctctttaatacttgccatttcaatttaattagagcaaatgttctcagggttatcatcctcctatcaacttctgggacaaaggcatcgaaaacattaagatcagaagaaggggaatatgaattgaagtccacagacttttattgattacgtacttggggaaaggcccagggccacgtgttggaggatgactaagataacaagcagagttaacatttattgagtacttactagatgctcaacactgtaagtaaagtcagaagtgccttgcatgcattgacttattaactctcacaatactaaaacgtatcgggttttgccatctgaggccttacaatctaggacagccttcctctttcctttctcctttttatttcttgcgaacgctatcccgccccacagagtcaacctggagggagagagggaggaagggagtggaaaagggtaagggagaaggagagagggagagagagggagggaggaagagagagagaaagagaaaaaggaagaacagatctggattttaaagtctggcttcatttcagtaggaggcagactaaacaacaataaatttgaatttttatcaaaaattatcttcacaggcttcagagcaggatgccgatcttctagaatgaatgcttcaataaatctgtcattatttttgaatttattaacaaaattgattttcatttttatcagcatcttagttttgctccagtgaactccttttcccctttaagattcaactgatcaagaagagtgaacaccccacccagaattctattgtagatactgcagaattatagccaaagacatattgcaaattattatatatggtaaaaagaaaagtacaatgaaatattcttcataaccaaaaagcagagatatattgaaacattttgattattttttaaaaagtaaacccaaggtatcatataagtccttacacaataaattgtgcctttcctaaaaaccaaacaagtcaattatttccatctcttccctgccccccaaaataaaacccattacagggtactttttgtcttagtatggagatgacaagcaaagctggccctgggggaccacagacagagcgccctgcagtgggtgcagcctcagcacctcctcccggcacaggcaggtgacaactgaaggatattctcttctggaatttccaagaattcctgggtcagctactacccaggaggtctgaagcaaaatcccactgtttaagcagagaggaaattggcaggggattccttacagcatggagaatttcacttccattacagcactggcaattcccctgttagtgaattagagtgctacattttgagaggactgctcctatgtaggtgactggcagatgcaaatgtgtacctaaaaacaagggatgtgtcacccaagaagataccgctggaaggtgtttccctcgggctatggcctccatcctcctgcttcaagcaacagttagcagggatttgtctgaggtttgaacaaaagaccagatgggaattcttgctgtcaggctgtgtccccaaatatgcagggctgaaagaaaaacaactgcctgcctttgggccagatcttcagggccccgtggaataaaaaaggttagttgccttcctttccctttaatcagtcctgtgctttcttcagaaaccacatgccacattctctggtccatctcgttttgaaaagcacgaaaagactttgaactgctcggggcctggcatttgaactccggttctttcatctcttccctcagaacttggcatacaacatgccctgcactttgctcattaattctgctgaccaagtaacaagactggtgaaagttttttttaaaagttcaggctctacttcacgttctcatcagatgcctggggaataaaccgagagaggtgtcgggggatcacatctccgtcgatgcttctgcagcagaggccgggccccgatcctataagcatgtacgtgccgcaagacctcagtgagcatactattcagagtcatcattattctggtcctatcctaagcagactatgaaattatacacaattcttacttgggaaattgacaagttatttaaaaagaaacatcaccaagacaaaacaaaaagccacaggttcaaatgagaatttctgactgatgcagttcttttctcctacacctaccttgtcaggatattaagaatccaagtttcatgtcaacttgcctctcatccagaagcttcacaaaggatgaaagcgcttttgacaaaaaaaaagtttatttctttatttgaagatcttgttgaacttaagaaattcacacaaatccttgcccccttcttttgctatgtgaaggtttgtagaatagaaatcctgtgaggaaggtggtctcctcaaataaacaaacccaagagtaaagcagtcctgaggaatctgatctgggcttagcaggagacatacatcattgacacataagtgctgggttcatttttcagacaagggatatatggcttcagaaaatagtggcatggtgcctacttgtatgttaagcacctgaaagattaaaatgaatgaatttgagggtgaaagggaaagtttctaaggcagtggttctcaaactttggcatgcatcagaatttcctatagggcttaaatcacagattgctggacttcacttccccacaccctgtagccactagacgtttttgattcagcaggtcttgggtggggcctgctaacttacatttctaataagttcctagatgatgctggtgctactggactgagaaccacacttttgagaaccactgctttaaagaaattagagccctttctctatatgcctgtaggcaggagctttttcttatgaccatcactcgcacccctacattctcttctacagccctggagaaacagagcatcctgaccactttgcagtcttggtgacctgatccttttagaatcttgattttggtttcttaataaattagtaaagatcctcgattcctggtcacctgcaatctttctgttaaaaagtctctaacaggtgtatgttttattcacttatacacatgaggagacagatcaaatctataccatctctgtaattttcttttttgggaatgatggcaattatggttcttcctaggtccttcggacaacacccttccaatcagacaagcagtctcccttggtgtctcatgttttgaatgagcttttcccttgcctgtttttacaataccaatggatttatatataattcaatgagagcgttttaaatcagcagctcccattagacagagcacacaaagcaaggttctctctaagtttctcttctttgtacaacctaaggagtgacacccctagcttggtaccaaatggggccagccttttaattacagattaggtgaaagaacatttatgggaaaagaagtctaattctccagcatcttggctcagaagctagaaagcttcttcagggattaaacaattcccatgtaagaagtacactgactaaaaccaaattttatccatatttttagcatcagctgtggctgccgtactctggaaaaggattttcatggaaacaggcaaatatccctgaaaaaagcttaatggccccagatctacgtacggagaaacaactggagcaatttaaatcactctgttcccaagaaggagtttaaagttctattaataaaaagcagagtcactcaaagatgaaagtttagtataattcaaataaaagtgagttatagggccatttacttattccccatctgagatttggaagatcattatgatacctcatgggtctgtggcagttatcggcattacctgattcatcgactctcattttctttgtagggctgtcacagttctcatcatcagacatttccatttcttcttcgcggcggatgcccatgagctgctcactttgagcattccggagctcctgcaagtagaggatacacaaatgtcagagtcacagacacatatggctttccccaatggtctttgggtatatatgactggcatattaacattcagaatccaaagcttttatctcccaaatatagcctcacctaacctaaaggaggttctgaggggtgtggggtacaggggagactgaggtcaggcttagattaatccctgctcacccatgactagggctctttagcaaataatttaatctctcttgagtctcaatttcctcatttgtacaaagcggataataacatccacctaatagggctgcaaagattacatagaaatacctgttacatggctggcacatgtacagtaaggacttagaaattatggttaagaacatgaacagtggaattttaaaatggactgttctaccactgacccacacggtgtgacattaggaaggattcttcatctctattaacctaaattgctcactggaatattatgattaaaaatagttttgaggatgaaatgagttaatgaatgtacagtacttagcatcatgccagacacttggtttgctcagttgataatgctggacattattatttctcatgcaaacatagtgcccctgcatgtgtgtatgtgcccatgtgtgatcacatacacacacaggcacacacacacaccattcagatatccaaaattcaaaattagtaagatgttagggaacaaaacacaaacagatgccctttctttcgtattgcacacggtcatgttggggttactgtttttgttgcaatggttgctttagcatcacataatttagagccacagatcttaagatcacaccttactttctccatttattaggggagtgactacaatcaagttatttatttgagactttgtctagtcactcacaagtgaggaataataatacaaggctgtttacatgtagtagcatatgtgaaaactcattgtaaagattaaagaattacacaggaaatttcttactactgtgcctaaaatctgaacattgtaatacttatgctaagtatttatattattattttgtatcaagctgtatattacatatttgtgaattcttccttattcattctgttctcttacatgtactatcttcagaaatacttaaaacaggggaagcctccattattctttttccctctgtaaagtctctaaataaaaatcaaatagttaaaataatttcatgttatgatcaataaacatatgagtaataataaaactaaattactacaactgatttattaggggcatgacttgtgcccatttgatggacatgcatatatcactccatgttatgggttttctccattcttttctctccttagctcacagattttaactacagcatgatggagaggaaagtatttattgctaacagcatttgaatggtcaactctgtaccctgggaatcacccttgcagaagacagggaagggagaaagcagagagacaaggtccgaggtggggtgcaggggcaccaatcacaggcagccctgagaggccagagggaaggcagacaaggctcctaatttgattatgccacccagaataaacaggtgccaattccatcttaaataacaccatcaggcattggaggtgggtgtcacatgtgattagtgcggaaatttttaggctgtggacagctaatttttctactgacaaagagcccaattcccaaagaggtggcttaacacttgaaacaaggaaaagtcaggtggaaagaataaatgaggctgaaagggactgttgtttagtccctgcgattaatgacaaactgtcatatggtagttgttcttgtgggaaagggtggtggaaaagaaaaaaaaattgaggaaaaagagctgagggtgtttccacagggtgcctctggttcagcattaaatcactagtacactctaataaatctgtagaggtgttgcagataattaacagatgctgtacatgggaatgtgggaaaaaatcaagccaattatcaagcttatacgcaactgagaaatcatccacaatgttaaattaccaactggtatttaatcaattcagcgacatgcaagagaaaatcacagctaatttagaattctgtggcctaatgtatatcaaaagaggtggggaaagtagcaggaaggcaaaaagacccttcgcaggagcacctttgacagctgcactccatctgtccttctggagcatcatttctgtctcctagtaccaaacaaagcaagcaggctccttagacctgcatggaagccttcacacgtcctgctccccaccacacccacgcagaggaggcagggttaagcgaaggtgagaagttgaggcagacatggcaggaagtgtgattcagatcaatatgtgacatttgctgacactcacattctaatgatggcctttttatgctcaggtttattcggcagcaggccaccagcctttctctcaacattccttttaatcatgtttggtttttatgtgaaaaaataaataattcacagactgatcattcccaaatctgaatcatagtttatggactccaatttgtgttttcataaccctcagtttgtctactgcatcacaaacagaggactcttttttttttaatcttgaaaatcagccttgacctcagtcttaagtcagagtcagggagaacatcaggtaagcacccttcatttttctggcccctgaaaaattaaagagaaatcccacctcttccttactcataatcctgaacagaaaaacagaactgtatcagtcaccaaccaccgtaggcattagtgaacaaactaaaaaatgtccttcttaacaataaattgcactagcattttaagtgtcacattattgtgaagtcattcggtattcaccataataacagtgataataaagaattcatttggtattcatgtggatattacatctagtgctattggtattcaactgtaatttagcattagttaatgggcacttaaaatgctacccaaatgattgatatcatagtactttgtgattcctcaaactctatataaaatacttattttacaagtgtaagccaaaatcattaaataaataaaccttaccttccataagtttgggattttgaaagaggggaatgtcatttagagaactttaatattaacatgctagagatggagaggcatccaaatgaaaaacattctttcattaaaaaaaagaagcaaagacagtatacttacttttaaattacaggttcaaagcgtacactactctgtggagttaaaaataacagctggacgaccagtgactaatgacacattttggtccttctaagtggcaaggaggtcaaattctagactgttctcttgggggtagatactcacttcacacatgcatggttgctgatgggtggacccagttggcctagatattcactccccttacaacattggatctggagagaagtgtaataggacttaatggctagcatagggactaagatgttgcttatgataagaaaatatggacggaaaggcgtacttgtccaaagagcaaactgtcatcatcacgtagaacactaaaaaaaaaaaccctctgtatttaaaagccagttttctattgtaagctccatttttcttcaaaataatttgctagggaaagtgtcttggtttatttctgaaatctttactatgaatgggaaaaagtattttctcccattgcaggggagaaaaacactgtgttccctaagtgttaagtcagctgcttttctggacaaggaacaaatctcagctgcatttggagctgacagtgagatcagacaatggcaggcggactgcccactataacagaaaccatcatggctgcagccatgctattctctgccaatccagctgtgtgatggtggttaaaaagtaataataaaatcaccaacctcagaatgctttcgccaaatgtctatgttcttgcgctgggctttcgagaaatggtcccaagctttttgtctggtagaagcgttgaaaacggccacaatctgctcaactttggtgaacaaggaagtcaaacaagacaagtaatttatgttgtgatcactatagggaagcaaagcaaagacactaggagtctatggatgatgtcacaatagaaacaacatcatcaatatccatccaatttgtgcctttcgtacttacattttagcaaggttggggatgtctcccttcaagtctgtctccacaactttaggttaaaacaaattctaagtatgaccgggagaagggcaagggcatctacttccaagcattctttagctgttgtttcaatatgtgatttggtctatctatatacctagatctatagatatatagacactggtgttggcatccagatatacagacaaagtaatgcaagggttgggtgcagagaagtgaagtcagggagaagtggctgaacgaggaagagccaaacatatcattttctcttttggtctttatctcaaggactcaatcacagtcctctcaagacattatcatgtccaagttccaaattgggacaatgaatagccgtgccatgtctcccctcaatctcagggggccatttttcctccttggctcctttttcctccccctgttgcactgactgcagccagccctccagccctctggcagggaacaggaaccatagcctctacctcaagacagaccaaagctcacccaaccagtggcactggcatgcaggtcttatttcaaccaccatatggcaccctccatagctcctcatgatcacattccattatcactttcacaaggctccccgccctctggctcccagaccacttgaagttctaactctattatcttgacttaatttagtacttctgctgctttcaggcctggtgctactggactggtaaatgttgaggggttatgaacaaaactacatagacaaaggcatgggctcttagtagtgggtattatgggtggagccaactaactgtagacttaatcttgcttaaacagttattgatccagtaagcatgagattaaggaaattaaagcactaaattaatcatatgattaaacctgaacttctaaatttttagttaagaaggctcagttaaaattagcttctcaaggattctaacaccccatcaacataaatctttcataagtgattcccaaggctctattataaaaaaggacatcaaagctcttccaaatcttctggtgtccaaagaatgtcaaagagcaatagagtaatccccacagaagaacaacacttggtgccataatttttaaattagcacacaaaataaatgtatgatggagcagaaggaaaaaagcagattccattcacttacaatatcgtgaatacttttctatgctgatgaacaactacttctcaatctatggctgattttcacagagggcttttatctttttgctattaatatttttactattttccacttcaggagaatcccaaccccaaatctccttatttagcaaaacctgtcatcatgtcacatgatgaatttatttgactcaattttaacaggaggatttgccttcaatttgtctcatactctccttgggcacatgtggcttccctcctcgacctcaactggaagaactaaactccagactaaacacctggggctgctctaagtgctggccatcagctgaccactgatccttagtgctctggttggctgtcctgcagcacagctggcagaggagagaacctgttccagtggatcaccggggctttctgcatgttttgtctgtacacaggctgggatcattgggaatttcagctgccttctgtaggggcaacacagaacagtcagccccaaatctaggctggcaggggtggtgatcaagaggttattaaagagtaatgggcttcgttgcttataataacatagctctttggcatcatttagaagaggaagaactatgatgtcctgacaccagtcctaaggggaaaggacaatatgggttgagactgagtgtttggttggtaatagtgaaaattctgacatcaatcagagaaggctgttaataaaaatgaaacactaaagaaaagtatatctgttcataaaaacgtgtaaggggccagagagaatgaaggtaaggaagactagtaatgcacctggaggagtacagaaaagaaagaactaagaagaaggacccaatggcccaatagtgcacaggtttaggggtaaaaggagatcccctaatatctactcaagccatgtgctattagatatttcctgtttgtggctaagtgcctcggttacttagaacatgttattaccatatcccaaggcataagttcagttcattcattcattcaacaaacatctggattcctgttagctaccaggaacttgattaattgctagaaatatatgatcaaggcccagtcttgtctttgatgcaatcatagtctcggaagagaaagaaagacaagcagataattatcctgtgcaagagaggtgcagatgacagctttgaagacacagagaagagaagagagtagctaagtagataggtggcattagaaaacattccacaaatagggcaacatttctgccaagtcttaaatagtgaagcaatgcctgcttggcagagaaggcaggagtggcctgttcaaaggctggtatagagttgtgggaggatgagtgaaagtagctgtggggctggggctggggctagtgttaggtatgaatcaagagagaccatgtatgctaactctgattgggaactttatattgtaggattggcttgggagaaattacaaaggaatgaattaaggcagaggctctggcatggagtgtggcacaggcagtcatttgacagggagacttgataggaggaggcagctgacttgctacatgggaggaggaagaggggtgcgaggtaccacgatgactggagctggtaagtacatcccaaactatgagaacaagcatcggtggagggctgagaaagaagataaggaatttacttttggacgtattgagtttgagatgcctgaagaccatccaaatggagctgaaatatggattaggggttcagaaagaagtcagaattcaaagagatatggccaacattttctgggccattctccatttcttgtattctttttcaatagggtaattaattagatgtaaaactaagtgggatttaattttatacttatgaacttatacactttttttccctataccaatcaaaaagcaaaacaaaaacaaaacaaaataaaatcccacaaaaccccaataactgtgtaactcaggtttggaaaccactctcacagtattcacacggcccagttttacctctctcattgctgcacacactgtccctgaaccagccatttgtcttgcaaatgaaagttcctgggcacacacgaaaaaggactctggaggagtgctttcatcagcattaattcatcatcattagggaaaaagcacctctaagagtatgccctaatgaatgtcattcaaagacagcatacttttaagctcataaatcaggatgactactggtattgatgtaaatacactattcattgcttatagcaggaaacaccagagaggaagtccatgaattagatgaccactgactacctctctggtataattcatactacttactctatctatatacaataaaacctgttaagaagttactatcagaacaggctcttcaaaactttgcttctcagagaaagatataaccagcaaacaagatggcattggcatttgttcaaagcaagtagcttatagaagttgtgctgcaggcagaacaaattgagacctactccctacccaatgccttcaccacctcagtggtccacagagtggtggccagaggccccacacaatcctgtatcagataaaaagcatagattctgtttgattgccacttacttattcaagaaagtatactcaaaagttttgcaggtaaagggaattttttttctttgagggataacattttcccaaatcttctattagcaactgaaagagctctccatcagaaaatttaaatttacccctcacactttgcaaatctttcccccccaattctgtgttttaattgtttgcctaaattaggttatttgaggatcataagaaaattaaaaatgataaattcttcagaagtatgcctgaatgccagttttagatatcacagtagagcccctagtatacccagcagctgtaaatgaccttaagggcaggataaacagagccttgatgaagttgctaatcactccacagagctgcaaaccctcactagtggttattcattagcttacacatatgtatgtgtggagatacatacacgcacctagcatacacacattacacacatatatgtatatattcttccaattttaaacaaacccataagactaatttaacaactttttttgcacttttccccaccccaaaatgtttggacatttgctgagtttagagcacacttcttactgatagagaactttacagactatcatgagaagcgctggtcttcagccttctctgggagggaaagctcagaacagaatatccatttatccaggaacagaccacactgaagcaagctccctgggaaaaagcagccactgggtgcaaaagctcagatttctgggctgcacaagactcctgaatttcaagctctgggcaggaatgcatgggagatgaaagagaaaggttagagtcctctagagaacacgaacacagcccttttcccttcatgtcttgccgactgccttctttctcacaggccctgcacctcttgtattccttgttccagctaaatagcggtgaaagagccttaatccagttagtgtcccaaatatctggagaaactgatttagtccttaaaggcagtaggcttgcctaaataaagcacctcaaacaaatcttccaagcttagtttttgttttttaatgctatctgggctcatgttagagcctcaactctgcagggtacacaggacatttttctttttttaagggataacattttcccaaatcctctatgaatagcccatgagagattttcaaagggatatgacacaaatgaaataggtgacctctcccaccccagcttgtttttgttgttttaaaatactaatagctaggggagaagggacagaagaaaagtgtaaggctttagatgtagtgctggaattggtgagccttggctttagactgaagaattataatggagggaatgcagtaagcgattccagctctcaggatacccagaggagcaagacaaggtccaagggagaagcggtatgtgtcggacagcacataagaggaagctgctgctataaaagagattcccagacagactcctgcacattcactcgggttctgggtcctgagcatgaaggagctggcagtcagcctggcagaaagcccaggaaacagagaatgaatacggtcaaacccatactttaaggagggatggaccggaatttcaaatagaggaagaaaagggcattctggggttttgtcttgagatatgttaaaaaaagcctcacatgacattgtgagtccattacagcccacttaaaactgaggccaagacaccaacagcagacatcatattactgaacttcctggctagatgaggccagatatttgttgcttttagggcagcatccccaacgtttttggcaccaggaaatggttctgtggaagacagtttttccatggacagggggttggggatggtttggggatgaaactgttccatctcagatcatcattagttagattctcatagggagcatgcaacctagatcccttgcatgcacagttcacaatagggttcacgctcctgtaagaatctaatgccgctgctgatctaacaggaggcagagctcaggtggcaatgctcactcacctggtgctcacttcctgctgtgcggcccagttcctaacaggccatggacagtactggcccaggggctggggacctctgttttagggaatggaatttgaatagaataaagagaagcctactgatcacagtatataaaaaaacaggatgttttaagcaaatttcaagcaagcaagaaatgatcaaattgttcaaataaaacagaaagatattaggtatatagtgacttttaaagatttgcatcactccaagtatactccagggaattgtagagccctttattaatgcatatatttaaaaattttggaaagtaaagcaatacatgagattataaatctaatagttcctcaaaatatatagcatttattaagctttttaaatccaataaatctcctgcctagattacccctactgactaaatgaaagtaatgtatatacagaagaaaaaagggacgatataaaaaaaaaagtctaccttcccatcttgacaactctaccaagttctctttttaaaggtaaccagtaaccactattaacagatcctagcacatccatccagaaaataaggttatgcatatagtacaaacagtgtgtatttttctatgagaaaccttttttacttacacaaaggtgctaatattatatacgctattctgtaccttggttttttcacttaatatatcttggaaatctattcatatgtatgttatcaataaggctgctataaacatcttccaacatatcttctgaaatccttacataaatatctttataaaaaattcttagcagtagaaaggctagataaaagagcacctgaatttttaattttgaaaggtactggcaagttgcactctatgtccctgaagtgtttttcagtttgtttctcttaccctttgccaacagtgcataatcaaatttagcttttgccattcctgatagatgacagaaggcatgaattacatggtaaccaattgtctgcaccagtgatatgtatgtttgcagtttccattacaaataacagaaacaagtccagactcattgagcctgccctgtattcagttgttggctcgatgctaagtcatcacatagcagcaggaggagagacctggtttctggggatcttttcttctttgtgaccctcgaaacggcaaccctgatctcctctgagtctctactaactcccttagtggttatgaaaatcatataatggtaataggagatttctttctttttgagacggagtctcactgtcacccagcctgaagtgcagcggcatgatctcggctcactgcaacctcagcctctcgggttcaagtgattcttcagcctcagccttccgagtagctggtattacaggtgcgcaccaccacacccggctaatttttgtatttttagtagagacggggtttcaccccgttggccaggctggtctcgaactcctgacctcaagtgattcacccgcctcggcctcgcaaagtgctgggattacaggcatgagccaccgtgcccagccctgtgataggcaatttctaattacttagcccttactgggctaggcactatgcttgatgatttaaaacagtagttatcaaagtgtggcccctggaccagcatcatcaacatcacttgagaactcactagaaaggcaaacactcagactccagacctaccaaaggtgaaactctagggatggggcccaacagactctgctttaacaagctctctgcatgattccaaggcatgctaaagtttgagaacctctgattatcttacctaagttttgcaacgactgtctgaggtaggtgctagtatgaatgcccatttcattgatgaagaaactgaggttcactgagacgaatatttacttgtccaaggtcatatatttagcagtggtgaagttggcaatggaaattacatctgtccaacttcaaatcatgtatttatacccattatatgatgggccaaagtcttatgagctctgtggtgtgtaatgtgctagactttgtactacacactggggataaaaagggccaaatatgcagctggtccttgagctgctcagagtccctgggggagacaacatatatatgattgaatcgcaagatgagaattgcttaagagagctgcagagggtgccaagggaggccaagaaaggcttaaaggaccccttggctgaaacttgcagctaagttgaattttcaatgcaaacaagccaaacattggaggttatgatggagcaggaagctgcatttacctctctacaaaagtgtattgaggaacatgagccacagtgcagaagaatcaaagtgtctggaaaaaaagtccctactttttttgtgtctaccaggctggaaccaatttctctcagtgtgtgccctcagccttctcattttgtctaaaatccagtctgtcctactttttttgaaataaaagtcattgaataagcctcagcaggggaaacttacagaagtggggccaagggagtgtttttatgaatacaacactgttttgggggttgcatgtagacgggaagagagagttgggaaatctgtgttggtcaagtcttagctccatcgctaactagctgtgtgacctgaagaaagtgtccatctgtttgaatcccaaggcaaagggggctaggctagaccatcctgaatctcctttctggctctgggagcctttagaacagggcttagcaaactttataaggaaaggaacagatagcaattatttttggctttgcaggtcatacatctaccttgctatagaaggtgtctacacacataagtggtttctctccttaaatagaaatcctctcactttgtctgtggctactcttccatgattctccccaggtacaattttctttggttggaaaacaaacactaagttgtacttctctttcagttacgcagagtcaagaacacatcatctctgctttaaagtaactttactgacaccttacttttcctcaatttgaaagtgtcttggctttaaaaaatctttgtaaaaattttttttatgcatggattttgtccagtgtagctcagagactgtttcccagagtaccccaatgctatcaacacacattcccctcgcctgatgtggggcagtggctagagtccagtcctagacctgggctcatatcaaagtgacagagttttcatctttagctcccagaagttatacctttcctgatttgctgaatttcacttaatatgcactccaattctttattgttccagagtgtaagacttgatttctatcttacattttggtattattaaagatttttttaaaaaaacataatgatttgactcagtgtatatattttccacgagactgaaaggaaggataccaaaaaaaaaaaaaaagaaaagaaaaaaaagactcatttcagttctggcaggcatagtgtcctccaccatcacctttggcatcctgtgaaacagaacattctgtgctcatccttgatgctgaagtttttatacatattattttctctggatatttattccctgagaccaaagaggtatttttttaaatggaaataatgtttccagcacttaatgcattggcaaatacagccatcagtacaattttgaggagaaatagaaaacctgtcacattgctaaagcagttatggggaattttttcccatggatgaactacagcaatgactgctacagacatgggcaaacattttaacacttcataaaattcctttttgacagcaggggacatagaagccaaatttcccttggtggaaataaaaaatgtttggctgagatgttcctaagaagtaaatgatttcagaaagagcttttcaggcagaagaaatgtggacgaggacaccaatctgcctaaaagggggatcacagtacacagagatcagaaacccctcacatttcactctagcacttagcacacaacttgacacttgataaatatttgtggaatgaatttaatcattcagacacttgaggcttttacaattttacccaagaagatagatgagggcgtgacagtggagaactgtcagtgccctgcgcagctgtctttgacaataattctgaccaatcttcagcacctgcagaatgcaatgcacataacctcagggttgaaatgtggcttaaaattcacagtgtagcccaggaggagtaaccttcacagcaaggtataggcagaacatttgcacagagtaatatctgattgcctgttctatgatcactttaggagctttgaacctcatggttgggtcctggaagatacctgtatttagatatccagagacgataaaggatccacatggttgacataagaactgtggaatcttaagggtggaaaggaactttaagggattactggttaaacccttttattacagagatgagaaaaaggagactgaagttgcttaaaagactttcccaaagtcacaaggctaattagtggtcaaacttggattagaaccagatctctctgccttgtcaaaagtctttccaccatttgcagcttttaagacctaagatgaggctgatgccattacctatcacaaatgtataaagttgcatgacagttctaacctttccaatctccaggttgaaatgatattgataacggtactctaatactcctactgtaaaattctcaactaaagtatatgccgtatgctccactttaaagagaatggcatattagagctaagatcattgagatcacggtttactaaaaaacacttaggctgtgttctgcaatattaggttctagcccaattttcagcaccacgttcctttccacctgtgattggtcaacaaccaatattttttttcttaggtcttctatgtgcttacaagaattatgccaggtccagaagtggcacagtgaggtagaaaagagaacagtaagtggctcatgtctctatttagcctaaaatcttgctagagggaaaatcaagcaaacaaaccaataaacttgatgcacataaaataattagaaaataagtaagtcctcaagtagatagtattaacaagcgctgcagaaggtaggtgaaagggagatgattatgggttataatggataaacaaggtttcatggaggaaatgtgatagaagtggacttcaattttggcacttggaggaggggaaatagttcaggcaaaggaaacagcacaagcaaatgtgtggaggtaggaaagagggtagtgccagaagcaaatacttcattttttagccagatagcagcatttatactcagtgtgatgacagcacacctcttcaactctacctataagctgtacctttacatttataatattcttaattttcattttacacacacacacatacacacacacacacttagaaagcaaactgtacaaggagccaagagtcttggttctaaactgcccataaactactaaatgaccaaagcctctcacgtctgctctctgagactcagtttcctcctctgtaaaatgacagggtttggcccaaccctttaagatccctcttagctctaacattctataatttctgctttttatccatgctcattatatgtatggcacatattcttaaattaatgttaatcaacccttctgcactgctgctggctttcccatttgccttttctccagtttgttcccttctctcttaccaggaagcatgttgggaaagtagcaaaatggggatatcatggagtgtttaaatttttattagatatgtgtgtgttgtaattgttaaaaggcatgcaaaacttatcatcttggcatgcatattaataactgaatgtggtagtccatgcttcctgaactttataaacagctcctgtacgagctttgaaatgacaagctttgttcataactgagaaactgaaagtgggcaggcctatggggagtttctgtgaagtatgcatttttaaaaagcaaagataaaaactccaacgtctccgagttggaaaacctggggaagtttctggcaaatggacgggttaagaaatgacataaagatgagactaggatgctatcgggataaggtgacatgacaaagatgatttacctgttccgaatttttttttctctttcttctatatctaggaaatgaggtctatccagctggcccagaagggaggagaaagccccaggtgccacagcaggatagacgatgtcctcatctaacatttttcataactggacatccatggtcagaagagaaaaatcgccctacacagaagtgaatggatgccatactccccaaaattcaggttgggtttttttttttttttttttttttttttgagatggagtctcgctctgtcacccaggctggagtgcagtggcgccatctcggctcactgcaagctctgtctcccaggttcacgccattctcctgcctcagcctcccgagtatctgggactacaggcgcccgccactgcccccggctaattttttgtatttttagtagagacggggtttcaccgtgttagccaggatggtctcgatctcctgacctcgtgatccgcccgccttggcctcccaaagtgctgggattacaggcgtgagccaccgtgcccggcctcgggttgggtttaattacagccccctgacactttaagctaagactttgctaaaaacaatgactgtttgatatttaatagctggtcctggggtgaagaccagagatataaaaaaggttagaactttcataaatacgggcagaactaaacaccaacaaagctagagggtaactgatggactttgatggagacctttgaataaatcacaactttttctttatgttattatgaatgacttgtgacgtttttcaaacaacttttgttaagcactgaacttcaggaacggtggctggagagcaatctaggccaaacatttgagcctatggatcctttccaaatgaaagcaagaacaagtacacaagcacagaaaggagataggtgcatctaatccagctcatggatcacatctgaagtttcccttgtcctattcaaccaattggttatttccagccaaatccataaggggacccacatgcttttaccatgctttgaattctgcaatgtacctgatcttccctagaagctgcggagtgagccctccgtgtttggcttgtttgcggcctgctccactagttagccagtttgccaatacacctgcttccaaaccacctcacaacaatttcccaacatgcttggctgtttagtggacaggctaccatggaatgccatgaaggacggcattgacactggggagatctttcggcactgacactaaggagatcctttatgtggagagggagcagttggggctgctatggaataaccaggagatttccagccacctgggagaaggaaagctgaggtgcaattcctgaatactcatgcttaacaattctaatctcattctaagggaagaagccaaaatgtgattcctgtggtatttgccaggaatattaatgcagacaaatggggtgtgactggttctgcttttggaaaatgcagcaagtgtgtcagtcactgaggactttagcagttattgttttacaagcatccccaaagtcctgacatcaaacacatcttaccacactgaacagagctgtggaaagcaagaagtacagttgagacacaaacatagctccactagagagagggaaattcgggacaggaaaggagaggcatttggattaaaggatgaggagatgtgtatgtacctaccatgttagtcaggttactgctaatagtttcacagactgggttcctttttgcagccctttttgtaaaagcacatagaagagaatggaaagttctgaggttgctcaatgagatatgcaatcttctggttctgcctcacaggcttaattctagcccaggctcacatttaaggtatcccccatcttcgagtcatcctgaaagatcttggctgtcaaagactcacaggaaggctcctcagagtctccattgctgggatgtgtacaccgtggccagcactgtaggattttcacaatctcggttgatatctgccaactgctgaaatacttctcagaatcaaattacagggctaagggggactcccaaatagtaacaggcagatggtaaatacagaggttgttggatggttacaattggggatactacaacgtaaatttctgatgattctttcaccccaactctcctaatatttcctagcctctgaccaagaatttggtaaagtgtggcaatttccaataaaaagtacagctattgagctttttctctgatttgcttcattatgcatgcaagttgaaaccttgtttcctgcagatgatgctaatatcaatgccaaactactcaacgaggtcaccagaaatttctgaactcactgtttcagggttccctcctgcctgtcttctgatctactcattcattcactcactcatccaccaaatatttcttgcatatttctatgttataaggcttgatatatattgatgacttgatatatattgatgtctcttcctttgtgatgcctgctataataactaaaagcagacatatcatgaaatcactactcatttggataagtgttacaaaggaccttcataaagattcagtgggctgggcacagtggcttacacctgtaatcccagcactttgggaggccgaggcgggcagatcacgaggtcaggagatcgagaccatcctggctaacatggtgaaaccctgtctctactaaaaatacaaaaaatcagatgggcgtggtggcgggcgcctgtagtcccagctactcgggaggctgaggcaggagaatcatttgaacccggaggcagaggttgcagtgagccgagattgcaccactgtactccagcctgggtgacagagtgagactccatctcaaaaaaaaaaaagagagagatgcagtgatggcaaatctactagaagagggtggaccagaaaaacctctctgaagaggtggctcttgatccaagacctataggataagaagaagtcaagcacacagagtatgggaaagggcaccccaggcagaaggaacagaacgtataaagccgagtggtggaaggtggttttgatgggctcagggggaaaggggccagtggaaatgatgcatggtgagtctgaggataactgaagctaaagaagtgagcacagagagctctgtcagctagggacagtgaatattctctaaatgcaatggggagatactcaaacggtttactggggaagacatgacctgatttgtatcagatggaatgtgaaaataaatcaaactagagtagaagtagaaagggaagcactctgtatggcaaaaactgcaaaattcttcctagtagccattctccactcctgccttattatgagaactccaattttactctggagagcagcaggcccagtcaaaaattatatttctcgcattctttgtagttaggcatggccaggtataataattctgcctaatgaaacctacatggaagttggctggggatggatttttgggcaagtttgctttcttgctataatgacgcaactccttcctgtgtctttccttctcttttcttatgtgatttcagctggaaaaagaagatgtgatggcaggcgaagcagcagcaaccatcgtagacaactatccaggtaaagcgaatagcaccagagagacctcagacctggcagccttgaaccactggaccagtaccaacaaaccccacatctggattttactgtgtccagagagaaacatcttctacttgtttcagataccgtttggcagaattttctgttactcacatgtggatgccgtgtctaactgacacatcaagtaaccaaagcctgacttgggtggtggcggttacaatgaagaagggtgggccgaatcggggtatatttttgaaggaagaaacaatgggacttcttgatgacctagaagtcagttgtggtggtgggagatggcagatatataaaaagtacaagactttggcttgagaatttatgagaatgggaaggaaaaaccagaagaggagcaggtttgaagattaaaagcaaggattccacttttgatatttcaaagttgaggtgcctaagaggcagtctccactcctgtggtttccaggagacaggatcttgctggtcctgccccaccccttcattcactccttctcagggagtgatgagccagcctgcccagggggagtgcctgttctgctcacccactcccttgtttaggcatccaaagtgtagcctccaggtaatgtggctggggccttcagtgctgcctgaggctggatgctcaacacaacgtccaacattcagaagccaattattgctgtaaatctccacgtcattttccaatttggtggtaataccaaaaagtatttgtagtcccacatactacacttttctgtccctctctcagttgcttcaaatatgggccaacttacacctatataatgacaggtagacattttgcgttctttcagccacatcacaggggcattttaataggtgcctctttcaatagttactgccaaagaaaacgaagttctcacctattcatggctgccctcttatctttattgttagagccaagggttgagtcttccttgctcattaggactataaactgcatggaaattagaacttatttaaaattgatgccagtgagcaaaagataaaaacatacagtaatcatttcactgttcaggcatatgacttcttaccataactctgaagaaagtgtattattagaattgttttactatgctctctctcatttttctctaccagttcactcttaccttccctccatccactgatccattctcttcttccctcctttaaaaactgctgtaaatattgctttttaaaaattctatccctaataaccttagagtttctagacatacactcttaagtaaagggccattcctcaaggctggtgaatctaggtaatgtggtctggtatcagtctgtgtgaagacagaagtcttatttttcctattccttttctttaaagacagattggtcttatactggatatttgatcacttatcggaatttacatttgggaatttgttatatcatatgctacgctgctgtaaaacctgtctttgataaagtcatgtaagatacttttacatttaagatctcagttttgccctctcttccatcctatcctgacagatacattattccttgtgtttgcactgatgaaagaggtgataggcattttggcacactatatcacagaaaatagtacttatcttcagaatggaaatatacatcccatatgtcactaccacatagggccctgcacctggtatggaatggagcatggcattgttacagtgtcattcaatggcttttaccaagcaagagaacatcggcagctgtgatgcatgatgccactgtgacattaactacagacacagatagagtgcccataaaaaaaatatacgccctttttttgaatagagccctgggtaattaccctgactattgttctaagagaaagccccacttacaccccttcatcatttagactctggacataaaaaaaaaatcactggcattgagtagttaaggcaatttgctttccaaatgaagaaaggacaaaaaaatctctactcttgagttgcccattttgacagccacagctcccccagataaaagatcctgaggagtttttctgatagtacccttttcctacacagagcccaaggaaaatgtgttcaagtttgctttctactgtcagcactaggaggacataggggtctgtgcggacagcctgcaggtgaacggtggcggccctgcagctatgatatgaaccatggtgggtccagcaggcacagatgcatctagctgccctgccctggtggccaggcttgctgttctgaggaaaagctacagaaacgttgctcaccttgagaagtaaactctcagggcagggtccgtgttcctccaagttgccacagaacatgaaataggttatgaagtttgccattcaatatggagtaaaaatgggaaattattgaactacttacccccaaatgaaaaagtaaaattaataaaaaagaaaaggcaaaatcacaacaaaagagatggcccccaaaattttacttacattgagtgagaatcccagttaaggcatttttaaaattctccttggcttcctccatctcttgctcatgggtggctttttcattcattagccggcggacgtggctgttggccgactgcaccatggaatagaactggtttgcagagcgccgattcacttcccctcgttcaatccaggaaagcagcactgtgatagcctctgaaaacttgctatcatctggaaatggaaaaccaccaagtacaaatcatgccaagatgagaaaatacactttattcttgttcctctcaaaagacagagcatagtccaacctagtggatatattttcagaactcagcaagttagctttcctgagactgactgccatatcatcacttaacttctcttttcccatctaacttcagggcaccacagaaccactcaggaggttcacactctcatctaccaactccatgagctcagctgtaggagatttgttctgggcattcttaggaataaggtacagcctcattcttccaccaaaccttgatttctctttcttaagatggacttgaaaaactgttactaacctacttggcctccacttcatttctttgttcctttatcaaaaatattatacagtgttaccagttttctcatttatagaatcagctgagttagtattaaaatgtggaagaaagattggatttttttaaaagtgtttgtaatgtatggtattgtccctaaggcaggtagtaggaataagtcaattcttgttctactgtagttcaaaactaattccattttagggctaataccatatatttaattaggctgaaaaatagaatatttcctaattttccacaaaagagaacatgtttcctgaagtgttccgtgtttgctttagatggctatggagagcccatctgaacccagtttgagatgtatgtgcatggtgtggcggggggataggaagtgggaaatgaagttccgcctgaaaataagtgataaagtctatttcaaagaaaacagacttgcctatttggggatggttactggaacaaacccgtgttgtatggcttggaggtggagaaaaagaaagtttgtgggtgattaagttaattagaactggaagttgtatgtcagttgttagaacattaaccaatctgactactgctgaaggctcattgcctactttccaggcaaacctgaggggagaagcttttcattgtgttctgcaatccctagaaaatgtgctttagggaaaaataccctacatttttacaagtaaactaggtagactctgaattctaaaaatcaggagcaaaattagattgaaagattcagattctcacccattcatttaaaaaatactgagtgcctactgtgtgccaggtactgtcccctccactggaggggcatcggagacatccttatgttgtttgcatataaacatacatacactccacatgaatagacagggggagatgcatgcttgagaaaaagatttcgtttcactcaccagattttaaaatcaatcattgagttcttattagtattttacacatcatacgaaaccttcccaccgttgagtgctttgtaaatttatagggtgctttacaaacatctttagtatcttttctcccaaagacctcctcccagaccaggagtacagcttccttagcatggctgctgcttgcccaggaggtgtgtgtcctgaatgaaggtggggctgaacctaattcaaggtcctacggctgaactctggaaacctctgccttccccaggaaagaaagcagcttttagggatgtacccatgctcaggcaccattctaagtcctctcctgctgcacagcagccttctagatttggggatcaaaggttttttttctgagcaaacctgcccccctgccctcacactttaaccagaggagataactggcctgggaatgcccacaaaacaccctgtgaatgacagactcaagtttccttgaaaatctcaacccataggcacagaacacacttactgagtatcgtagccacttataccattttgttaactctggaatttcagtctaagttcaaccctcagtgaactccagctgcaatggtttcttatctcatttcatggaccgaagcagcttgtgtaagataaaatctatcacacaacttaacattacgttcagcccatggagaggcccataatttagcatgatgtttgtgagaggcccactgcaaccgttactggcagaataaattgtgcctccctccacactctctacctctcttcccaccaatatatgttaggagaatggacctcagaacagacagcagaaataaacctaatgcttagaagaaatctttttttttttcctctgaaaagataacaacagaaaaagagaacactgacttcatgtactatttttcccctttgctgtgagtttcatgtctacataacacagagaaagaaaaatccttaacatttttgttatgagctttgcagggacagagtgtaatgctgttcacctctttctgtcatatacaggtagtttttccttctcttgcttgtggtcgcttagttcataaatagactaactttactatcaggaaaaaaaacacttcaattttaaaaatgcatgtttgctcaaatgctctgaaagccacattttattgcccttcacacctagacctagagcacaataagttcaccagcagattatagtttcagaaagaggaaacaatattcttaggattaagccactgaaaatacacaatttcaaaagtaagtagccaagagattttctaacatgttaacaagtactaggaagcagaattccattagcctaaaagaggaatatagtttcaaagactcccaatttcatcttcatttctgaactttctgaaactgacaggccgatatatgattgatgtactgacattcaaattaaattaaaaaaacattagttaaggcatgcttgataactccagtcaatatttgttgccatgtaagaagtgactttaatttatattaattaagactaagtcagtaactccctctggatggctacaggaggatattgggagcggtcattttcaatactcaactgtaaattcaattttgtattcagtggaaagatcactgagaaagcagaaaacaatataaactaatttaaacaggatttagattgcagcattattaaagctattcatgtggaaagaaattaacactgcttgtaaaaatcacatcaaacatgcacttataaaaattccaaatactttctgtgaacatgctcaggcataactctgaactggatgcagtttagaagctagaatgtgcagatgtgctttttccactataagaattgagaacgattggtatatgatggagtgaatataaatcatttgctcattagaaattacccaccgttttctaatcaggtcctcacaatgttaatgcacctgagttaatggacaggtccattcacgggtcttgcctttttcccttccatccgtccgtccccgcttcctttgccagagccctctttgttaaacagcacggcgtgcctccctgcatctgctcatgctgtgcacttatccttgggtctctcccactcctggtccccctggtcagctgttattcttccctcaagattcagcgtaagtgccctttaataaagaaatctcttctgcaactctaggatgaattaggtgtctctttgctatgtttccacaattccccgcatatcctgctattaaagcattagtcgcactgtatggtaattgttggtttacagatctgtctccagttttgaggggctaatatgagaataaaatttccaaagacatatttctagacatatttctgtcttctggttactctgagtttttccctttgtattttatattttattgcattctacagtagttcctccttatccacagtttcaccttctgaggtttcagttaccctaggtctcagttaactgtggtcaactgcagaccgaaaatagtaaatgcaaaattgcagatacaagcaattcatacattttaaattgcacactgttctgaatagcataatgaaatgtcacgctgtctcactctgacctgaccgggatatgaatcatccctttgtccagggtatccacgttgtctacactacctccctgtgaatcacttggtagccacctgggttatcagatccactgtaatggtacagcagtgtttgtgttcaagaaacccttatttggcttaataatagccccaaaatgcaagagtagtgatgctggcaatttggaaatgccaaagaaaagccaccaagtgcttcctttacgtgaaaaggtaaaagttcttcacaataaagaaagaaattgtatgctgaggttgctaaaatctaggataagaacaatttatctatgaaattgtgaagaagtaaaaagaagcttgtgcatagtatatatagtgttcagtactatccatggtttcaggcatccactggggatcttggaatgtatcccccaaaggtaaggggagactactgtattcctaatagatttgtagcaattaatactggaaagatacaaatgtaatggttaaaagttaggaaacatcagagttgataataaacatttaaatttcatgtcaaagagtattttcacacatgccattatctacgagagatagatgttctcatgacaattaagctgaatgatcccgttatacttcaggcttcagaagtcattatcactggcaatgaaagttaagagtgatgtcagataatcccacagaagcaaggccctctgcagtgaggcactaaacagtttatcaaataactcaaaaatgtttttgaaagcatttttaattctgggaacgtaattgctctttagctttgtgaggagtaaataatattataatgatactatcagatgtcaccactggaatccacgcccatctcatttcatttctggttatttcagactttgttaacccccttccttctccctctcttccacatttattgagtacttggcacatagtaggcattacaaaactgcatatgggagaactctttgctatattctaagaccaggtgcaggagcagcctttgtgagcttgttaaaaacacagactcagcctttctcacacctccagaattggaatctgcattttactccaggtgatttgtacgcacatggaggtttgagaaacactgaagaaaggactcagtgaaggccaggtaaactggttaggagctgaccaaagtaagagataatgaaatcctgaagtggaaagtagcagctgagatactagagactttcaaaaggaatagatgtgattcttaagagctttgtgagtctctatccctgtccccacgaccaattaaatccctgtccccacagctgtcacttctatccaggaaataaaaagggttcaagacttggaaatgggcatagagattactatagaccctttctatggaatgctgggcatgaattacctaattctacagggggtgggaaactttaattctttggctaatctctgactaggctattttacaactttgtaggagtagaacataaattgtggcaaactgataacaatacaaataattcgtctctgtaacaatgcaaattaatttttgttcagtagaaaatgtaaatctttataaagcgaattctccttcgaaacagttttaacattttcttggtctccttattaattagtgagttaaataaaatcattggcacatgttcattttatatttgtaagacagtcatgatttcaccgccacagtattctttaacaaaagacagggcccatgctacagtcatatctgaaagtccagggcatggcacaaagcgatgggtacctggtgaattttaattaaactgatacatagataatgatggggaaaataaaccaaattggtaagtgttttttgtttttgtttttgagatggagttttgctcttgttgcccaggctggagtgcaatggcatgatctcggctcactgcaacctccacctcctgggttcaagtgattctcctgcctcagcctcctgagtagctgggattacgggcatgcgccaccaggcccggctaattttgtatttttagtagagatggggtttctccatgttggtcaggctggtctcgaactcctgacctcaggtgatccacccatctcggcctcccaaagggctaggattacaggcgtgagccactacgcccggctggtgtttttttcctcccgctttgtgtgcacagggagaagcagccctgaatttcagaacaatagataggataagagccaagccgggagcactgaatacgaaacttaggtgggctatagtatccttatttacagctgggtctataaaggaacaatgaggagacagggattttatgtttgaacggaacgagggaaaacaaggaaggcattctaaaatgcttttctttccaaagaaatggagggacacacacatgtgtacacacatacacacacaaggaaaggtatgtctgtagttatcactgatttctggctccaaagatagctggaaattgctcacagtgtacagtcacagagtcatctaagcagatttggaatttcagtatggtcaaagcattgctgctatcacaatccccaaatttctgtacatgtccctaaagaagtctccttttcctggctgctcaattaaccccgcatcaactaaccagatcacagacagcataaaaggctaaacaaagagttaatgttcccttctacccccaaaacacacatgcaatctccttaactatttagtagctgtaaaaatgagaaaattaagggggcaatatgaaaatgcactgattattcctgctttagggtcgagcaaaatatttctttttattttatttatttattttatttatttatttatttattttttattatactttaagttttagggtacatgtgcacattgtgcaggttagttacatatgtatacatgtgccatgctggtgcgctgcacccactaactcgtcatctagccttaggtatatctcccaatgctatccctcccccctccccccaccccaccacagtccccagagtgtgatattccccttcatgtgtccatgtgatctcattgttcaattcccacctatgagtgagaatatgcggtgtttgcttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccaagcaaaatatttctaaataaaacggcctatcttgcctctatgaaggtcaataacacataaggaaataatttgcaaacaggctcctatgtttcatatttcccttactctatgaaggaagcctggcttttagctaatgggacatccacttggctcataacattattgatttttactttcatggaaccataaatactgacaaccatctcagcaaaatgctggtaccacatctgccccttcctccctctggcaggctgacatgaggctattctatatgcaaataagagtccagttctctggaaattatgaatgttgatcccaggaggatggtattcttgttgacacatcaggaaatcccaaaggccctgcctgcaaggctttgtcaggacgtcacctaattcagagagaaactcttcatttcatcacaaaatgaaagattatgtgaagctttctaagggggtacaaagtacgtaaaaacttttaaatgctcttgccaagagaaatcccggtgaattagaatataatccttcctcactgtctaatcaatctcttcctcccacagtccaaacacagggttcctccaggggtggatggtctgtgttagacacactgaaattcattatctcatctgcctggttgccactgtttccaataaagtgtaattatggtgttattgagctccttcccactttctcaaagccatgctataaactttgggtttctgagcagttacttcccagtcggtcttcattaagttgaattgtctcggaacaatgtctgtttaaccagcaggatgcttactaattttcttttttagaatttgtattaatgtaacaggcactgggtgactccatgtctcaggcactacacaaatacaacacagtgttacctctggtttcagaaggtcaagtagccagtgaatgggataacctggtcccagaagatcctccctctctcactccagcactgcccatccgggctggctatctcccctgtgacagcactgtgcacttcccacatataacaggaggattattatatttattataatagtgcactattataagtggcaaacgcaaggtgatttgttattgcctgtgtcactcaagacacctaaactctttgaggcaggggcttgttcaccgttgtcctttccaccactggctaggacagcgccagtcatatggtaaaatgctgattaacgaatacttcttgagtgattggaaggatggctgagcacacatcacatcatttccatgtacatctggtcatgcccagtagaaccactggacagaaattcaacgtgctcatagatccaaatagcagaagaagagagaaaataattatttttactgagcacctactatgtgcacagttttagcattggacaggacatggagagggccttgtgggtcataagaaagacttggtttgtacagattttgctaaataaagctgattttcaaagagaaaattgtaagaataaacaagtatgatataaaatagaggaaaagtatctgtaataaatctaagtaagatttctcaggggaggaaaaaaatcaaatccaattaggtattttcagattgcatttccatttcctttctgacacagatttctttaccttaggtattgactgtattttatgtccccacatcaatgaaatcatcttcagggaaacagtgtcctcagctcctcctgtctggctttgcaacattataaggagcatggagtggatttcctctctaaggcagccaatttcctaagcaattaaatgctgtttatattccaaactctatgcttgggttgaaattgtcaagcttgatattacctgactcttgcctaagatgtatccccagctagttcattctactgtaacagccatctattaaaatttccaatctgttctttcctcaagggatcacacagtacttggcaaaggtacagcttctgaattctgtaaattatactcatctatataaatatatacttttgaaatggcaaggcttgcaaattactttaccaaattgacatcccaatctgttatcctctaaaaggagcggcaaatgccacatacttcatacgtgcggagacacttctgtactgggttcttaaaaacaacataactagatgatacgcttttatgaaattcctccaggaggtcacagatcaaggtgcagtttttgtcacttctaggtgtggacaaactgaatacagttagtctgtgtagatcataatctgataccacaatacattggatattaaagaaaaattattgttccagtgaatactccttgttgagaacattgctgctgtatctcattttggccactccttatggtttctaggctggagggaaaagtgagatgatatctgtatctgcactgcatatgccctttattaaaggcacagccatggcctatgtatttacatcagtaagacatgttttctcaaagcagcagacacaccacaagagcatcagcaagaagcattccttggttacggtgcgggtatttcagtggcagctgcagttgattaaggattctcaagccctggatgggggatgaagattggaagcacagcacccccgctgccacctttttttttttttttttaaagcatagaatgtcaacttcctatcttcctaaaataggtgttaggcagcttttcatacattttttttagtgaaaacatccaatccactttatacactgccagcaatacaccagctatgttctaaaacacttgaaggatcaatcacatccctcttctcatcagaaatctgttaatggcttctccactgtttatggaataaaacccaaatccagcaatagccttcagggctctgccatctggcccagactgccattccagctttacctcactctagaaaggcagcttctatgctgaattcctttctgcttctgtgggtttttattcttaggtctccagcctctaactagaatgcctttatgcctctttttatcctggggaaaaaaatcttatttattctgcaaatttcaaattatgcctcctctataaagactttcttgacactttcatcaacattatttgcactggcccctgagtccccaaagcatattgcatttaccttggttgacaatcatgccattgacttggtattacagttaattgtttatctgtagacacctacatgtggccaccaactgtgacttacattctctcatcaaatcctgacagtgctcagtgacctcaggagggtctgaccatcatttgcctgtaaaatgcccatatgttgctcagctcacacaactttggtcagtaatagaactgaattcacatgtcatcctaacttcaaaatctggcatcactgtagttcacgggggcaggtaccagagccttcctatgtctttatttcccacagcataaaacaccagggagggcctcagaaaacattagaagaaataaaacatactctcttctcttgctagtcatcctgtaaatgttgcatgtgtcccttcaactgcatctctgaagacagggatcccattctatgtttcttttctatcctcgatggaccctagtaccatgtctgctgttttgcctgaagaaggctttaggagtctggtaaacatgcacactctatagagctggaggaacactaagaacgccccaccaatggcacaaatagttgctggctcattaaacactgggtcagaagataatagcctgctttggggacctttctgtcccctcattcagtgagttttgttgagtgactgtacatacacttttatggagaacatgggtgagcattctggaaaggggcaggggtctgtcccaggcagaagatgaagcccaggtgtctgcagcttccaggagaccccccagctaaccccaccccagctctgtaaagagtctgtgcttacaccagactcttacagccttcttaaggcatagcagacattgtgctgaagggacaatggtggacgcaggagaaacgcacagggttccgtgtctggggatccctgtggaggaagaaaagccagcgtgggtggcccatacctttcagcttttcagccagcagagcggcttcgtgctccgagtagtgcattatggcaggcggggatgggggcctgagccggtcctcctccagcttgcgccggtgccgctcctcccgggcacgcatcctctgcttgcattcccactcatagaagtcatccctggcctgggcaaagtccacatgaaggcggcctgaatcctttttgtcggtgctagaccctaatcgcatcctataacctgaaaccaatggaaactctggtcacaccataatgtaacaatggccacagttttggtccagaccttcaaggcacgcttaggcaaatgctcacttatttcttggctgtcactacggatacatttcccataggaagcgggaaacaattatccttttccccagcaatcttgaagctctgtaaagttaggcctattacaggtttggggataaacacaccttggagagctgtctcagagggctgcttacccatcttccaaaccagtatccccaagagaagatgatctcaggaactagggtcttatcatgatcattccttcttctccctggcttctaggaagctcagaaacaaatttggcatggagcattttttttctctacctttttatggccttggttttattatattttcagcttactataattctactgtataggtgaaatatgagtaaataaagagcatctatgatatttaaaaagatctacaaagtgaattccagacacctcactcacaggttattgctacattcccccagaaaatgctgctgctcaattctctctcagcagctgcaaaagccacaattaccaaggcaattttgcaatgctgttttatttccacttatcctctggggtgcgcaggagaatattttaccttcgatcaagaggcctcgccgctgcctgcctcacagccctgcagcacctcatctggtatgcagcaccacacaaattgttcatgtaatattttaaggccacagcagccccgtgcaagagcccagagctagacaaagaaaaaaatgggcctggaaatctttgggggattcactgtgagctacccaacttagataaagattatgagcagaaatttgatctgagagatcaacactaacagaactgaaaccagtcagccggcctaacttcaaatgaagaagagttgactttgaggttgctcttcagtttggggtactcagattttcagaacataaatccaggtcccagcagagacacagctgctgggggctgccagaggagagagcaacataagcacttttccagtatgggggctttgcaaatgagatacaactgtaaaatgctaggctgcactgtgctgatgttcaagatctcatggtagatttcaatggattattttagcacttggggataaacctcagctgaaaatctctgtagaggctggctcctccccaggatgccacttcacacctttgaaaagttacaaataagatattgacttcacatctggtttctgtgatgccttggaacccttctcactgctagattttcaagtgttatctgaaaatgggaagacataacaataccaatcaaaaacaaaaacatctaatcacagatgtgcagaattaatgcaaaagcaaaatgtatcttggttgtgggccatgggaacttaacaagtcagcaggccacagtgatacacgcataacagctgagcaggcaggactgtttaaactggccagctatcccaactggccaagcacctttcccctgctcatgtccagagaagcagttttcaaacatttctggctccagaaacaccctcactttcacagaaacatcatcattaaggacttaaaagagaccctgatgaggctgagtctaaaattagctaggccttcaaacgtgaatgtggtcctaaaattagacaggccttccagctgggcttgggcttgggcttgctggagcccacaaacaggaggggccgcctgacttccttcctgcctttccagttaattggccttgcagatcttcctgggactgacgctgcagcctctcaagggcagggaggcagagttaggaggctcctctgcacccaggtagggaagctggaggtgaggcctagctgtcttctcctcctacagtaatggggcagaccaaggagcaatcagagacttgctgagagaagcgggaccagcacccaggctggaaaatcataggatcaaggtataatcaaggagcacctttcatatgcctaaatttgggactgttcatctttgtcagtgtcttatgaggcttctgattgggtgtgaacattgtgttgtattagtgttgaaaagggcctctgatttactctaaccttctcatttaatcaagtagggtaaagaatacagttgacctgtgagcatgggtttaatctgtgcaggtccacttataggtggatttttttccaaccaaatgtgtatccaaaacacagcattcgagggatgtgaaacccacatatttggagggctgacttttcatatacatgagggttctgcaggatatacatggggcgggggcggggggtcctggaaccaatcctccaagtgtactgagggatgactgcagttttcttggtacagctgtgattagaagccaggtccccaggatagggttcttgagatagaaaaatccgtccttctttatcatcatcaggatatttgtgttaaaaacaaccatttcctgaatggtttctatgttgcaggtgccctgctaagcacttaatatccattatttgatttattcctcctcacagtcctacgaggtcatgctgttactatctttattttatagatgagaaaatggaggcaggctctaggccgtgaaacccagtgccacaaactcaccagaacccccgttgtctaacagcggattgtgtgttatgaaatgtcttcattctaggctttgtcttccttctccattttgtattgcttttagtttttattttctactttgtaaggttttactgaaataaggggttttaaagttctccatatcactgtctaccttaggaaagtctctgcagtattggaataacctcaagtcttctggagtttgcacagaatttcgtggcaatagaggtggactgcagaaattaagtaaaacctggcaggaatgctcagataggtccccctgcccctccccacccccacccgctactgttttcccacattcccccatcagctttgcctcaggaatagggaggtgaaatgcagagggacagactgaaaaatggaggtggggagtgtgagggaagggcagtgagttcagtctgagaatgtgtccttccaaagccagcccctaattcttgggtttggcaaaggccttgcggacagactccattcacttggcccaatacccacagatgggaaggcagcactaggcctaatctcagtatctgtaaaaatcgcctataaaaattgacaccagaggacaaggcttaatgaaccaccaacgaggcaatgatactgggccttctcctagggcccctaagctactttcctgcaaggaactgaccttgctttggtaccttggtgtccagaaagtgaatccacttccaaaaacctgaaattattctgagagagtactttactcctcctaaggattacatccagtaagaataatggtccttagtactcataatattgcttctcatctaataagcacttgagaacattaattagaaactcgatggaattcctaaagactggatggtgggaaattgctcctgcagtgaagtaccttcacaggcttagcgcagagcttctggcagccaaggaagaaggcagaattcctccttttccagccccaaactatgaagactttattttgcatgaaggccaaagggaataagctcatattaacatcacaaaacataacaaaatgcctagaaaactccttatgtaatgcaaagtaccagaaaggtaaatggctttatcaaccatgaattcctctgcaaagcgaatgtgacaaaaattcttcttgcttttccgaattgctgtaatatcaccgcactgttcaaagacttcttgaataatttcctcagtagcattttctggtaatcctccgacaaacacggtcttacacccaggaggtcgttctcttgtggaaggaggtggaagatctaataatcacaacaaaacagaaagttttatctttcatttatttgctttctctggttctcctggcaaaactaaagcttgcagagtaactttctccagactgagtgacggtaaatttctatgccaacttaacattgatcccaggctgtcttgtttctaagttcctctcccctcctgctcccaacctttactttctgtgttcattgctacacagagtggctatatgcttgtccatgaacaaagataaagcaaatgtttgcataatttcatttctcctttatactacagaagcccagaaaagggagggaaaaaacttcccaaagtacaaaacatgacgaaatgacaacatgatgaaaaacctcagcgtgttatctgctttgtcttgtttccagataaaggagcggcaaaacagaatacgggaagcataacctacaaaagcacgcacaatacttacttggctgtgaaacaccgggcctgaaaaaaaccactttgttattattcacatttaaatgagcaaactattaaattttgggaaggctgtataaaaagatacaatgtacactctcacaatattttacctagtttatatgtagattactaaagcaatctcctgaaaagtccacttaaaaaaggcaacactgattaatatgaatgacaaaaaaaaaaaaaagtcctagctcttttagcccataaacttagtatctgaggcaaaattaaaaaaataaaattctggcccatttacttcatcaaatgtatgtttccttcaagcaaatacaatttggtccagaaactctgagatgcaggcttccctctccccagcccccaaattgctaactgtcaaattaattccattttccatctagcaaaacatatttcagagtttttcacccacatttgtgaagatggatggaaatgctcacatatttcacactgtgttctccggcaaacactaggcttcactgcatgcaaaaagtcttaacgctggatacacatccctaaatcccacatactggctttatagtgtggattcagcttctggacagacacgtggccacatccctgtatatttattgtaacctagagacaaaaggccttctgtagaacggatccccactctgtgcatttacgtgtgagtcacatctgaaaatgactgcaatgccattttaaaatttaaaaagaaaaacatttaaaatgagcaaatatttctcataggcgttacttacttggattttgaggaaaaagagtacagcttttgcagtggattatttctttgacaacagccacttctgttggtggtgggggaggtaccagtccaaggcctggtatcattgggttaatgggggtgattccagtcatcatgttgaggcttggatcaaagcctgggacacagattgagtctgtaaagtatacaagataacattttgactggagattaaatccatttttgttgttgtttttgccattttcctgtggattatttgactttatactttctatttttcaggaatttctcctggcataagatataatattatagaaagctatgccagaagggtaaagagaaaaaaagtaaaagatgaacattaaactacatgaaaaggaaattatattacttaaaatattaacatggcagaaagaacacagcatattaaaatgtaaaagcatgcaccatgaagcttcactattactgtgaatgcaattttctatttcttaacgttggtgtattgtttataccaccttatgacccagaatatgggaagaatatcatttaacattgaagtgctctgtgaatctaattgtcaacgtggtttcatcaaaagagccttcttacccaagtgacctagatttaggaaagttcaatttatatgtgcatactttataatgatgtattcaggtcccacctaacctatttcccctggaataaaaaaaaaaaaaaaagcaaaacaaagagtgattacaattactatggctgggttagatacatgcaggcataaaattagctatatacatttctggcttctattggataattgcactttcttcctataatttagtcaacaaagaattgacccacccttttgaaatctttatgccctgtattacacacacacacacacacacacacacacacacacttgaaaatagaaagtgtgcaaaacaaatgggttttccagctttttttttttttagtgtgataatgaagcaagtgatttcaaaggtggcatacagacactaataagtaagacctttctaacagcaggggctatgaaaatactatactgagtagccacaaggggatcccgttcatgagggtttccctgttggcagaaaagtctcatgggtggcgtgaaaatgttcccagatagacaggccaggatagatcatggtgccctcctctactctgcaaggatgaaacttccttcttgtctcataccatcctatcttcttctccctcctcatcttacatcacttccagtcttccttcctgcccgccacccctgcccccgacaacccctttgtacagttctcctgtacagcctgtgccttaggcctccgcatggcctcactcttcgcttacctgtgctgaaaggctggaggagcccagaagcagatgtaagaataaccacacgctttgtttactaagaagctccagagaatacagaaggtctagcaaaagcgtttcctttctgggaaaaggtttacagattccgccagctactttggacatttccactcctcctctgggctgaacagaataaacaatgtgattctgatctataaccccaagaggactgctgtcccatttattaaaaactccatttaatttcatagtgtatcagtgtgacttcagtaaaaggaggatttttttttaaaagaaaagaaccctaaatataaatgacaaataagcattttctttcaaagtagtcaccctgacattctaggtacttcctctacaattatggctctcagtttcttcatctgtaatatggtactgtttgactggattatctcttggagtgctagaattccaagactccaggattccatgctgatgttgctcagtacaaactgacacacaaaagacttaaagttttataagtgacagagatgactctgtttattctgtcaatcatcagaaagtttcacaagtatgatttccattttacagaaaagaaagtaaggcttaaagtacttaagtaaaacttctaacattccaaatcaaacagatggcagagtcagaatgagggcccaggtctttgcctcagtatttaaacatgtattaaatgtgactatttcaaagtttccatctagaatgacccaacatgattactcatctaatacatgccactacttcttaaaatgtactttacccttaaaaaaatcaagatgggtcctgccgatcaattctaaagaagttccagaacagaatggttttcaacatcatcatcattaaaataacatattggcctccaaggtgaatatattagaaaaagaaatattggcaatgggaatattggcatgcttgtgcttttatttaatctcattccgtacatcggcttcatctgtttttttcctggcctggccctcgctattatttgccaacacaggatgatttaaggctgaaaccactcaggactgcaaaccctgaaatgagagccctgtgaattataatcagcagatgtttcccacaaatgagaagagaagcccagtgcttgcattctctttagttgttaacagacttctgttttctttctgaaggctaagtaaataaatatatgtccagaaatggggacagaagataccactcttgtacaacgtattttaatatacagcaagagttgctttgcttttttctgagacatcagtatgaggagactatgaggtttaatgaaatctgcatggcaagtgcagtagcttgaaaagagcttagaaaggaattaacacgtaaattatgttggacctgaaaggattggagattcagtatttgagaggagaaagtaaggaaggattagactttaagaaaaaaaaagaacccattacttttttaacaatatatgtaaagatggaaattgttttctctaacagcacaggagcatatgatgtactcgctcattaaagcaaacgcacaaactgaaaatcgaggaagacacaaacacaggaagacaaaggggagaaggcagcgcaacccgaagaatcagttccatgccctgttaggaaaagctgcccctgtgagcttcagagataatgagttgtaattctactcagcgcaaagaggaggactgcttaaatcacagcaagaaagaatccaattacgtatacagtagaactttatcacaactgtactgaaatgacaggaaggaagggttattcatcacagaccgtggccctgtctggctcctctctgtgttgccggctccaagcagagactggccacagccaaggctcggcaaaggtttctttttggttgtctgttcccagttggacgagatgaaaacaaacaaaaaaaaatcctgtttactgattcacaggccagtgttttatcaattggatgagcatttttcagaaggcaggttggggctttgtgttcaggattttagaggcatggcagttgaattaattaaagcactcattcatttgaattaaagatccattcagcatttcctgggcacgtatgactgccaggatctggagttacagaggtaacagtagtaagttccccacttgagtttgaggagaggataaaggatgggaaccaaactcagcaaaagagtcgggacacatgagctgaggctcagaggacacagagagagtccaggaagggaattgctgggagagagcctggtaggcctggggaattccaaacaatttttcatggctctttcatggtgtgcatctggcagtgtggccacaatgtctggagagactgcaggaattagatcagatcagagagaccctgctgttcaagctagtgaatttcaactttgctctccctggaactcagagtcagagatgcaccctgccaggccagggctccggtgcctgggccgcccttcctcacttcttctctctttgtctgctgcccgctagccatgccttgctccttttctgccctttctagtcaatgcctcagttaagagtctcatatttgagatgagaactagatttcatttgaaagaaaggcagttgaggcctcttgccaggcaaggctgggcatactaactaggttaggtgtgggcagggaggagggacagagagaagttgtcagtactaggaacaagtctggtctggaaggaagaacatagcgttttaagaaaataataagagaaagaggcagtaatcaggctaaatggctgcattacaggtgtagtcctgggctgagggtgtcctgacaaagtggctgaacacagagattattagcgcagataaaacacaggtccaggtggggcagctgcccagaggactctgtctacaggtcacagggcctgcaccccctggtccagggttcagacccagcccaggggaaataaagtttgcaggaacatcatggagtcataagttgagaaatactaggccaattggcaggttacctaagccaggattcaggcaggagaagcaagacaggattcagacaacaaaatagaagcctggggtttggggaaggagatagacccctcagttatcagatacggagcacaggtcacagcctgaccagcataaagcctgcttggatgctgagtcttagaatgcagggctccagagcccccttcctcccgcctgacgccagatggaccctcaagtccagggacagagtaagtgtgtggggccaggtcccaggacttgtgcagggcacagagacaggctggaagggctctaacaaacatgcaattgtgctgcttctttttccagaattactgggttaaaattactgacctatcatcactctgcagagaagccacgtgatacctgaagacattctgtttaccagaagtttccagtggagaaactttttcagaagtctcctattgcaattgacaagtcttgttgttctataatgtcattgaatttgtaaactattaaagtaatgctctttttcattccatgttttcttttttcaagcattcttaaaaaactgttttgtgaacagcagaggaaaagtgaacattttaaaaaaggtgatcttaaagtcaagggatctggcacagctggatgacctaaggctgaccagctttttttttttgacatgagtgttgcactgtcatccaggctggagtacaatggcacaatctcagctcactgcaagctccgcctcctgggttcatgccattctcctgcctcagcctcctgagtagctgggactacaggcgcccgccaccatgcctggctaattttttttgtatttttagtagagacggggtttcaccgtgttagccaggatggtctcgatctcctgacctcgtgatctgcctgccttggcctcccaaagtgctgggattacaggcataagccactgcacctggccagctgactggctttttaacctctctgggcttcagtgtcttcaccaggggaaggagaacatgaatactagatagacatactggtcttcatggtcatccaagaagaacacctgggtgaaggcagtatatcaaagtgtggagacctcaagtctgcagtcatgcactggctgtatgactttgggaaatttaactaatcattctaagcctcatttataatatctgtaaaatgaagagaataatatttaccttttaatgttcttgtgaggattaaatgggattaataaaacaaaaccaaagtgttcagcataatgtccagcacatggtaaatactcaataaatggtagcaattacatacagcattaataaacattaatattatatagaatatttacataaccttatataaatatgttagtaacatagcagacacacaatcataatgatgattacaaagtctttcatttgacaaacatatgagtgcctactaggtgttgagtgttttgctaggtactctgcattcaaagacattgcaatgttcttccttcacagatgtggaaatctagtgactgaaacaacttagcagaaaataccaatacagtaatgacacttattttgagacatttaaataaaaggtgctatgaaaacactgaaaaggggacatctaaacccgtctggcatagggtttgtaagagttgacttgtgtccccccaaaagatatgttaattattattatacttttaacataagtcctaatcccccatacctatgaatgtgactttatttagaaatactgtgtttgcagatgtaatcaagataagattaggtcatactggattagggtaggcatgatctaatatgactgctgtccttataagatgaggagaaaagacacagacacacagggagaatgcaatatgatgactggagagatgcacctgcaagtcaaggatcacccaggatagccggcaaacaccagaagctaagagaaagacatgaaactgattcttccctggatccttcagtgagaacaaggccctgccaacagcttaatttcagacttttggcccccagaactgcaagacaatatgtttctgttattttaattcacccagtgtgtggtactttgatacagcagccctacctagaaaacaaatggggttgagggtggggggtggggtgggtgccaggggagtgtcagggaaggaatcctggagggggtgacagctgaccaggttcttgaaaaggatgacatctgtatatgcaatgggcatgtaaaaaggtatccccaaaatacacttattgggatcctaaatacaaagatatttctaaatgttctcttaggagaaatgttcaaaaccagtctcctggaagcagaatagctcttaggttttccctttgtgaaataaacaaactctgaagatggttacatatttgttaagaacaaattaaccacacagattatgttaacataacagaatactttacaaggtgagtgaatgcctacaaaccagatctttaagaaagtgaaactgaaaatgcttttgtaatctttccaaagagtttcaaaggcagtgaggtatgtttttcatttaaacctaagatgtgtatccagagtgagttcctggtgcctgccgtgcacactttataaacaaagacttcattccatcaataaaaccctctgtctcctttgaccaggatgcaacgctggcagaactgaggaatgcagctgtcaacagctattctaagtattgttgacttgggtgaggagatttgtgtccatgtttgaaaatatgacatgacacgaagcaaagagaatttcaaaactcctgaccaaagctggtacagagaaaaactgactgctcaaagaactccatcagatctttccagcaatctgtgcatggagcgtgcacttgaaaagcaagtgtgttttgagtgagcaggaggtaagcgctcatcacaggttctgtaaaattcactcacactgtgggccaggaactcaagggcagagcggtttctgtgcagaggactgggctgacacagtcagagcaagctgctccatgttttctggacctgctgaaacacactcttaagacacagtgggcctcacagctgagccatgaaaaccatgctggcatatgacaaccaggtgtggaggggttcattttgacaagcaggcaatggacactggccctaaccaaagattaggaaatttcaaagcagaaagcaacctgggcattacctagtcctaccatcttgatttagagatgagaaagtggatgcccagagaagtgaagtgatttgcccaaagttacacagctagttaagaggagagctggaattagaatcaagagtcctgctgcatcttcactgtgcacctgagttctctgtctctccagcatgccttcctttggatgcctctagtgacactgcactcactagctcctgacattgcccattcttttttttttaacagttttcaaagtgagaaatttatccctaatatgttgacttcggacttgataacctgtagttaaatccattgtctttattcagtactcctgggttcctgtaacaagtctgattctctttcccactgttcctggtcaaatccataaagaaagcacacaacaatacctgaaccttctcccagtcagcctcagcaccctcttccttcagtccttccatgaactaaaatccaccttttctgacatctaaaaattctaaaaacccaccttttctgaggtccagggttatccacagaaagagaccaggaagaagctgatcaacctattaatggtggtctctatctttcttagttctgaacttgtatgtataaattttagtaagttgttacgttacgattaaaaagtaatggtcatgtttactccttgctttgtgacaggcctgtgctgaaagcttcatgtcatctcatgtcatctttttggcagtcccatcacaaagttgacaaatgctaagtgacctcattctactaaaacacacacgtcttgtctgtctgcagaaggatactctcatgcaactttgaagttgacattttgaaactaaatgaaatttgcattttccgttcagttttccaaaatctgtcttcttagttctcctcctgtcttgaatttctcctcccttgtcctcaatagctataatggctagacaaccctctcttaaagttcctgttccttctaattcaccagcaaatttcttcttgcaggacagattcagccacagagggcaaggagatcctcctgttgccacatttggaaggtgaaccattagctgccttcctggcagatgcctactgggggtctggagcttggaggtgacacatggagcatgtcctcctccacttcctccctctgtccaggtagttgttgttttgctctcaccacagcattatttctgttctttcccctctctaccttcaccccttggtgtgcaccaggttccctgcaccctcaggtttgtgaactgtagcacgtgcttacagaaatatcttcttgggccgggcgcggtggctcatgcctgtaatcccagcactttgggaggctgaggcaggtggatcacgaagtccagagatcgagaccaacctggctaacacggtgaaaccccatctctgctaaaagtacaaaaaattagctgggagtggtggcgggcacctgtagtcccagctactcgggaggctgaggcaggagaatggcatgaacctgggaggcggagcttgtagtgagccgagatcgcgccactgcagtccagcctgggcaacacagcgagactccatctcaagaaaaaaaaaaaatcttcttaagcaaatcttcttagactccctccccaacactgatttcttctgaatcctctgttgtaaatttccagttttacgggccattgccaggtctcagggatgtacacagggttaccgtcaattccttaggctggaagctcatgtgtactaagttattttccctgctccctctcactcatttctccatcttgtctgaatgtactccacagcaaactgcttacaggattctgggcatctggcctactctactcctgttagacacttttgggttaagtaactttagggcttggttgtttcttttaatggcaccactcctctcagtcctggtttaaaacctctataggtaaccacatctagtgacctgccaaaccctttcagatggagccactttagaaaggatttctatatcattgtcttttttgttcccattgctaatttaggtcctcattcgctctcatctggagtactgcaaaggactctttttgtccccacaaactgtagcttctatatcccccctgtccccaccccctcctgcccttcctccctccgcctcctccctgcatgcccttctcacacccctggaactgggatcagccagcgatgcacacgggggaaccatgagaacaggccctaattggggcctctaaattacttctttcagacttcttttcacatccctatctcattagccgatgattaattttctttctgtacgatgttatgtgactttgtacagcaggactgttatataatgatagggagggagaaaaggactgaattggctcttggtgttctctgctttgtcctagctgacaagcttatggtgcgggagcagacagtaggggcaaaaaattattaaatattgagaaatatttttgaacattcagtcaagcccctaagaagtcgctaatttttatacatctacttctatctttctgaggagtggggacactccaaatatatgttgaaagactaaataaattataatttctttctggcattcaatgcctccttgctctatagaacttcctctttatttgaagtcaggtaatagcctggtgacaccatatagatataaagcccactatagtcagtatttataacagcagagatggtaattcacagcatgtaaatgtctttataggaaacttccctttgaaacctgcatctttctgaggcaatatgcaagtgttaaccttttgattttatttatcaaccttcatttctgtttacaaaggcatgtgagagataggtaacgtctcataaattttaaaaagaacaaagaaaaacattcaatatttagtttcaaagaaaacattcacatcatattaaacaatttatgtaggtttcaatttaaacttactgcttgaagggactgaaacaacacagaactggtctgtttaaataatatcagtatatagctgtagactgggagagacaaaaatagagcctgttttaaaggtaaacacatcatgaatattcctaaagagaactgcaaattgtgtgtggtctgtaaatcatagactgatctaatattaatttaatttttctactagactgtgtgggcaaggagaacgggtaacataactatcacttatctcagggtccaacatggctcttggcatatagtatcctcttcaacaagtatcagttaaatgaaagaaagaaattataaaatttacagaatttacagagttcatcctaaagagacaagacaaagtagtatttggttgttgagtccacaatgtcacaacataaattcatatatgattctaagcaaatgacatgtggtattctttctatttgtcttattaagtgaatagtaagagccatgagggttcttgttagttattcctttattatagttggaaaattatggtgatgatgacttacatttcacagataatgaggctaagaggcacaaggaatgaaggtgtgttcacagaataaatggacagaattggtctttgaatgcttgttaatatggcatctggaaggcagacctcatgcttcccttcctttctagctacaagaaaccagacctgaaatcaaaggataacacagaggggcagtagggtaagtatggtctcatctaaatccacacaaggtcatctcataccacttagcttgggagtgcttgaaaaattcaggacaggaacagggacaggagaggacatcataatcccatgcctcaggggaatactacaacctaacaggaacataactgaaaggcaagctaaccaaaacaagtttacaaaagaggcaaaaataaaatttcactcatctgctattaaaattttaaataggaagcataaaccatatgaaataaactcaatcttcacttctatattatggtgaattagtgaattaagggaaaaaggaaatacaggaactgtagattctgagtagagattagaaataaaaggaagaaataaagttgaagatgaaaagaaaggaagtaagtcagagggagagacagcagcagacagatggagggaccgtccgagttctagttcaagggtagactaacagaaactgtgcctcggttcttcatctgcaaaaaaaaaaggactaaaaagagtatttaccctgacagcattgttctgaggattagtgttacgaattaaaatatgtacaaggcttcaaagactacctggtacagagtaagcactcaacacatattactatcactttgataaacattatatcatttgtgtgtgtgagtgtatgcatgtgtatattagagtgtacatgtgctacaagactgctttcatgtccttcctttaaaaaaaaaaagcatatcctacttctcggtggctttttaagttcatgttttattatctgtcctaacttctttgggtggaaaccagaaggccttctaggaaaacaactgaggagacagtgccatacagtttctctacaaaagaaacttctccaagggaaatcagaaacctcctctttcttctcccccaggacctaagatatttttcatgcctggaaatgagagttgcagcattgggacctgtttcctctctgctttttctgccaggaagattaggtgttgtacccgacacaccaactgcacttgttcctatgtttggcatacccactttccccttaaactgagttttccctttgtaattctattttattcatccaaatgattatgtctattttgagcttttttacccacacacatacacatacacacacgtgtgcataaacacacacacacgtgtctttttaataaattaaaactgagcagcaccagacttttaaaaatacttcattacatccgaggccctggccagatttacttatttacatgttgttttgcattttaatttagaaagcaccaatgccaacccatactcccccatagcttgtcatttctgacaacatcctgagtaattccaggggcgaatttttcagagggaataatttaactaacaaattgccatttaaaactaatttatccttttgagctgagtgcaatatacttggaggagcattccttaatgacttgtttggataatgtttttctccacagtgttgatccctcaacattagaaactcagagagttaattcctcacatgaaaaacataccccaaacttttcttctggaaaggtcaagatcaaaagcagagactatcccccagatttttcattttctcccttcccttcccctcccttgccttcccttcccttctctcccctcccttcccctcccttcccctcctttcctttcctttctttcgcagagactatcccccagatttttcattttctttccttccttcctccctccctccctttctttccttccttccttccttcttaatctttcttttatcttttcttttctttttttttttttggaaacagggtctcattctgtcacccaggctggagtgcagcagctccatcacagctcattgcagcctcaacctcctgggctggagtgattttcctgcctcagcctcccaaatagctgggactacaggtgtgtgccaccacacctggctaatctgtatattttttgtagagatggggtttcaccatgttgcccaggttggtctcaaactcctgggctcaagtgatcctcccgcctcagcctcccaaatgttgggattacaggcatgagccactgtgcccagaaaggatttttcattttcaattaagtattttctgcccagttataacttcaaagaacgttaggtacttcattcaggggtctatatttcattcttattcacagaagcatctagttttgaattgttactatgcttttatgcagtgctatgttttcaaaatccttttttagtcatttaaaaagctggtcctcattatatctccaccagattcttcctcctccacagatgaaaaaggaagttgaggtttggcagactgaagacatctgcccacagtgtcactggaatcacagggaaataggctgtggtttacactatcctgctggggatgaaaatctacttgtttgtagtctccagggtggtaaagagcagagggggaaaagcaggatgcacagtattcagggtttagctgaatgtcaagttcagcttcctcatctcagatgtgaggctgcaacctgcctatttacttcacgttgttattatgagtgccaaactgtatgatggacgtttatgtgccagcaatttacaaacaagcaatcaatacacaaatgtaaattatagtcagcattttttcctattttggtggcttctgagactctacaatggtgctaagtgcccaccttgtccagaaagagaattcaatatattcagtgtattactgtgttttaacaagtatacagaagtgtgacaggtgagagggacagagggagaaaaagaacggggcggggggtgagtgagagagagagagatagtgtctatgtatgtgtctatcctcgatgcttgcaatccatggttctcagcagaactatgccattctccatgttagggtcagccagtttttatagttggaaaaactgagaagcagagtggcatactgccctaggtccttctgagatatttgctcattcaacatgtattaattacgtacaagtttgctaggcaagacgctgggggcatagaggtaagtcaggatccctggccctaaggtgcccccagtccgtggtgatgcagatacctgggcacatagctgtgttagaaagtggcagtgttattagcaaggcacacaaagtacctatatcatcatcctgaaaaaagcctgaccatactctgaatagtatgtggacttcctcagtgaaagtatctatctagctaagccactgtatccccaaagccaagcacagagcattttgtaaatacatacccaggtcagagagtggctaccccatgggccccagccacactttcaatagcagtcatttttcctgcatttatcaaaagacattttggaggcagaggattgtttggtgttgtattatttatctttatctatattattatttacctttctcctcttcctaacacaggaacattccagatcggtaggcctcttgcaagctgagtctataccaaaagtgcacacgttgtggaagactgaggttataaaggataaatctgtcacagagacagagtacaagggctggctaatctatatttgcttgttgtaactgaacagggaatttacatttgccagaatagcagaaaagaaatattagcttggacattcatgcccttattcaattatttttttttactataaccaaaacagatcttcatgttttttcaaatacatttggtcagtcagtcaaaagaatttgaaaagcatatcacaagtatttaacttccttctatcagagagtgatgggacagagacatgagggaagtgaatcatttcagcataaagcttttgttaaacagagctaagttaaactgaactaaaatagaataaattggatgtatgaagtgtgtattatgggaacttatcctgagacctcttctgttcagtgtcttttcttgatgtcttgaacaaagattgctataatacactcactaaatactcaccatcatcaagttacttgtgttgaaggcatgtcaggtgctaagaacacagaaaggttgaagacaagtgtttaggcttcacgcttcaagagggacaggaactttcagagtaaattaaagtgacaaaaaagtactttaagttattgaaaaccttgctaaaatgaaattaaagagctgaaactctacccagagttatatgactgacacagtcacagcagattataacagaaagtcatacatgtaagaggtaaatcctaattccacaggataatgtcagagaaatcaggtcctatgaagcatccctcacactgttccccttggccaccatctgtcaagaagtggtaccaggccagctcttgttattaccataagaagcagagagatatgagttgggaggatccaggtcagatggactcctaccaacctcttccaattgaaatccgggcacttctaccctggcctcacccctccacaccttgcttggctggcctgccttgcactggcctcacctgtgaccatgcactccagctacctcttggacagactttataccagcctgaccagaaggttttcttagctatgatgttcactgcccaatttttccttttgtccctgctatagtctgtattataaatttcatggttagaaatttaatgttgccaagcattaagaggtgaggcttttcaaaggtgactaggctatgagggaggttatgccctcatgaagggattaatgcttttaccatgggagtggattagttattgtaggattgggttagttattgtgagagcgggctcctgataaaaagataaggtcagtccccactctctctctgtctcacatgcttacttgcttttctgctttctaccatggaatgatgcaacaagaaggccctcaccagatggctgagcagatgctggcaccatgcccttggacttcccaatctctagaaccatgagccaaataaatctcttttctttataaattacccagtctgtggtactctgttatagcagcataaatgaactaagatactccccacctcacatttgtgattgttttggatcgttttcccacgaacaaaactcctagatatgatccttttttttcttgagtgaattaccctctgagtaaaaatctagcctttgggactccagatgaattgtggaagaaggtatgggaaaaggtagagtaattattttaaccaagtattataggcgccaggcaaggtgctaggcatttttgcataccttatttaattttatcttcagtacaacaaagcaagggaagttaagatatggagaaagtcaagtgtcagctagaagcagaagagtaggaactcacactcaggtcagttctattgcaaagctttttttgtctcaccagagctgtcaatgataaaaccctaaattggatggattatagggtctggccagaacacaggacaagatggatctttagctggtaaacaccagtatggccatatcactgttttaggccagcatctgttctgcttggtcagtgcccaagacctatcatttgttaaatatttaggcatcattgttgcccatctcaaaatgaaatgtttgccaaataccaaatgtttgacttttactctggcaaggagagagtaacagtgactggatatggtctcccacctgaaacaactaaaaagccagataaagtatatgaaacatggttttcagatactgggcatgaggtaatgcaagacaatgattcatgaaagaagtaaaacaaagtgagccatatgattgccccagcttattgccaggagagtttccgggctacagcacagggaagaggaactctggaaaagtctgacagtctctctgagtaaagaaatagttggtagtttaggatggcagcttagagttcatagggtaaagtaccagagagaagagaatagcacacatgtgtgcacacaaacacatctctccctggagatataaagcaagtcttgagttgagaactaatcagtgtatgtgtgtgataaaactacactaagctaaagaaagaaacacccaaaaggtttagaaggaataatccataaagattacaaaagactattctcatcagttagagtagaaaagcctcataattcatgatgttattgggtagaatactcagaatggtatcacctttgtagtaggacaaaactagccctagacaaaaagctgctgtgatctctcataacaaaacttaaaagcaagcctcaaaaggttcaactgcttcccagtaacttaaatgggtcctaaaataaacttcacggatatgagaatacaaaaatacccagcacctagcaaggtaaaattcacaatgtctggtaaccaattaaaaattaccaggtatgacaggataattccaaaacctctgaatatattattttacatgtcaaaggaattaaggatacagatgacattaagattgctaatcagctaactttatgacagattattctggattattgatgggggcacaatataatcacaagagtcctaaaaaggggaagagggaggcagaagagaaggttggagtaatttgatgtatgaagaattcaaccctccattaccagttttgaagatggaagacagcaatgagccaaaaaacataggcaacatctagaggatggaaaaggcaaaaaaacagattctcctctggagcctccagaaagaaatgcagccccgatgacatattgattttagcccagtgagatttgcatgagatttccaaccacagtactacaagataataaatttgtgttgtttttaagccactaagtttgtggctacctgttatagcaatagtaaaaaatgaataaaaagagaaattacataccaggcatacaaagaagcaggaaaatgtgaccaataataatgagaaaaataaaacagtagaacaaaaaaataaataacacatagatgacagaattcgtagacaaaaatattaaatattcataactgtgttccatgtgttcaagaaggcagaagggagatttaacatattaaatagagagatggaagattaaaaacagactcagaatgtacttgtagggatgagaagtacaatgtatgagataaaaaatatactgtatgaaattaacagcagatttgatgatttatttaaaaagttagtaaactcaaagaaaagcaatagaaactattcaaatgaaacgtggagaaaaaagacaacaacaaaatgaacagaacataaaagggctgtgggacaactgcaaggagtctaagatatttgtaattaaattacttgatgagggtggggcaagaacaaatatttgaacaaataatggctgaagattatccaaatttgatagaaactataagctcacagatctaagaaactcgagaatagaaggcacaagaaacatgataaaagtatatgagggaacatcataatgaagttacttaaaatcaatgataaagacaaactcttaagagcatccaggaaaaaaagacatattacatacagaggaactaagataaaaataagagtatatttcttgttggaaacaatgtaagccagaagacactagaatagcacctttaaagaactgaaattaaaaaaaaatcttttctttaactttttctttacccagtaaaaatacctttcaaaatgaaagtgacagaaaaactttttctgacataataagctgaaacaatccatcaccagcagatctatactataagaaatattaaaaaggaattcctctaggcagagaaaaatgatgagctgtaaatcttgatctacacaatggaataaagaatatcggaaatggcaaatatatggttgaatagaaaaaaaaaatttttacttatttttgaactctttaaaaaataattgcctgaaaagagcaaaaatactcacaatgtattctgggtttatgatatatatagaagtaaaatataagacagcaaacataatacaaaagtatatagttcttacaatatatatgaagagataagccaacaaaggagataaaattgaaatcataaagatactaagtccaaaaggtggcagacaaatagaaaattggaataaaaaacagaataaataaaatcaattattaagattgattttaacccaatcacactgataatcatattaaatataaacagtctaaataaatatccaaaggcagagatcaatccaatatatcagattggatataaaaactatatgctacttataagaaactcacttttaatacgaagtcataaataagttaaaaataaaaggactgaaaaaaatacaccatgctaacattaatgaaaagaaagctggaaagggggcatgctaatattaggaaaagtgaatttcagataaaaaatataattatggataaatgagtcatttcataatgataaagaggtcaatttaacaagaaaatataacaatcccaaatatttattcactgaataacagaacttcaacatatatgaaataaaaactaataaaatggaaagctgaagtagatgaatccacaattaacagtcagaaatttcaacaaccctctcttaataattgctagaacaagtacatagaaaatcagtaaggatataaaaatctaaataatatcaaccaatttgacctaactgacatctatggagtacttcacccaacaaaaccagaaaacacattcttctcaagattacatgggtatatttatcaagattggccatattctgggcataaaccaaaccttaataaaattacaaaaacacaaatcatataaagtgtattctgagaccacaatagtattaaattataaaatagtgatgaaaaatatctagagagtcaccaaataattagaaaataaataacacatttctgaatagcctgtaggtcaaacaagaaaccaaaagggaaatttagaagtactgtgaattaaaataaaatttcatgatatgcagctaaaacagtactttaaaaatgtttaaggcactaaatgcttatattagaaaagaagaaaggtcttacatcaatgaccatggcttctatcttataaaaaaaaaaaaccttaaaaaaaaaagagcaaattgagcctgaaataagcagaaaaaaaaattaagaacaggaattagtgacatagaaaaactatagagaaaatcaatgaaaccaaatgctagttctttgtgaagatcaatgaaattgataaaactccagccagccttaggcaggaaagcagagaagatacaaactgctaatattagacataaggaatgtaacataactacagttcccatacataaatatcaaggcatattacaaaaattgtatgtcaataaatttaacaacttggaatagatttcttgaaaaacacaaattaccaaagctcattgaaagaaaaacaaataatctatatagctctgtatctattaaagaagtagactttgtagttacaattattcccacaaggaaacttcatgcctagatgactttgctagagaatcctactctagtagaggttaaatcttaaggaaaaaataatactaattctacacaaactcttccagaaaattaaagggtataccttccaatttgctttatgattccagcattacttttgttacttaaatcagataaaaacattagaagaaagaaaaactatagacaatattcagcatgaactttgatgcaaattctaaacaaaattttagcaaattgaatatagtataatgaataatacatcatgactgagtagtttatcccagagatacaaggttggtttaacattaaaaagtaattcacgtaatttaccaaagtagtagactaaaaaagagaaacacacacacacgatcatctcaatagatgcagaaaaagcgtctgatgaaaatctgacatccattctctcagtaaactaaaaatcaaaggaaatttcctcagtaaaggttatgtactttaaaactacacatatgatcatacttaaaatggtatttcttcataaggtcagaaacaaggcaaggatatccactctatttctattcagccatcaggatatatgacaacatgcgtgactttcagaataactatattgagtgaaagaaaccagaaactgagtacattctataggtttcatttacataaaattctggaaaatgcaaaataatttgtagagacagaagatcagtggttgtctcaggatggggatgagtaagaaagggggtctgagtaggtaggaggaagagataacaaagggaacaggaaatgttttggtgtggctgatatgtccattattttgattgtgatgatttcacaagtatatacatatgtcaaaacttatgaaattgtagaatttaaatatgtacaatttattgtatgtcaattcattaaagctataaaatataacagatactttaggtcataggtaaaaacgaaaacactgccacagtgaaccaagctatatccagccaaggtcttggtttcaactagggaatgcatgataggagggcatggttgtcctccctggcagcaacttaaaagcatcagatatgcatatataaagctttttagtttcctaacaagagatacttaatagatctcaaattaaacaaacacagccagttatatgccaattctatagttttagaagtcagcaagcagcatattggggattatggatgaactgaacaaaatctagcataaaacatggtaccagacctcaaagggttttgaagactgtcgatgatttggtagagtgatgctaattctcactctcaacacaatccaagcgaggaaatttctccaaaataagataaaaacttgcagggttttaggtgtcattgtatatctgaatttactccacagaaattcttctcccaacttgttaaatttcaagacttctccttggagccatgagcagaataagaaaaacacagatggctcaacttcacggtaataatgattcaaggcaagcaaaccttcagctgtttatatttcagattaaaatagaattgaggagagaaacatcattctgggtgctaaaatgaatattaagataaagctagtgtaagtattattaatattgcactattattattttgggtttgcaatccataggaaatccatgtatgcttctgtttgcttcccttacaactggtattttaaataaattctgcatgctcaataaatagggtctatttactcaaaggcgacagaccccatggtactctccacaaagacttccctcatggcctcctgctgctgttgtttatagggctgcaattacagaaaggattctcagcagaacgagcaatgacaccattaccatcaacaggaattctcctggcactgtggagattctttattgaaagaaatacaaagccagtatgttgctagtagaatgcatgaatttgttgggcaatggctttctccttctggacaccaccctgcaggttaatgactctcaattctgagcatccttcttctctccttccagcaggtgttttcacacctttctaagttaagtgtcccagaatgtaaaggctgccactacagggaggcagcaggacacaatgcatgagactgatcggcagtgaagccggactgcctgtgttcacatcccggctgcaccactcactaacagtgtgacttcaaacagattacttagcttctctgtgccctggtgtgcttattcctaaaaatgaagtaataacagcactgatttcactgggtgaggattagataaggactgagatgcttagaaaaatgcctggcacatacacaataaatgcaagcaattattattattaacacagctttgttgacacaataacatttgtagagaatgaatgacagcagctactctaagctgcctccttatggcaagcacagtaggaacaagaaatagaaatacttcctctaacaatgcagcaaaatcttctgggagagagaaccatacaagaccagcctattaaataacaataattatattaataccacccattactgagtaccttctacacactgcagtgtgtaaaatgcatctatatattatcttattcattcccataaccccatgaattagatgatataacttccattttccagataacaaaactgggactcagagaaattaaataatttccctcagttcacgtggctgagacaaacatttctgaatagaactacctggctcttagccaggtttttccgctatgccatgcaccttttcaacccaaaaggtagtggtgtgttctgagcaaaggcattcaggagaaaacaaacctgtcaggaggcagagtttccaacagcacactgtctttgaaactattaaaagaatagtcttaagtgctgctgggtgaaacaattaaaaggatagtcttaagtactgctgggtgaaacttgtcacacctgaacacagagatagcaatcctcattgctgggtcatctctcagtggcaggataatatacttgaaaggatgatcagttgtttcctggttttttccttggcccctactaggtaccctgattcaaacaaggctgttcattggttagtttctcagagaaggatattgtgtagaaagctcagggaaaaaaaagtgtgtggtatgttggcatcatggcactactggaactggaaggactgtggcactgggatctagtggtgggtgccccgctttctggatggcagggaaaggttctctgatgcttaaatgagtccttttttctgtacatttgggatatttcataattaaaaattaaaaagtaattatctataagcaggagaaaattttatcttataatatcaataaataactcttagaatactctcaagattaattttgagaggaaacttataatcattaacttttatattgagcaacaattctataaaaacacaacagcctaaatcaattcaaaccttaaagtaaaaatgtttgcaacatatatgacctattttgtaaaggggcagaatccacaacaaagaaccctagtaaatcaacaagaaaaaaaaatgtttcaacagataataagtaaaaaacaaaagggaaatttaaaagagaagaaatagatatggtaaattaagatttggaaaagttcaaataaaaacaagatatttttcacacattagcaaacatttaaagaaacaataatagtagttttggtgagaatttgagggctgggctaacaatatgtgtagctagcattcaaaaggtatttatttacatgagaaaattttgccattttttcttcactggtaagaaaaaatgataaacaaccatatatttggaatgatatcaactttttaggattaaacacattcgtttatacatttgtagaaaaagaaattggaaggaaatacatcaagacacatgtagtggttatttctgcatcttcaaatgacaatttttgctcatttatacctttgtgtattcaaatttttataataaaattacattattaaaactttccttggggccgggcaccgtggcccatacctgtaatcccagcactttgggaggccgaggcaggcagatcacttgaggtcaggagtttgagacgagcctggccaacatggtgaaaccccatctctactaaaaatacaaaaattagctgagtgtgggagccggtgcctgtaatcccagctactctggagcctgaggcaggagaatcaattgagccttggagatggaggatgcagtgagctgagactgttccactgcattccagcctgggcgacagaacaagattctgtctcaaaaacaaaacaaacaaacaaaactttccttggtacattctaggttctttaaacaacaacaacaaaaactctttgatggcaaatggaagagacaggattcatgttacacatccctctgtgtccttacagggatgtgctgaggatgtatgaaatttctttgtaataatgtcgttgttttcccaagagcattatttaaggagaatggacaggtctatgggaaaatttaactttgtatagaatgatttttaggtctaaaaagtctagttcagcctgggaacactcttctatgataaaggaatgaaaacaacacaaatcacaatatcatattaaggtgattttcctaaggaaataatgtgtttgacagctgctccccattcagtgtatctgtaagtgaagagagtcaattgaaactaatgttcaccaaagaccacttttagccacccattgttgacttggatgtaaaatggtaagcattgtgtttgaacgattaaaaaatcagaaataaaattactttttgatattagaatctaaatggtccaagaatatgattgtcttggggattctttttgagaaattaattttgacacttcactcactttataaatagaaatttctccttggttgttttcttaacatgtttagaattgatgctaacacactttagtttattcattgcagccaacttttgacaacaagctttcaaattctggagtttaaatatcaaaacttgacgtggtaacattatagaaaaaagctagtggaacacctttaaaaaaatggaatgttgaaaaacaactccaatgaatttagaaatggcagaggaaaattatatgagaagatttagagtcctctaaagcaaatgatttattgaaatattttttcccccagcaagtattaataagtaccttccatatgccaggcattgttttaggaactggagacgcaactttgaacaggacagacttgcttcttactttctggaagcttacctcccagtgaggattgatagacataatcaaaaggtaaagaaagaagttactttcagattgtgctaagtgccatttacagggatgtaggagagttacctggggtgagagaggagggaggaagccgtttgattggttaagatggtctgtctggaaaagaacttttgagttcagttcctaaaaacaaggagctggcctgtggtgggaagatatggaggacgagattataggcagagggaagagagggagcaaaggcctgaaggcaagagcaaacctagcatgtttcagaagtaaaaggaggccagtgtggacagagcctggtgggtaaggggtacagtgacagatatgagattcaacaggggattcccaagggcctcctcatccccactactcaactggataactactgtcttttatgcctattgactttctgcttgaacagtcatttaaaagtgttgaaaggtgaaaaagaaaggtttaaaaatctctgtagttttaattttattctgattgctagaggagatatataaacatacacatgcacacacacacatatataaacatatatacacatatatgcataaacatataaatatgtaaatgcacacatatatacatatgtaaatacatatatatacatatataaacatttatagatacatatgcaaaaacatagacagacatatacataactggtgttttcgaacatttgacaaggattcatactagagaatcagtggcatagaaattgcagtataggaggtaaaattggatattaatgtttggaagtacttcagactgctcaggaaaagttaaccataggtgggtggaagcttttccccagctggagaagctcagtatgtcaatgaaaccggaggttactaataaaaacacatgaatgacatgaacaggtctattctgaaaatagcagagttggaaaatgctaacgttagagacagagtcagtaacaacaatgaagcctgccagattggtgtcacttaagagacatgatctaaatagaaagaaactcaacccattgcatgaggatgcttaagttattttgtttgaagagaaatttatcttgctcagtggaataagccagaagactaaacaggaaaagaccattagggaaagatacccaacgagcaaatcagaacaatatgaaaaaagtaatatcttaaagccacctatattaataaatttggtttgcctgttcagagttctaaaaatgacttgtgaggggagagtacagtgtttctttgtactccattactctttggggtaaaacctgtttgacaactcagttcaacatgactgacagtattaatcatgcacctatatgtggctagcactgcactaggaagtgtctctgctcataaacagtgaaacctactaaagagaaaaggcatgatgttaacaccacctgggatgtggagtgtatccatttcacaaaatcctatcagcagagcaaataatgggaacaaattgactacaggccagggtcaaatcctaaggtaaaagcagtaactgccctcgggtgggtaggagagagcatctctgaaattggccagagctaccagggaaggctattagaatgaagtgggacttgaggctgcccttggaggagctggtaaaattttgataggtggagaggcagaggaaggtgtctctgaatcattaacagctgaacaagagctgttcaatcttatccaactgtgagtctggaaacactgcctaattattaactagcaggtgaaaagaacagaaaaaaaaccactggtgccactgccaggcttccatctggctgtggtatcatcaggaggcccttaaagttatagttcttgggcaataagaaggcagcatcttttactaaattaacaaaattaacttactaaataacaaaagtaattttaattacacccagatttagcagggaaactaaatagcaaacattcaagtaagtgtctctgttgataagcatataactagaaacactcttttggaagtaattttgtgatgtctcaacagtaactaaacgaccatgtcatctgttgacctggcaattgaccttaaagaaatagtccaaatgggaaataagaagtcaaagatactaactgcagagttattgatactattgaaaaactggaaacagctcaaagactaccaacagagtagtcaaagtaatggaagcagatgtgtgatatcattcacccatggagttagtaaaagttaaaattattttaaatagcccctgttggtgtgagtgtaaaatgggtttaaattttatacagggcaattttggaaatatcaaaatttaaaatatgcattcctctgaatcagctccagaaacgctgagaagggatcaacagttaaaatacttaatccacgtagagggctttactgactccaaaacatctccttatttccttttttaaaaatgacattatccacaatacatatgatctttgaaagaaaaggaagaaagaaagatagatattattgatagtcccattttctaatgaggaaactgaaggtcaaagaggtaaaggaatttaactttctctagccctaagttcatatgcctgaaaaatcatgatgcaactggttggaatttcacaaggctaaatacagtcatcttgtttaagtgaaaatatctcttgatttagatatagaaccccatttcatggagccaagacagtagggtctacggaaacaatggctgtcctattcttccctggagatgataacactgcttctactacacttgacagagggggagaaggggagaacaaaaaaaattttttggtcttctgacctagcctgtatgaaagaacaaataacttatgtgcaaatataagatacagtgtgagtgctgaaaacgaggtaaggattatgagaggtctattatctacatgtgttgtatatacttggagaacacgtttgaatgggggaggtgcggcattatttcacagcaggagaaataatcattctcatcatttctaaaagccaagcagccttcagtcagtttcacaataatcaattaattagctaaagtaaatatttagaatgagttacggcacaaagatatgaaatcatggcatataaatgagctttagacatgtaaactgactctttaggaggagaaattactcaagagggagaagtggtattgcaccagatggctgtgtctaataataacttcaatggacacatatgatacttgtttaattatttatcaaggagaatgcctgcaaaaatttagtaagtttataaaatttttggcaagtacaagactgtgtcagccaataatgcattttgagtttaaaatgctccctcttggtggcttatgataatacttaatcctagaccaaggattcaccatttttctgtctcagtttcaccatctgtattaagaactgaaaaacctttacccaaatcagggagtttgggactctttaggactttactttttatattatcccctgaatcaaatacttcttcctacttaaaccatttccaaaagtgtactgtcatatcctaattgtcttaattctgtctcattgccatttcccccttaagttgcctcacaatctatctgcctgacttctagacaaataacttcaaagagttgtctatagaaggtttctagttttctttttcatttctcattattctctttcatttctttctccctgcctcccttccctttttcggttttgtttttgcttttcgaaggagggccaatttaaaaacaaaatgaaaaaagcacatccattactatctgaaggcactggctactacgaatcccttttctttgtgcagcccttttggctttttgcaagacctccctatgtaccatctcacccgtttcttatgatattgttcaacctttaacccactgacctgacttctatccccacagctcccccagaacggcccttgtgaaggtcaccaatgaacccggcccccattgcagtcttttaactttgcccctcagaagaaatcaatcatgccggctactacttggctgaatatgtgacttggatcccgtaacgttgcacacttctctttttcttctaattttctgactactcatttcctctcaaccccctttgctggcttatcaccttcttcctaaactataactgctggaagttttcaaagcctactgctgttccctctattctctttatgccatttccctcatgcccatggtgccagtcatgctgatgaacacagatctctctggatgtgattatcactggcccacccatctcttactccagacccatatatccctgtgtctactcaatatcaccacttaagatatcccacaggagctccaacccgggaagtaccaatctgagtgcatgatttctccctctatttgttcctcctgtgtttctcacttcataaacccatttacccagttgcttaagctagaaacttggcattcatcttgattctctctctctcactcccctgtcatctaatccatcacaaaatcctaaggcttctaccacaaaagcttattccaatttgtccttatctctccaacttcactatcatgccccaagtcaaagccctactcacctgggacctggacatgtgtggcctcttaactgattctcttgcttctattcctaccccacttcccaaatccattctcttttaacattaaattcaatcatagaatccctctgtttcagggaatgaataaataaatcaccttcaatcaattaattttagaattaagatcaaaccctttcccaggacctgcagggcctctaacaaccactttgagctcttcacataaccagttccacctcaaccaccaagctggttgtccaggacttctccaagcgagtcaagctccttctgcctctggggtcctcttctatgctcttccttctccactttccagagctggctccttctcatacctcagaatctcagtttaaatttagtctccacaaagacactgttcgtggttacctgaagattcatggtaagttcccccttatggtctattattgcagcattgtattatttcctttatagtaatcattaccatttctaatgatacgttcatcaatcagtttacttgtttactacctgtctccacaatcagaatatgagctccatgacagcaggaataactttaggtattcacaataaaacatggttaataaatatgggagtgaaggagggatactactaaactatgacattaaaactagtatgaggccgggtgcactggctcacgcctgtaatcccagcactttgggagggcgaggcgggtggatcccctgaggtcaggagttcaagaccagcctggccaatgtggtgaaacactgtctctactaaaaatacaaaaaatataaataaaaaaaattagccaggcgcagtggcaggtgcctgtagtcccagctactcaggaggctgaggcaggagaatcatttgaacccaggaggtggaggttgcagtgagccaagatcacgccattgcactccagcctgggcaacaagagctaaactctggagggggaatgtaatattaattcaaacacccattttttttcttgagaataaaattttagtttcaatattttctatatattttggtttcatgtttacaaacacatttaaaatcattaatatgtttttctttaaaagctactgatttccttatgaatttgtttttttcattcaaagtgtaaaatgaatgactctcattagatgtgttttgaagaaatatctttgctgtgttcttttctctgtgttcagccacgagaaattggtgtgaggctgctggagtgggatgggtccctatcctgacaattataagtcagtataaaaaagtctgaggcaaaagcaggcatagctctgtgggcatttctgatattttacgttagtcattagaaataattcatataaaaaaggaagatgaccaataataagagaaaataatgtgaagcattgtattttttaattgctgcttgaagagagttcattttcagccaaaacacaatagtactttgctcctttggctagaagtacaagtgattccaagaaacttaagtattctcagagctacctgctatgggtatttaggcctaagtcctgataaaaggtaatcacaagcttttaagaaaggtattttttaatttcttcttttcaaattggaaagaaagtgggcaaatggtttgtagtgttctaataaaatagattagataaaaggggcaagaaatcacaggctgaagtttttttattcaatacatatttattgaatatcaatgcataacaagaatggttccaggaggcataagaaacacaaagatgaataaaatatagttcttcccattaagaggctcatcattaggcagaacatacagattagatagatggatggatggatggactaacgacaggtgggtggatggatggatggatggatgggtgaaaggacaaatagatacagcataaagagaggatgaatgattaagcatggtcttctagcacaaagaaagttacaagaattatacatgaaacaaggaataattgagactctatgaatgtaaagaaatgaatgtagttcattaatttgatccatatctcagttgccttactgatatggtttggatgtgtgtcccctccaaatctcatgtcgaaatatgatctccagtgttggaggtggggcctggtgggaggtgtttgggtcatgggagttgatccctcatggatagccccttcctgtggtaatgaatgagttctcactgttattcacaggagagttggttgtttaaaagatcttggcaccacctcctctctctcttgttccctctcttgctatgtgggcatacctactgctttctaccatgattgtaagcttcctgagacctcatcacaagcctagaagatgcaggtgctgtgcttgtatagcctgaagaactgagacaaatgaacatcttttctttataaactgcctagtctcagggattcttttacagcaatacataatgaactaatacacttgtgcaatatcaataggcttttcctttaatatctacaaaattcttacagagaatgaatgaaaaatgaagtctcctcttgaacagcccaaggttaggctgctcctgtatgactagccaatttcattgagtgaaaattcaatggcatcccgaacttggcatgttcttcattaggcaaggaaaggaataagcaagagtgcctggagtatttctctcaaatctatcaaaagcagagaaaccagtcaagacacactgttctgtagaactaaacaagataatctccagacctctgtctccttgtccataatatgaaagtgctgtggcagccaatgatgagcagcagccatggctctgcattactccggggccctgggcctcaaacaagggccacgaggtgaccaagaacacaagcaagccgaggcatagccgctggcacgaacatcccaccaagcacaccaagttcatgggagatgtgatctgagaggtatgtggctttgccccacgcaacatgccatggagctgccacaggtctccaaagacaaacaggccctcaaattcatcaagaaaaggccaaggaggaggaagagagaggagctgagcaacattctggtcatggcttccatgaggaaagtggctgccaagaaggacgaattcctcccctccccacataataaaacctttacaggaaaaaaaaaaaaatgcaagggctggaccagatcagtgttagcagaaagattagcagatagatttcttcacatatgaattggtgttggctccttggagtgctatgttgcaatggaagcacacattctacctcagtagcaagaaggccctctgatggactagcaacatctgccatgagcatgggaatagcgtgacacattcactactgtggggcagatcactaaggtttaacatttaaaccttaatctacctcagtagcaagaaggccctctgatggactagcaacatctgccatgagcatgggaatagcgtgacacattcactactgtggggcagatcactaacatttaaatgaaatgttatctccagggccgggtgcagtggctcacacctataatcctggaactttgggaggccaaggcgggcagaccacttaagctcaggagttcaagaccagcctggcaacatggtggaaccccatctctactaaaaatataaaaattagtcaagtgtggtcgtgtgtgtttgtagtcccagttactcaggagactgaggtaggaggatcacttggatagcttgagcctgggaggtcaagactgcagtgagccgagattgcaccactgcactccagcctgggcaccagagtaagactttgcctccaaacaaaacaaaaccagcgtgagatattattatctaaagtcctttcaaactctcaaatcttatgatttccactaacattgagttggtgtgattatcttcctatatagtggacaacatatcacaataaattcttaattatccatactttcgttatttttgccccaatgttgctttcattctcatgaatgtgatccgaagaaacacagccttatccacaagcatggagcccagcaggaagctgtttaaagcagaatacttcgtttactcattcaaagaagcccatgccacgtaggctgcgatgggctcaggaatagcaagaggtttgccaaggtgatgcaggtgagaaaatacgcatttcttgttctttcctgctcatatttccacaaagtttctttacagaactgtaaattcagaaatcagatagagccatgatgaaaacaattacaaataaaaacaaacgatggccacttatttgagatttcagatagcatgtaccccggttacctcttactgataagaaaatctctacttgtgctgctcttttccaaagattgcttgaactgagaccatctaatcgctagcatctaaattactattcattttcgtgtttatcctctggtactggttactcagcagatgccactgctacgtcaaaagcccggaaactggcaggagaatgtccttccttttcttgctccttgtttcttcaaagtctagcaagatttgagttccttacaatgattctcctgcatcactcacatggctgtatgtgtgactgactcggtaggagctctctgcatccattaaagaccagatatacaaacaaacaacatcatctccaccaaaaagattaccttaatttttttcttttttgagacagttttgctcttgtagcccaggctggagggcagtggcaccatctcggctcactgcaacctccgccttccgggttcaagtgattctcctgtgtcagcctcctgagtagctgggattacagacacgcaccaccatgcctggctaattttttgtatttttagtagagacacggtttcaccatgttggccaggctggtctcgaactcctgacctcaggggatctgcccacctcagcctcccaaagtgctgggattacaggcatgagccaccagtcccggccaagattaccttaaccacaggagatactcttcctgtggttcctgtcaaaagttaccatgttgctttattccttccagatattaaccagatgttagtcattttagcattgtgcatattaatgtcttatgttcttgatttttaagattttccctctaagtcttagaaagtcagagctttaagggagcctgaatacctgcctttgacagctaggcaccacaagggcctcgaaatctgtgcaacttgcccatggccactttgccaccgtgtgatagagcagggtaggagcaataccacctctccagggcccatggccctgtgctttcctcttgccatactgagtggcttttcctgcactttcatgcccttcccagtcttctccggtgggtgaggcctgcggcacactgggctcttctggtgcccctgcagaatctctggcatgcccctctcttggcgaagccccagcaaggatgacatagaaaattcagacaaggatgaaatcatcgttttcctctattatttttctaaattgcctttttcctacccatgactaggcagtatttcctcacagctggggatgaacaaattcaaaaagatgttctcaaatacatggtttccaagagaggccactaagtgttgaaagtataaaatgaacatttttgagtgattgcacagttcatgaaaatgtctctggttagaacctcatcagcagtgattcactctgtgcatagggtccccatggagactggagtcacctcacattagggtattgaggctcatttttcctgctgagatggaataaatggctaggatgcattaactgatggcggtcacaatggtcccatccagtgaagtgaggaatatttctttaaagatgcccttgtggtcagaaagacttactgaactttaagactaccatatttctccttccctttaaagaaaaagagtacttttgccctataggcataaacattcagaagtaaagcctcaaggtcaaaattatatcttctatgatagatagcaagataatgtccctgttaaagaggaaaatatagtttattacagttcaatcatgtttttcttgatgcccaaaacatctttttcaagataataaccaattaaatgagattatatactgtgtgtcttagtctatggggagcttctgtaacaaatactacagactaggtagcttataaacaacagaagcttatgttttggaggctaagaagtccaagaccaaggcacttggaagatgtgccatctggtgaggacccactttctggttcaaagacagcctcttctcatttcgtctttacatggtggaagcagtgagggggctctcttgggtctcatttaaaagggcactgatctcactcatgaaggctctgcctttatgacttaattaccacccaaagtccccatgtcctaatatcatcaccttgggggttaggatttcaacatatgaatttgggggtatgcaaacattcagaccacagcacagtgctggagcatagcagatactcaatacacgagttttaatttgtatatgcaactatgttttaggtactttacagctcagctacttttatttaaaaatttttcagttttaaaactgcatcgtaagtaagaccacagaaatgtagcatcagacaagcttccctacccattccaaggccaaatgaggatttttttgtttgtttctccaccagccaagaacctggggtgcttcagggactcaaactttagttgcagtttccaggcctcatggtttagaaggtctaaaataggcccagaaatctactttccagaggatgctgaaacagatgacctgcagcaaatactctaatgtaattgactcttgaagaacatgtgtttgaattttgaaggtccacttatcaccaattttcttcaataaaagttatactaagtatgcctgcctctcctgcctccccttccatctccttcatttcttccacctctgacacccctgagacagcaagatcaactttgccttttcctcctcctcccagcctacccaacgtgaagacgaggagcatggagacctttatgatgatccacttctgcttgatgaatagtaaatgtattttcccttatcatttcttcttcttttttttttttttgagacagggtctctgtcacccaggctggagtacactagcacgatcatggttcactgtagcctcaatctcccaggctcaagtgattcacctgcctcagcctcctgagtagctgggactacaggtgcatgccaccatgcccccactaattttttttttcagaggtaggttttaccaccatgttggttagactgatttcaaactcctggactcaagcaatccacctgtctcggcctcccaaagtgctgggattgtaggcactgggcccagccccttccttatcatttcttaataacatttatttttcttctagcttactttactgtgagaatatagcatataatacacataaatataaaatatatgttaatcaactgtttacgctattataaggcttttggataacatcaggctactggtagttaagtcttgggggagtcaaaacttatatgtaagttttttactgtgtgggggtgagcagctctaatcctggctttgtccaagggtcagctatagtgtcacagagctatgatttgtgggtgtgcattgggtacatgtgggtgcttccacgtggcttgcagagaatggttgtcacttctcctccaataggagatgtcaggacaaggggatcattttctacaggggccaagtcttctcttttcattcccttaaaatagaaagtcatccaaggtcactcttctccccttccccgtgccttcctaaactgctctccaatgagggtaacacaaactaacacatttgatccctataatatgtaccacacttcaccgattctagaaaaggtaacaattctctgatgatgattattccctccttctttacagacaaactcagagaagttaactaacttgcccaagtttacgcagctaagggaacaagcctggattcaaacctaagacctcaggctctaaagccaccatctgtctcttgcagagacagttcctcaatgttgaaggaaaaattttttctcctgaaagaccacagaaaggatccccacatactgctgtaataggctaacgcccctctgtccttgcactttcccatctttccaaccctctgcttgccatcctcagctctgcccatccagccacccctccactttcttgcctcatcagcccaccccttttttcatggctccactgccactcttgtaggagtgtgtagtccagctctgaaattactctcctgaaaatgctcatgccttctttgtgcccttgtcctttcattctcaccacctgttaaaatccaaccttggataaacccacagagaacttccttctctgtgcctgcctactgggaggacacaacagtgctggagaaaaccacgcagggctctcaaagagtgtccagacattttaccatatttttctggtcagcttcctgtctctcccccagtgaaaccttcaagggttctcccttctcttccaaccttccattcctcatcagcccacttatcctcagcagatgcctgtccttttctgagaaatggaatccattagccaggaactccctccacctgagttaccaaatcagcaatcccacctgctctgcattctggacttcccatgcaggatgtacataggttgactcaagtccatctcatttgtgttaaactttaaaaattccaagtttctgttttctttgagagagtgttacttgctttcagactgcaatgtatatattctctcccatactgatgatcactttttggttattgtcataaacctgagtgcatgaccaccatagtgttattcatagaagtctacttgatgttactaagttgttcctggttcaactttagtacaatatctagatcacaggacccaggttcgaaaatggaaatctgcagcattcaaggacaacaaaaagtgatgtgcataataattacataattgaaatctttaaatttcaatgtaatacaaataaatctctatgattctcccctacccccaccacgaatgatgtctttccacccaaggtatttatttttaaaaacaaaagtgtaaagatagagctggccttaggcaaaaaacgtaggagactttgctttaatcatttgcccccaaatcctaatacagtagaaacactttaggcagatagacctggttatcaattccagcactgtttccttccagctgagtaaccttgggtgagttaactcacatcacctaaactcagttccctcatctataaaatggggttaataatatttagctagcagaggattcaatgatgcaagatattagagtatttggcacatattaggtgccaaataattataggttttattattattctttttagtgttcctagtaaagtcactcatatcatagccccagatctttaacttcttatatccctaggcaatacatacattcactttaaaaagactttgtctgtaaacttctgcttccagccaccagaaagtaacaaggatagaatttattctcctactttaaacaactcaaaaatcaaacaaaatatatgaaatgacggttttcagatactgtacaacaaaaagtacaggatagtgatcattgagagacgggaaataaatgaagtgaaacttatgatagtcccagccactgtctagaaggtttccagggcttaatgcaaggaagagaaaccagaacagagcctgaggtctgtctgaattagacatctggggaaaccaatgcccctggaaatttcagggcagagtacaagagaggaaggagccaatcagagagagagagctttggagatcttcagaggtcccctcagagtctgtggctgcatgttgattaggagagacggagagggaagtgcaaaggctggggcaaaagccacagatggaacctttctgaagctcacaaaggacagggagtagctcaagttctcgagatccagagagaagcaacctcgcaatatgccaggaaagagttcccagaagtgttttgcctcagaaaccggatgaaattatctccagtctaaaggctgcttagatccattaacccaagtataaaatcaaagccttgagagaatcaaactgtttccaaggaacttgactgcatctcaaaacaaacaaacaaacaaacaaaaacttaaaaatattttaaagaagacaaaaaaggaaagaaaaaaaaatccagcacctgacaacataaaattcacaacgtctggcaaccaataataaattagtaggcatgcaaagaaacagaaaaataagacctatcataaagataaaaatcaatcaagacagagattcagaaatgtcacagataatagaatcagtagataagcacactaaaacagctattataaatatactccatctgtgcaagaaggtagatgaaagcataaccatgataaagaaagacagggaagatacatttttaaaaaagaaggaatctgaaaatataatgctcaattatgagaaaaataaatcatggatgtcaaataagggggctggaggtcatagttactcttcatatctaactgattgaagacagaaaatctatagtttagacagtctaaggaccaagtataaaagtgacttttccaggtattatgcattttatgtaattatttatataaatgaaccaaattacatattcattcaactatatagttaccaagcacccagctttaatgatagaggaaatacaaagatgattagctacagttctttcccatagaagaagtccagcacagtctgttagacagatgatagaataattatattagcacataaatgacatgtgcttacaattcaagaatgcagtatgtaacacactgtaaactagaaggcaggctgcagaataataaaaggaaataaaagcaaacagtggatctggagcagaagtcccctacgcaattaatccatagttacaaataaaagactttgacattaacccaatgcaaaaatccaatatacaataattcacatgcatgcacacacatatatacacacacttatatcagtatagaaacactcaaactcattctaatatgggaatttaattgtctggcttttctttctactctctgctgaattagaatgtccactctgagcagaggatgcatttcctagtgtggaatgcaaatattttccctcagcttattgggctgttaaagatactgaagcttctctactccagaggaaatcaagaaaattagggaatgtatgtatttgtgatatatacacatacaaaaattatatattatagattatatatttaatacatgtacatatgtcaatatgcatgcaattatttaaaaatatttctctagttttagtctagtgagtaagaatgtggccaccatagttctaaaggctaatgagtggtacatataccagagtacaacagagcaaataaagattaagctaatcaagaggtgcaaactggaataaaatttaaatatatatgtatttgttgtagtatacataggatgaaaaaatttttatattaataattcagaagaggtcgatctaatgctaagcaagtaaatttatcttattcattccatggaatagaaaagtgactatattatattaagcatttaacaaaagtttgtaacatctctagctaacaaggatataggcttttgtcatttgtggagaacaatctttgatttgctttaagtgatgtcagttaccttatatagtacatgggataggccaaagcaaatcttttttggaaacagattttacacattctcttatctctagaaatactgtagacaggctgggtgcagtggctcacacctgtaatcctaccactttgggaggctgaggcgggcagattgcttgatcaagcccaggagttagagcccagcctgggcaacatggtgtgaattcccatctttcctaaacatacaaaaaattagctggcacacatctgtggtcccagctactcgagaagctgaggtggagaatcacctgagcccgggaagttgaagctgtagtgagctgtgatcaggccattgcactctggcctggatgacagagtaaaatcttgtctcaaaaaaaaaaataaataaataaaaagaaagaaaaagaaacaaaagaaatattgtagacacacacacatcagcttagcactaggatgcaagttgcaggacagcatgtgtagcgtctatggcagtgcctgcacatggcaggtgctccatattccagtcccattggatgtatctaggccatctacctctgccccatctacctctgccatccctttttggacagcagccttctagatacaaacccagcctccctcccctcttgccattcttcaatgcagtctctataaaacaagtcagatgcttttttgttagcagaaataaagaaacaaaacacacgagtcacaggtcacttatctccttaaaacttcagtagtttgcacttcaaataaagtctgtactccaagctttggaaggcatggtctggccccagcctatcctaccagacttgagttaagcaccaacctgccaatcccactccatcccaaccaccacctctggcccacatacacccacttttctcttctttgaagaggataagctcctttcatctcaggtctttgaacaggacattttctgcttttagaactttctcatcttttcaaattctccatttctttctgctcttccttcctgctaactagataagtctaatttatcctttaggtcttagtttgaatattactactttaggggaaccttttctgaagcttctccaatacctccaaacaaagttagcctcccaattcctctttgtaacatcccacaattataattagtcatttgtataattatttgataacatcttctttagagatacgtgttctccataagagcatcactggtcggtcaggccaattgctgttcctctagtgccttgtaaaaaatgctgtaatactgtggtgagtaaataaatataccaatgtaatgtcctaatgtcctggggaagaaagggtaagtaaatgcatagagtgtaacagaactgtcacaagtacatgaaatcaggtacataaattgtgaaacataagtcaagggcctatttgttttctgacacttgatagtgagaaatctttcaacaagatggaaaataaaaacaaaagagaactctgagcatcatcctttagagacccccactggtacccgccaggctgtctgtatccccttcatcatggctgtgtcagagaatgccaccattaatatctgaagggactaaagaaagaaactttgctggtataagtatgattttcattttaaaaacaagcatgtggggtggtttatcaacagacagtcctgagtgtatttgtaagctgaagagacagtttcaggcaggatttccagattctatttttttatctctgaccacttctctcatttcaaatcttggagccctgaaatagtaggaatgtagtgggacacaagagagggatctggagacctggctgcagggtaggctgaaacttgaaggagcatctgagagcttcttcctaatttcacagcagaggtgcgtctgggcgttacggtccccagggcgtcaacaaccatccctatgttgtggccaccaaagccatacctccatcaggccttccttcctgcttgccaggcccataaatctccctgctcaacacaggttttctttcaacaggttcctcaaactcaacatatccaaaaggaaatgagccatcttacccatccttctctttcagccttccccaccttctaagcaaatggctctatggttaaccccacttgcaagtctagaagcctaggagtcactgttgattcttcactctccttatgttccatgtggtcttagtcatccattcctgtggtttctacaatgaaatgtctcatgaatcccttcaggttactccatctgtactgctcaggataatcgctggcattactgccatcactgtctcttatctgggtaactcctgtctggttgccaacctttccacacccccatcagtcctctataggggttacaaacatgctctgtaaaaatataattctgatcctgctactcccctgcttaactttcttcagtgacatcctatagcaccctttatctattagtagcataaccacttatcatgttaatttgtttttgtgtatttactcttttctgtttctcccgccactctaaagcatgacagtaaggtctatgtcctgtattcccagtatttagcataacatctggctcaataaatctcagttaaaagagtgatgcttgaggagatgaaaggatttaacaaatccctcttcatatctgggcatattaaagaggataaaggtgttcctgtgaggattaaacaacccaagaaggaaattagaaaaaagtactctgaggaagcagagaagaatgaaaataagtggaaacaccagtgaatgggagagggtagtgaaggggacggagaaggacttgcaacctatcttggcgttccatgagatagaaagctaagttcttctcagaatggcaggaaacagaagcagtgacagtgaacccagagcttctgaaaaagaaacagcaaggtatgagccaaggaacacttaagggtgctgatagacccttacaagtgtgaagaagtcttttgttggctccaaattagtcactgataaaggatgtggctctatgtagttaattgggaagtatgttgtcttttttttttttttttttgagacagagtctcactctgtcacccaggctggagtgcagtggcgccatctcggctcactgcaagctccgcctcccgggttcacgccattctcctgcctcagcctcccgagtagctgggactacaggtgcccgccaccatgccctgctaatttttttgtatttttagtagagatggggtttcaccgtgttagccaggatagtctcaatctcctgacctcttgatccgcctgcctcagcctcccaaagtgctgggattacaggagtgagccaccgcgcccggccaagtatgatgtctttttggaacatgtgtttaaaatagcacaaatggcatgctaagaagcttggagtaaaagatgtgcatcaccccagagtcaataatggctaaagaaatattgttgacaataggaaaggagatttcaaaaagtttatagaaaagcaaggtattatctcacggccagagaatatccagaaagcactattagttcccatgcaggcctgggcaagaaacttaaaacctgggtactcagctcctgcttttcagctctccttccagttgatgattataactttggaaaagaaattaagttatacaggaagagagcagctggtcacacaagaggtgccaaagcttgggatttgatattctagatttcaacttgtgacaccagaggtggggccttctgaaaagggacaacgtgtgccacagaaaactgagaagaaggtttcaggcaacacctgacccaaattttgaaatttgagattagggagtgacactgttcagcacaaacataaacaaaattgtgaactagatcatgcagaggatatcatatgaggcatagaaggatggatggtagtggagaaggatctccacagtgaatattctagcgtctcacgagaggctcacaggtttgttttttaattaatttttaaattttactttaagttctgggatacagaatgtacaggtttgttacataggtatacatgtgcgatggtggtttgctgtacctatcaacccatcatctaggttttaagccccgcatgcattaggtatttgtcctaatgcaggcattttttaaaggctaaattaagttaggaattgtacgtagtagatcccactctttgagaactacttattgcacattagcatagtaaaggccttgggaaaacctacaaagaaagcaatttatctacgtttaacccagagtttgccaccattgttaggccacctaagtataatacttatgtgacctccactctaccttacaacagtggaacacgaatgttccaacagattggtttaaaaaacctagatctacaccaatgcacaaagtattgacaacaaacacaaatcaaaggcaacaaaaaaacttcacaaaaccaaaacaaagtatggggaataaaacaaacaagaaacaataatggaggtaagtatcatctcacagaacagccaggactttggagtatgggatttaggattggggtataactgtgtaatggtatatttgggataaaaggaacaaattcaatgtaatgatctcaagtagcacttcctgtgaagaaggtaaacagagaagttcataaaggtgggagcagaatcacggtgagaggaacatttggtgatgatgaaaggggagggaagtggaagaggcgtcactgtggaagtgcacgacagcacatctgaaaggtgtgctaccacagtaatgagggatttgatttcctgggaaatccttttgataaaatcagaggatataaaaatcttacgccttgctttactgataattttaatctctcaataaattgaagaagcagtgaggaaagggatttagtgtcagtttaatttcaacaaatatgggaagagtggttggtcatttagaaatatcagaaactttgggagaaagccaagtactcataaaatccagcctctccataatcctgtcagaaatgttttaaagaggatttcttggaaggaaggttacactaaataatctttaagtcccttctgaaacattaaaggctgcctctaacattctgcattcacagttgaagaactccagaggtggccagcatgacacctgagcaagcagtggcatccgtggctctatggctacgtggaaaagaaacatagtgctgcacaccaggtacagtaaaaagggcatcagatatgtcatgtaaacataccatagaaccataagaactgaaacaatgtggtcttggaataaaaatagataaatcagtagtaaagaatagatatttcagaaatagacaaaaatatgcataagaatttaatttccaataaaaggcagaattaagtcactgggggcatggaaaatagggaatataacaacttccagagtgggcaaacctttctgcatttagaaatggaataaagaactcataaatgaaaaattaaatataaaaaccataaaaaagaaccaacattaagaggcaaaacatggagtagataaatatttttaggaaatatgaagtccaaggattaaaatgtttaacaaatgcccaaatataaaccaaaaaaaaaaaaaaaaaattaccaggaaccctatttgataaatggatacagtgtgagaataattatttacaaaagagaaaatgtgaatagaaaatgaaggagaataaggaaataaacaagggtagttatagaataatttaagataaaataataggatgccatttttgcatatcaaattagtaaatattaagtccatatgtatagtttgggaattaattgaccagtacttaacaagaaacttgaaaatgctcatttcttttgatgtactagttccacatgtaggagtctatccaatggaaataattctaacagctaaaaagccccatgcataaaaatgtccactgcaatgttttaaagcaaaatattatttgctttaaaaaaagcagaaaggagaaagaaagaaataagaacaaaggagtaagaagaatatttaatgtatgcttaccatatggaggttatataaattatcccatttaaatctcacagcagttccatgaagtagatatgatcaccattttatagaaaaggtaagatgtttttgcatgctcagggagactaagttctttaaagaaacttggctagtaacagtgaaaaaatggaaacagcctaaatgtaaatagtagaatggttaagtaatctagagatttgatgaattatttttaaatttttaatataaaagaatacaatggaaaaatagtttaggataagatgttaaaaatgcataatagaaaatgttatattcagtatgattgaaatacacagaaaaaagactggaataaaataaataagcactaaccaaacacaacagaacctgaccctgagattgtatcaaggaatgtagtcggctggtggccctgagaacaaagcaaagtgcagttaaattatcaggccgtgtaaatgatgaagggaagcccagaaagaccctgaaaggctcaaaaacagtttaagcaatttggctaacacaggagatagaaaaagtaatttggggcagatacggtaaatcttctataacgcgtagggctgtaattcttttcatggcaagttgctgggaaaatcataaattggtcatggttaaaacgtcagaagactcaaaattacaagaaaaaataatgaattatgaaggttttggcttactctagaagtcgtactacattttctgagagaagtaggaggtgagacgagagtaagtaacttctgctctctgaatatttcaattaggcagctggggaaatgtgggtggaaaaatagaaatctttactttcaagttattagaagaaagtatctgtctatgtaagctttagggaaaaggggcctgggataaacacatgttcaagccatagaaaatgtcatttatgtacacctacctccctagagcagactaatcttcaattgtatgaatttgatagcattttgaagaacttaataaatatcctaaatataatgttttaaaactcagcctttgtatttcctttgtctcctactttccctggtctcttatccattttcatattctttcttattatattaaaaaagaaaccatatatattatatatatgtgtatacacatatacacatacacacatgtacacacacacacacacacacacacacatattactacagttaatttggaatttttcatttatggccactattgaccaaaaagaaacacaacaaaaaacaaatgcttggtcaactcagcatgaagtgcacaggtatgtgggagtagaacttagcacattccaaatgcgattggtttctatttaatgaacaccatctaccctcacctactttgatggccaaaaagtgaatttttcttctgccactgtaacaatgactactgcataatacctggttgtcacctctccactataaattctgagagggcagaccatacttgtcttgtttactgcgggagcccctgcaccagacagcggctcaatgagtatttgttgaatgaatgaatgagtgagtgaatatacaaatcctactcatctctccagacttagctcaagccccaccttcctgataacatctttcctcaaagccccagtgaccgatctgattattatattaccagtgtgcaccactacttaacacacctgactctacacatcatttttatcattgtttttcaggtgttggtgttttgttttgtttttttcaatttagagagaaaggctcttcaaagacacttatatacatatatatttattctatttctcaaagcactttttacaggacacatgtaaaatcctcagcaaacacctgttaaattcaatggttaaatcttttagatgacttttgactttgtggtatttctaaacattttctctgctgaatgcatgcattgtattaggatttcaccacgtggtggacagaaaacagggaatttagtgtcagctgagctgagtttatagctctgccatttcaatgctggaaaagtcaccgaaactctgctcttctgtttctctatttgtaaaatggaaacattaacaagagcaataacaaaaagaaatatctacctatcataaagggaagacagtgcaatcaaatgggataatgtaggtgaatgagttttgcaaattggaaagcaaatattagccattctatttaccaattttaaaaaacgcaattgatgttgcaagactgtgtatagcaataacagttagtgtggctttttctgagaacaaggctattaggcagaagagaaaggtgatgaggaaaagaatctcaagtacaacttgccaaacatgccccagtcataaataaaagactgtgtccaacactcgcggtacagagagattaccaggcacctgtcacctacacccttcggcactgctgcaagcatctctgaaaccaggagaaagcttaccagacacgagctgctgtccaggcaaccctacgggaaccatgcccaggttattcatggctgtagcccaggctgtgggatctgtcacggacatgttgagctgggtcgtgtctatcgctatactccccaaaccatcggctgctgtggggaaaaacaaaccatgatttagagtccataggcaagggtgtttgttttaaagaaaatcacatttctagatatgtgaggcttcatttagcacattcccaaactacaaaaaaaaaataaagaactataatctgcagcaatgttttctctagacataaacacaaagtgtttccaaatactttctgggagaaaacttaatgacatgtagtttatattatacacagcatgctattaaggaggtacccctggaaaaaaatcgaagaattgtttccttctcccagtgaaacaacgttagttaagtcacaaggctgagaggcaaagcagtaatactctcttggtaaaacaagttaattggcttactgtttctaggtgtaattcttgagcaggcaggccttctatctaataagaaaatagttgtcaagcagtagaactggtcctgactgaatttattaagtgttacctcgtaatctattccttcctttacaaacttttacattattacactaagaaaatacaggtgtctacctaacgtgacttttctgaaggatttctaaataaataaatcaaatttaaaaacaggtagcacaaagcttaagaaaacacaaaacaaaacagaagaatgtgtcaaatttgacttagtgctctttcattttcactagttctacagactgatttctttatgggcccaggctcctggttcaatgcatatttttcaaggtggggcaagcttttccactaagaactcaaaaaatccttgtttgtgtcctgtgctggccactggcatttacctgcagccatcatctgaggaagctcctggggaagctgggtgatgttctcaactccacctgcatctaccattgaattatgagtgtccagaggggcaggaacactttgatggctgagtgcagggtcccctcggaggtcatcagattctgcaaaacgggacagaagtgtggtgagaaaccttaatagttaactgagataaaacgtcaaggaacaaactgttatctattcaaaatcaaaaacaaagaccgatttccagtctcaggcacagaagaaatgctgcttcccatcgctcagcggctgtcttgtggctcagttaaaaccttagagccctgtgagatgtgtgggtcaactcatcgactcaccaggagcctgggctggctgaataaacagccccatttgtgagtacctcaaaggccttgcttcctactgaagcaccttcacaaatgggggcttatcagtccctgcacagccttttccacacacactacacatcaatggagagggcagagtcagggctaaagaagatttttttaagttaaaaaattaattgatgctgttactttggaagatggtcgtctgtggaatgtattcagagagggaaaaaagttgggaggaggaaggaaaaaggaagaacccattcaccatgcagctggaaaaggagggtacctaaattacaatagtcaggaaaggcagaagagaagaatggcatgctgtccataaaggaagatctagagggtgttagggaggcaaaggaagagcatttggttttttcagctcattggaaagataatttaactggccacaactttttggtttgaattttccttagaattgcccagcttatatatatatatatttttatatatttatatatatttatatatatatatttatatatagtcttttaatgcacttatctaataaatataacaattaaacattaaagttacaaagttcttctcaatctcacactatttataaaatgctatgccttctctccacccttagaaatgcaaaaacagagctttcacatgtattttaagtgcactttcaccatttcaaaactcagatgagtggcatgacaagtttgatcttaagtagattagatataacaactaagtctaaatatttatttttattttagtataaatttagaagtttttctaaaccatgttcctgttaatgatgattttagaattagatcttatggtttgacagtgtatctaatgtgaagttcgaaccttttatggcatgtctttttgtttctttcattcttaggtataagaatcagtaattccttgagcactgcactgtcaaaaagaacttctgatcagttgagcagaagtttaattcaaatggaagctaagggttcaattctcaacaacaggtgaataatgagcaaatagtttttatggtctcaacaaatccctagccctcaactagaggggtatgtaagatagtgtggaatttttttccaattgtctgtcaggaagatgaatcatcatcatcatccaacagtgaatgattctaactttggaagcaaattgtactgagaataaatattttattccttcccactatactatccaaatgaactcagaacctgcatgtgtattgtgcatcaattatcttaggctatgggtgccatcagacaaagagattctcaccatagaaaataaattcaacagcataagaaatgcatagctaacctaaatgtctggtctattcaccaacgatctttctacgatgaaatctcaaagcacttctctctccacttccaaccatttcagagtagcaaggcagagtcaggctagaatgtgttcattcttttgttcaaatggccctgtagcagagctgtttcagatctttgcaacgtcactatttgtcttacttatctccccaaatgaagtttagtggctagcctccttctacctcagattcttcccaaatgggcattaatcacacatttttttctcgagtctgcagttctggaacactatatcagagaacatccctctactttgtaggctcatgacttgtgcctgacccaccacatttcaccttgactttttgctacactgttttagggatggctttagttttccttggctctgtaacagtctgctccaatggcagttctcactttagtggttacagtcgtataaaggggcatcaagtgtcctggagacccatcgtttctacctaatactttcatggccatcttaacagactgcaagtgtttcattgaaaacagtaagcaactgctactgttccactgaaaaaaagcattgttctgttggcaagatgtggtgtataaacctagatttatcccccaatgaaactcttgtgacattcaatgtattacatctcttcagtctcccaatccaatgtttttttttttttttttttttttttttagtatttattgatcattcttgggtgtttctcggagagggggatgtggcagggtcacaggataatagtggagagaaggtcagcagataaacacatgaacaaaggtctctggttttcctaggcagaggtccctgcggccttccgcagtgtttgtgtccctgggtacttgagattagggagtggtgatgactcttaacgaacatgctgccttcaagcatctgtttaacaaagcacatcttgcaccacccttaatccatttaaccctgagttgacacagcacatgtttcagagagcacagggttgggggtaaggttatagattaacagcatcccaaggcagaagaatttttcttagttcagaacaaaatggagcctcctatgtctaattctttctacacagacatagtaacaatctgatctctctttcttttcctcacatttcccccttttctttttgacaaaaccgccattgtcatcatggcccattctcgatggtcgctatctcttcggagctgttgggtacacctcccagatggggcggccgggcagaagcgctcctcacttcccagacggggtggccgggcagagacgctccccacttcccagacggggcggccgggcagagatgctccccacttcccagacggggcggccgggcagaggcgctcctcagttcccagatggggtggccggacagaagcgctcctcacaccccagacagggcggccaggcagaggcgctccccatctcccagacggggcagccgggcagaggcgctcctcacttcccagatgatgggtggccgggcagaggcgctccccatctcccagacggggcggatgggcagagatgctccccacttcccagacggggtggccaggcagaggcgctcctcagttcccagatggggcagccggacagaagcgctcctcacatcccagacggggcggctgggcagaggcgctcctcacttcccagatgatgggtggccgggcagaggtgctccccatctcccagacggggcggccgggcagagatgctccccacttcccagacggggcggccgggcagaggcgctcctcagttcccagatggggcggccggacagaagcgctcctcacatcccagacggggcggccggacagaagcgctcctcacatcccagacggggcggccgggcagaggcgctcctcacatcccagatggggtggccgggcagaggcgctcctcacttcccagatgatgggtggccgggcagaggcgctcctcacttcccagacagggcggccaggtagcagcgatcctcacttcccagacagggcagccgggcagaggcgctcctcacttcctagacggggtggccaggcagagacgctcctcacatcccagaccgggtggtggcggggcagaggcactcctcacttcccagatggggtggcggccaggcagaggcgctcctcacttcccagacagggcggccgggcagaggggctcctcacatcccagacaatgggcagccaggcagagacgctccccacttcctagatggggtggcggccgggcagaggctgtaatcttagcacttttggaggccaaggcaggccgctgggaggtggaggttgtagcaagccgagatcacgccactgcactccagcctgggcaacattgagcattgagtgagtgagactccgtcttcaatcccagcacctcgggaggccggggcgggcagatcactcgaggtcaagagctggagaccagcccggtcaacagggtgaaaccctgtctccaccaaaaatacaaaaaccagtcaggcgtggtggcgtgcgcctgcaatcccaggcactcggcaggccgaggcaggagaatcaggggagcccgaggcagggaggttgcagcgagctgagatcacagcagtacagtccagcctcagcaacagagggagacgggagacgggagacgggagacgggagacgggagacgggagacgggagagggagagggagagggagagggccaatctaatggttttaatgacatacaacttactgtggctaccatgtgcctgggatggtgattctaaagtaagctctgtcacatcttaggaatttccaatagtctcaaggctgccgtgacattgttcacaaaatttaagttgattcggtcactcattttggaagaaaggtaatacttttaattaattaccaactagtaatttatgaatagttgcaagaatgattttggtactttgttagcatctattgttcctattgaatacctgcctctttaaatgattcaagaccataatgcctaatttatcattcacatcaatttctctgccttagttttattatttctaaactatagaaaagattaatcttcttagcgatgtttatttacacacagagatgtggggagttaaaaattatagctaataaagcactctgaatacagtaggtgataattattactattttatttggaaatgtagtgtttccattaagataccctgggatctttgtgttctggtagataattatgtaattaattctaaaacagtgagtaacacttgatatttctaaaagtaagtgttgccctagttttctgtgccacacctcagttggagcacaatatttcattttccaccattcctttataaaattatatgaggtaggccaggtgcggtgactcacacctgtaatcccagcactttgggaggccgaggcgggtggatcatctgaggtcaggaatttgagaccagcctgaccaaaatggtgaaaccctgtctctactaaaaatacaaaaattagccagcaatggtggcgcatgcctgtagtcccagctactcaggaggctacgacaggagaattgcttgaacccgggaggcagaggttgtagagccgagatcacaccactgcactccagcctagttgccagagtgagactccatctctaaaaaagtaaatacataaaataatataatgtaatttaaggctgggcgcagtggctcaagcctgtaatcccagcactttgggaggtggaggcgggccaatcacctgaggtcaggtgttcgagactggcctggccaacgtggtgaaaccctatctctactaaaaatataaaaattagctgggtgtggtggtgcatgcttgtaatcccagctacttgggaagctgaggcaggagaatcgcttgaacccagaaggcagaggttgcagtgagctgagattgtgccactgcactccagcctgggcaacagcaagactctgtctcaaaaaaataaaaataaataaaaataaataatacgatgtaacttaaaagatgtataaatattttctctctaggttttttctgcctatgcaactacaaaaactttcaagagattcatgaccaattatgaaattggcagtttctacttacagctttaatgaagtatgagcaccacaaaacaatctgatacacaaaatgccaaggataaaagtacagctttgtttggccttaacagatatctaacttgtttcctgttaagatatattcaagtataaaatctcataccaatttcataactgttcaacaaaatatatttatgttcagtatttcattgggctagataatggggcaaatattttttgaaacttatcaagtctatgaaaatactatttggcttaaaaaatggcacaggtttgggaggctgaggtggcaggatcacaagatcaggaatttgagaccagcctggccaatatagtgaaaccccgtctctactaaaaatacaaaacttagctgggtatggtggcgggtgcctgtagtcccagctacacgggaggctgaggcaggagaatcgcttgaacaatttctataggtatcagcgatgcacacatcatgaataataaaacctacctgtaattgtccacaaaacacagattcctgttaaaggagggtagagatcagctaggtattgaaaaatccttcttattgaaaaaaagaaaaaggctgggtgtggtggctcatatctacaaccccagataggagctaatatctataatccactttgggagaccaaggtgggaggattggttgaacccaggagtttgagaccaggctgggcaacatagggcgatttcatctctacaataaccttaaacagttagtcaagcatggtagtgccctcctgtcgtcccagctgctcaggacgctggggtgggaggattgcttgagctggggagtgaggggtgcagaggttccagtgagctgagattgtgccactgcactctagcctgggcaacagattgagtccctgtcttaaaaaaagacaaaacaaaaccaaaaaaaagcatgattttgtttggtctaagtccttaggtttatacctacttcaataacaaaataattgtggtgaaagaatcagatttcttaatgtcttgtaaacagttgataccaggccaggcacggtggctcatgcctgtaatgccagcactttgggaggccgaggtgggtggatcacttgaggccaggatttgagaccaacctggccaacatggtaaaacctcatctctactgaaaatacaagaattagccgggcgtggtgacgtgcacctgtagtcccagctacctgggaggctgaggcaggagaatggcttgaacctgggaggcaaaggttgcagtgagccaagaccaagccactgcactacagcctaggcaacagagtgaaactccatctcaaaaagaaaagagctgataccaaaggaagcttatttcatatggtatcagcaaatttcttattttataagaactctccattagcattatcatggtatatatttacagtaaaaagaaagatacatttccttccaaagttcactctccttttccatcactaaggaaatacctaacttcgatcttcacatagtcagtgccatactctcgaggttatggaaatgttccacggtttaaaacaatatagataattgtgaagtaggtatgcttatgtattaactctttgattctttaagcaattatgaatagtaggggagatacttctgcttcctgtaatgataaactatgtaactgtagatcaatcttcccactgaggaacaactaaaaatcttaatatcttccatcagttttgtaaaattctcactatcatcttttcatatacaaaagcagttcaaaggacattctctgattattgtagtgggttactaatctggcttctaaggagaatgggtcctgttaactactgggtgtttcatcttattgttaagggaggtgagtggaatctgcaagtttaggggcagagtaggaattgctctgtaaagtgtggtaaaagaaaacataaaagctgaatgttctgaggggaaagaaaggagggatctttggtgcccacccatgaagaaaagatgactacagagaagatcaatgacttaagcagaatttcaggtggtttcactgggaagcatacagtgtaaatctctcctcagcccctccccagaaatgtcagctaaatctgttactccttatttcttagataggagtaagttttggggtattggggagcacttagaggagagtttcaagaaaagaatgaaaaggtagctaatgggattatataacatcctacatgataacgcatgataaagactcaaatctgttaaatatagaggatggtgattatttgttaatgatcaatgtcagctgattaatgggaaataataggattaaggttttgaggaatagatttagattaggcatatcatggggaatttctgatgagatgactgtaaagtaggagtattatatcaaataacacttaaaagctctttctcagtgatggagagaaaagccatttcttggaaacagtatgggcagaaaatggagttggacaaagatcaattcagataggggagaaccctatagcacttagtgtcaaacccatgaaatcaaaaggtcttctttagtatctaactagttattcatatacagatgctcctcaatttatgataaggttacattctgataaatccattaagttgaaaaaatagtaagatgaaaatgtatttaatgctggcaatacaacagacagtcctcaaatgacgatggtttaatttacaattttttaactttacgatggtgagaaagcactgtgcattcagtagaaaccataaccccatcacaagttgtaaggagcttcttgacttggagttacatcccaatggagttatgtcccaaaagcataagttgaaccatcctaaatcagggaccatctgtgtttataaaatcactgaactttttcctgaagtgtcacatcacactacattgcacctaaggagagatgccactcctactctttttccagttttctgttaaggcagaaagataaaggagatatatactctttctcccatgctctcatagcactctgtaccttgctctatcccagcactttcactcatattctagttagtttatctctatcatgtctctaataaactataagcttaggatgatcaaggaaactagtcatctgtgcataccctgcagctagcaagcaaagtacctgaaatgtggtaggtgttaaatatatatataatatagttataaatttataaaatatattttacgttttatataaaatataaatattttacatgtaatttcaaatgaattcatgcaaggaggaaagaagagaggaaagtaaaaaatgaagaaaaaaaaggaaaagaaggaaataataaaggaaccaagaaaaaaaaaaatctcagttccagaatttagtcccaaagcttggaagtttaaagctaaagaacacaatgagggtggagggatttttcttgtatactagaatacagatgaattcaaagtgtcaaagaatgacaattaaaaaaaaatctgtcagatctttcaagataagctttagatgcacttaacaagtcaccctctaagctttaagattccacacctccctggcaaccaatgtaggatcacaagcaggttacagtgatgttctccttttgtgagacttcttgcagctgctctttgaatgagctgaaatctataaataactgcatctccagacccattaagcagtacattagtgtaacaaaggcatatatgtacagtactaaagaagtgaaattgttggaagaaaggaaaagtttccatttggcatgcaccacagaggatgaaaagcagacccaaccatttctcaaacatgaaattccattattggtttgtgattacatcctccacttttctactttgtatagcagccaattttaaactacaaatcatcatctttccatcttagagaggacatggtttctaaatgggtaaggttttacccacagcatgtctatctttgaagaactctatattgagagaaagagacagaaagagagatgacctgaaggcccccctctaaaaacatgcaatcaaacaaaatgaccaaatttgccaaggagacaactcaactagcatgtgcaggacagcagagaagaacaattttcttttggcacaaagaaaaatatcactcggcattacaaatataagtgtagagacatgacaagtaaaattatttttctcaggaaaactttgcttttggaaaaaaatatgctttatatatctaaattgaacaaataacaaaaaaaatcttgagaccttatgtataaagtgcccctctttccattaaaaacagaaaagaaaagaaaacaggccttgatgctactatggtaatatgtagggattggtaccatcggaggtttccagaagccactggagatcttgccacatatcctctgtggggaagggaggctactgtatgcagttttaaagtctttgtataggcaggttttaaagtgtaggacctttcacatttagacttctagagattttctgaaaagggcaacattagacttgaagacagtttatgaaatacgtaatggctcaactccttcccctcattcatggatatcaatcaaccacatacacaacctgctgtcatatgttgttgttttctactttccaaaatacacagaccataaaaaaaaaagtgatcaccgctagactttgctggtgagtaaattattcaagaaagcaatattatcagtaaacataagcctggatccattaaagctagaagagtcccattttacgcaaagcttttctaagcccctgggattcagggcaaacacatacaggttcatagagtaattcatcaaggtttgaagaatcaggtaaaacctgagtttatcaattcctacttctcccagataaacatgtctccaaaatgtttctgacaggcaactatccagcctcagctagtgatgggtgtggcagctcactgtgccagatagtcctaagagttcaccgttctctctcctgagcacctatctgaagaacaggagatctaaatctaaattctgtcctcaaaccctacctctgcagtgatatgtggtcttggaaagtgactcttctatccctggaatagggatactgaggcttaactaccatcttacctagccacagataaatttatgaaagtaactaaggacatatcagataattcttgcctccccctggtcaaattttttctgtgtttgcactcttgtgttcttttcacattcacattctaaaagttctaaagagtagacaatgtaaacagaatgttgtaactaaataaaagcctcaattaaaatggcaaagctatggactcctgagacagagcaagagagacaggaaagagtcgtcttgaggaagggataaggcctctgggacaagatttcaggtggatgtcaggcttcaaagatatagccatcaaaagaggtgaattctataaaccatacacatggcaacaaatcaaagcataattttgtatgcatacacagtacagaaaggcaatgttggtcacatcccggcctcttcagctgcactgatacacagaaagcaatttctgtaaacattattgtcttcttacataaaggaaatcagacaatatataattctataatttgtgctgttttgtgctcagctttttcattatgtactcattttacaccttgacccaaccgtggaaaacatattaagctagaaagtggaacattttaattgtagtggataaataactgacccttaaatggtggcaaactggcaaattagttatctattttccaaaaagccctggttagagccctttaatttatggaaatctacctgcaataaaacccagatcagaccaagaccagcctgagccagttgctcatcctgtttaacatttctcccagtagggtgacaaataacatattagttactctttaaacaaatgtgctcttaatgatgccactgccgcatgatgaataaagcattagccctgcagtcatgatcgccctgggacagggagcgttagcagaacacacccaccttgcatggattgccctgggtgagagactttgctttatctttctctaaatgaccacccatagcccttgctcatgctctgtaaccagtgagcaagaacagtggagccttgggtcccctgtgatggtcctttttgcttctcagggcctcataaatggtatggctatatcactgggagtaacccagaaggcatgatggggtagttaggggagggctatgggggcacaggagcctgatgcaaatgactgcacagcagcacatccagttggaaagttccagttcagcagtgagcattctgaggaaatgggtcaaacctttagtgctgctggttatatccagcaagatttaaatgaaggtgctcagaagagaaaaaggcctgagtgtccaaaaggtattcaggctcctgaggctagaggcagattagggggcacagaaaggtggttccaacctccaggaacatacatgattcagaagctgaatcctggttatttcttggtaaaaggtctttatgttctagctgcttttggaggtcaggcatcatcaaaagcaggaattggctacacctggttatctcagcaggccctcataacccagaaaacctccatggaggctcccacccccatcaaaagagatgagagaataaatgctgatggaaaggctccagctctgaaggcaaagttgaagggcactacaaaacactgttgctacagacccaaggcctttaccctctgtctgtcttggtcacagatttgcattaaaatgtcctccacccctaccgtcccccattaacacattctccttttcaataggaggagatatttgcctcttaagaatgccacataaaaatccttccttacaaggagatggcatttggaggactatgttcctcaaatagtctctttttctactacagtcttacagaccaaaggacccatctgcctctgagcaactagtctatttttttaactagggctgtgttctcaactaggcactagaggcataaggtctacaataatgatgaagacctgaaaatattttgtgtcaacatgcaatgaaaagcacactatctaaaacaaatatttaactaaatgtttataaattccatattatgacaattctaattatcaaatttagtattcacatgaaagtcattatagttgaaaaccatttgtaactgggctatctcactttgcagaaattactgagtgtgcaccattatggagaaattagagctggttttaaatgaaagaaataacttgcaggcaaataatttcaaaagcaaaatgatttaaaaaatcatctccaaagttcctataaacaaacttatactaaacatcagatgtgaacacacttgttatgtttgatctgatatggagtaagtaaatctgctgctgcctagaaaggttttaaatggttgtgttctgaggcactgtctccttcctgcctactgtgtgtaagataaagctatacttcctctcaaatttgccaaactcagttcaggatcgaatgccattccgttatttattcatggattacataaataattgtggaaaagaagaaggaggcatgagcaaaaattgaccttaaagaatacagatgagagagaaaaatatctggctcatggtaccgaatgcaatttcatgttagcttagagtcatcgtatgtatttaggttttattatttataaaaaagaaatcgtgctgaatgttctttgtgggaactgcaatatattgctattgctacgatggtttactattttcacagctagatggcttaaacccaaactaaacaaatattttaaaagaattcccaccagcattattacttttttttcgtttctagtgttaatgaaaaagatcttctgcttttcaagtcctctgatatctttactcttgagcaattctcaattttatggcttatgatgagataatgtttattgaaaaataacaacttaagaaaataaccagcaactagtggtggttaagcagtgcagtgtctgaagtgagggcatttgagaactgcagtggctgtcaactccaaatattcaccaggtcttgactattacggcaattaggatgatgattttattacttgcacactgaagtagacatatttttgtgtactcatccaagatatcaacttgacagtgtctactacacacagaattttgctaataagataaaaataaggtagatgtgacagtgagacacataatcaacataaaacaaaatgcaccatcatgtccagacttctcactgtatgaccaaacccttactttaataggggtcaccaccttcattcaaatgcactccccaaactcttgctatcattcttaactactggctaattcaccatccttttctctagggataaaatttgcacagaaatgcaatgacacagttctcttcaatctgagagtaaatatcaatatacactagagaggtggggatttttttgttttaaaaatattattgctgatacatgtaatgagttcaaacaaagctaaagtctataaagtaaaaggggaatgccattccgttactccttatctgccagccaacacactccccagatggaaccgctgggaaaatagctccctatacagcagtcactgtggcaagaaactcacatcctcgatctcatgaaaaagactcacaacaacctatgagatagatgttattccaactttttacaaaagaaaataaactaaggtccagaaggctattcctttggatttttacccaaggtcagaaagccaatgaatggcagagcccaggactcaatgtaccctagcctggatgtctgttgttacagatttggggaactccaactttctcccacaaagagtcagactagaaggttcctctgggtttaactggctctaaagagagaaagaagtctagggtaaaggttagttccatccctgggggtagatttatttatgcaacatatctttataagatgttgactgtatgtagcactgtgcttgataccaagaacgtaatagtgaacaagacatagaccctgtcttcaaaaagtttgcaataatacagtcaggtaactaaacaaactaaaaagtaccagcagacatgaacttgctatagcatggcaaattagatattcttaggaacatgcctcttataagaaaacaacaactagattctggataagaccacttatttatgtattactaggctttctactaggcttggtaaaggaaaccctgctagacatctgcttctaaaaagaaagaaaacaaaaaaagttggctgaaaccagaaggatgagccaggagtagtaagttgcttggagggaaagtgccaacatcagcaatgcaccaggagatagcctgtcatggcaaggtcaagccctggtctgaggtttccatggcaatcaggacctgaagatttgttgcacctttacatggcccttaccccagtcagccttctcaaactctcgacttcagttttagaagtaggcaagtgaaagaatctgggcaaaccagcagaaatcactgctgaaagacaactcaagacccatgctttattgagaggcacatttttcttaaataagtcagaataataattgtgtacttagagaaagagagagagagaacaaacatataaagtttctacctagggttgatctgtaatccaaattgggcttaactcagtccaaatatatatattgagggcaaactgatggtttaagctgagagcttgggataaagaaggtataaacatcatcattatcaaggactgtccaggtccattctccccatgtcaacagcttctatttgcaatctctaaatcatccacaccctcaccacaactgtactgcctgatagaatgcactagtgagtgaggcggatggcaaagtagaaaggctggtcccagctttatatatagaaaggctgggaggtggagtcaggttactattactttttcttacctcatcccctttctgccagaaccttcttctgttctacttctcttacttgtaccaaatacactctctctaacacgagctatctcatcatgttggcagctagctacaaggaagaggcctggaatgcagttctcctttctacctgtcattgggaataggagctacagaaactagggttggtgaggcgggtggggggtactgtggaggtgggtaaagccacaagctggataaaccagaaaacccaacttctaactcctattccaagggatagctgacattctagaggtgctgaaagagtgaggatctatgtcagttatcatgtgggacactgaaatcaaagtccctctgcatgctgattagaatcatcacccattgtggcggctattttttcattctcagtagagacaaactgaaaccctgagaactgatctgggcaagtcgctttctctgactctcctaagaaacgtgcacagcagtttggcagcacaatttgcataccagaggagagctcctgtcacaagtaccctgtgggccagtttcctgagcttttccacttgatgctttcaagcctcatctcacgagtcattggagaggctaacgtataatgccttttggaggagctgaaaggaataaaacattactagcaaaacggtcatatattttgagagttaaaatctagatccctttagataggccctctgaaagaaatgctttcgactacgatggcagcagcaaaaactctgttaaggacagcttcatgagcacaacttcccagccactattcccacctgaaaagtacatattctggtctgcatttttttttctacaagtattttgctttgattcattgttgatacacatgacagcagaataataaactaggtagtttgagcctgtgtgtgactgggattcggcataagcatcacaattttggtttgtaaattcctttggttcagtagatcaaatggggaaagacttgtgtaatgtgaaattcaatgaccagcaatggcagggatcttttggatatgtaatctgctgttggagccatgcttggggaccaaatagatgagcaggccatgttaggaagggcagcaaggaaaagagaaaacatgaattaatattaaaaatgtgatgcaaaataaaatggaggttatagtcatatccttccaattgtattgagctgaaattgtttctggatttggaagctccttgctaagctaaattgcaaaaataagattatatgaggagaaaaggtaatttccaaaatataataaacataatacaattactgcacacttatatatgaaatccagaaaggtatatttctttcacgccatgtgatcacagttttgttacagttttatgttcttattttatgctttccactagttttcttgactttgcatattcttgatgcaaatcagtgaatgcatataaagtgtaaacaataggctctcaacatggagcctacccaaatgatttaactgtgtagcattgattatcttgtccactgtgtgagcaacgtgcacaaaatatgcattttgtatgttacggaggtcttgctgatgtggatgaagaagtgtgagaactaggatggagaagaagctaacttcaacagtctactctttagtgtcctccctttacataaaacaaaacaaacaactgatcagctactagtaatcaacaaacttaaatttgctgagaggaagtagttaaatagcaataccaagatgtagaggttagggaaggttgttttgcccctgcctattgacctacatatactgaagcaaaattggaaaactgcagcatatttggtcacaaggtctttctatttccattcataatttcttttctttattccctctttttttttgttcttcagagaacacctttcttgatatgggtgttttaaaattctgatcagaactggcagtgggaaaagagctgaggaaataacggagactcatacttatgtgacacattcacaaaccctatgaatttttaatgaaggcacaatgtccacaattagatttgaaatgaggttttctttgtaggcgctcttacagtaagtggagtgcaagcgaattttactttatattcagtaaatgataccaagtgcaaaaaacactacaatttaatagaaaataaaaacaaattgttgattgttcatagctcctttttcatctcttagatttacaaaagtgtagcagttaaaaaaattgcatttcgttttatttaaataccacatggatgccaaggcaactcaaaggtatagaaagtcattttcagtcatgacctgaagctgtccttttgcattgtgtggagaagtttttgtttgttttaaactgtaaaaatgacttctaaatgtagatctttggggagaaagatattaagcttccctatttgcaaactaagccatttcaaatgaacataaaaaaaaaatctaatagtgtagaaaataaggaaatagagtgggctgatggctacttcgtttgcattttgattttaaagcttaactcttgtcttcatagggcttaggttttcagcttcgcagaaacagacacagtttcccatccttcttaggtggtttccaaagtccttcagtttctggctcctggtcaccttggcaacatcatttcctaaagctgcttcttctcttggagctcccgcaacacagatgcttttactcttccttgagcctagcaagtgtgatcttctcttagtgactctgcacttgtggttcctccaggtaactgcgcaaccaccctgctccctcacctgggcccttctctgacgaaatgtcatccctgacctctacctaaaatagcaactgcgtcaccttctgtccttctactagccttattttctttctctctaggatttcttggcatctgaggttatattacatagttatttctttgataaattagtcatccatgagggcacacttatttttaaccttttaaaaatgtttttcttggtaaattgccatcagccaaaacagtgcctagtacttagtagacacacacccttccctcccacatacgcaaattcattgattaaatattatgagtgggtgtatatatacatacacacataaatatgtataaacacaccgtattaatcattactgtttgattttctatattcctgatgctttgacatatgggtccttgctgacattggagggatctcccctcccagggctagccaatccaagagagcaaacgcctcacctgggagcacacacgtcataggcaaaccaaccaatccagatcccagaccctcgaacacctcctttactggctctcagatgctgaaccactattcctctggcctaatcaccccggagccaagtataggccttataccccagagcttaaattattcaaactagcccatcctacgcctgtttattccaccttgccttgcctcctgttttgcagaaatcacaataaaggcgctctcacttcctctcccttctgactgaccctggcgcctccctgtgtggctcctcgttgtgtggtgtggcaagcttccttctctttggaactgtgaataacaaactatcttttctatggcagtcgtctcctgatctgttggccttaccacaccctataataataaaaactgcattttcaaatgcaaacaaataaacactcaaataaaattcactgtattttcaaggacaatgaaatatagtaatcgccagaagttatgatttttctggactcataagaaataaaatcaggcagggtacagtggctaacacctgtaatcccagcactttgggaggccgaggcaggtggatcaatttgacgccagttcgagaccagcctggccaacatggtgaaaccccatctctactaaaaatagaaaaaaaaatgaggtgggcgtggtggcgcatgtttgtaatcccagctccttgggaggctgaggcacgagaattgcttgagcctgggaggcagaggttgcagtgagctgagattgtaccactgcactccagcctgggcaacagagtgagactctgtctcaaaaaatgaataaatacataaataaaaatagaaagaaagaaaatgactttgacattttaaagatctgtgtacagtttcaactccgtctcagccctgagattcatttatgaattgcttttgtggttattattgttgctttctactttcgccctttaagtttttttgtttatttatttcttttttttaagggggattcagacactattacctcaaaggagcagcgctgccttattctttttgctagatacaaatcgttaaccctattcaccaaacagcaattaattgtcaataaaacacatccacactgtgaactctggtgtcaacgtaggcttatcaattgtaacaactctgagggggatgttgatatgggggagaccatgcatgtctgaggtctggggctatctcttagtctgtttagggttgctataacagaatacccgaggccaagtactttataaagatttagctcatggttctgcaggctgtacaaaaggcatggtgccaacatctgcttggcttctggtgaggccgtttcatgctgcatcatagcatggcagagaaaatcaagggggaagtgaacatgtgtgaagaggcaaaacctcaggggcatcctttttataataacccactctcatgagaacattcctcagtgaactaatccagtcttccttgagcgagaactcactcgctacttcaagaacaacaccaagccattcatgagggatctaatcccatgacccaaacacctcctattagacccacctcccaacactgtcacactggggatcaagtttcaacatgagtgttggtggggacaaactcaaaccatagcagatatatgggaaatttctgtaccttctgctcaaaattgctgtgaatctaatagtgctctaaaagaattgtcttaaaaaaatacatacacatatatgtttattctctttaaatataagaaaataataaatcctatccataatttcctaaattatagttagctctaaatgtaataagaacacatttctatgacgtgatgcactctgagttttttcaacacatttgttccttttttattccaaaaactatggttcatgttgttccatggccaatttgccagatgcttcaacattccctgctggaacgcacctcagacagggctaagtcagggccttccaggggcatggcaaccatgaaaactgatcctgggaaactgacctttaatatattttcatagtaagctcagaggaatgtgctgggtgattacccattacttgtacctggtaaggacacaggcctgaagctagagtctttgcacagtagagatgggccagcaagatataaagatgtccacagaagtggccaaggaaaccactagaatgcactggagggagcctcaatccagtcagttgctaacactggcagtagggccttccctgggatttgatagcctatgcagctgtcttcatgcagttcagattcatgcctcctttacttaccttacagagctcttgccaacatggtcaccctggtgacaaccatgtgctctctaacagaaatacctgaccctgctcaaggtattagaaacaataagagaataatttttaggagacttgagagaggtcttaaaactgtgctcatatgctttttttgaaaacatggttttcaaataaaagcaagggttgagacatccaaggagctagtcgctctccctctagtccttcggccttcctttctgcctggtgttgcacattgcctcccacacgccagtgctcacagctgctccactgtgggtgtggctgttccttctcttctctatgcttctctctttttaggctcatataaaggcccacctcctccaagacaccatgtaagatcaattttctacaaccacttgctcctctgaaccccagagttccccaagggtggtatgtcagaggatttaatgtgggacccaacaccattattttaatttttaatagctatatttgctttgagtcatgtgaaattgatgtttctgtggatttaaaaaatggtcaaatattggcagtttcatgtagttcaacctaatatgtgtcagggaaaaaatattaaaagaaaaccagacatcattgtttaggatgaggctaaaatgagtactttattgaactgtgtaaaaatgaataagtaaataaacgttttgatggtacagatacagcaaaaattattaagcttgtatccactactgaaccactgaccaaatgtattttgacaatcactgttctacgtgtccttttaacgtgtcttattattgtgtgtgtgtggtttttttttttttttttttttttttgtatatctatgtatttgtgttttctcttccattagtttcctggatatttgtacacaagaggcaaggagagattacaaacctcttagcataatacccggcacgcagaagacggacttgacatagggatttgtctggtcacttatgatgagatcttaccaggaaacaccatttgttttccttatggtcattctaaaactggaaactgatgggccacgcaatggagtatgccattccagccaggaaacctacaacctggagcaaatgaaaacacaggactcctatggagcactccacgctgggagctaacctcaccactgggaagcattaaggggtagtgtggcctgttggtcagaacatgaccatctggactcattctcagcagtgtgattgtacattacatcctccacttctccattccaactgacaatgccaccaatagctgagaaagtggaggccatgggaagctggtacctactaggatatcctattggctcctgtcctctctgcccagttactgaccacggcaccaagcttcagattctgtttaatactgtcctttacacaatggtgcctgggtcttttgaaatggatagggataattatgattcatatgcttcaagaaataaaccacggtactcacacaacctacatatttcatttctattttaaaaacacaaaatacttacatgctgttggtgttttgaaagcttttgccacttatgcttttttaaatataatggttcagaaacaaaattctgcctgctaatcagtctttatttccattcataaaaaattatgtctccataatacctaagaggtcaataactagatgttgaaacaaataatattaaagaaaaatatttattgtagaagtctgtggttgaggcagaagaaaggtgttattttcatctggggtatcaagaaaacaccatgaatggagaagaatatggtctgagtctcaaaggattaaaaaaaaaaaaaaaccaacctatgtgggaagagagacagagagaaagtgcgcaggcagctcaggcaggaaatggtaaactcaaatgtgtgaaatcgggagcgttggaggctgctgaaaggacatagctgcctctttactattttacatttaagtcaagttattcagattatattggtctctgtatgtatataatgacaatagtagttttattctctaaaaagttgctttgagaaaaatgtcaagggatttaaatgcatgcttccaaagtacaatgttttcctacataaagatgctggtttatcaactagaaaactaaagtgggcttctttataaaagatagactgaaaagattaggaaagtcttgacaatataaacatacatttactcaccaactcatgaaatactaaaactaggttttactgctcaaagaaagcataaaatagatcatttcagtagaaagaaaataaagcacattttttacaacatagaaagtaatctcagaattcattaaccaagagaccaaaaacaatacctaaaatattatatatgttaagggagctttaaataaagtcatggagagcagatttacaatgctttaattgaaccaggataggaatggcaggagtctgttcacaacctttcatggcagagaagagttatataacagccttgatattggccagctgcaaaaaaagtcaataacaatatgaagatgacaggacttttggaagaaagttactatacagcttggagttcataatattatgtgaggatagagaacattaattctaatcagatccacatcattatttacagaaaacttttttttttaaggttcagagaaaatacaagtgtgatataaacacacaggtatcagggctaataagtgtaagagagatttagaaaaataaaattttgattctataactggatagtcataatcctagtgaaacaaaaagagatgccactgtagaaatcactatggcttacaataatttctctgatgaattttgattctaaaatgacaagtaataaatggaaccaaggacacgagggtaaagacaaacaccagtgtgtgggaataattcctagaagaatgctgaagaggcctaaatacaggactgggatcgaacattttgaaaaaacataccaaagggatgtttatagaacatattttttaaagtcttcaaaagaagaacaaggaaaaatagcaatacttttggggaaggccattaacaataaatagcaaagatgacagaactgttcaactcccattttgtgaatccacccctgcaagcaaaataatccgcacattgggaagggtagaataaacaaaatacgcatggaatttcagcctgacgtggtgatggggggatttactcaccaacccagagctagcatcagacattcacagaacaagccagtaagacccaatcctgcaaccaacataatatgacactaggttaaatgcttccactttcctttcccgaaaatctgagcttgtggcaactttatcgggattcaatcatttgaccttgagaacttagtgcaactatggaaatgacccataatgactaccggaattccaaagagttggtgccagttttagaatgacaacttactaggtttgtgacctggggcaaaagatacaggatgagactgattttcacatattagaagtaaagcggatatagaaggtgaactagattagttaagcaatacgccaaagaatggacttagtgccaatggttagggtttatggcggaccgatttcagggtcatccattctttttcccattcattcagtgaatatttagtaacttccactgtgtgcagcaccattttaaattctaggtgaacaagaaactcactccaaagaagggagacctggaaaaataggtcagtataaagcagataaatgggtaaatgcattaaaacgcaggttaacagaaacaacacagaagaaaaaacaattaactttgaaggtaattttagattttctccaaggttaaatagaggaaaaaattggtggggagggataataaaacaccttaaaatgtgtttcaggcatgacaacactatgatcaaaaatacttctgtgtgaaaagtatgtggcatgatacagaaaatgagtatttttgtttggctgtagtttaaagggaacatggtgaaaaagtggagaacgatgctaacaatgtaggcaggggtcatgctaaggagtttaattcctacaggcaatggagaccaaatggaatattttaaatggggagtgacagggtcaaatttgtaatttagagcaataattcttagagaagtacagagtaagctctacaggaagacaagcctgaggagggtaaatctatttggaggtaattatgggagaccagacaagatgaggcagtggcagcggagatgaagagagggaacagatttaagaggtacttctggagacagaagagatagcaattggaatgtggaagtgagagggagtgagtgacatgtgtgagggcccaagaaggtaacattcaaaaatgaatcccaggtttccacctcaaaggaattgttggataaaaatagggatttccatggcacaagaacacttaaaggattagtttagttcaggaggaaaatgtaagttttccacagagcaatcaaatgcttcaatattaaacttacaaaccatacaaaaatgtatctgtcccctggatggctatttgcttccctcagtagccacaaagctatgttgtatgcctggcacacagtggctctcaacctctgatgggcattggacttgaatcaaattgcctgaggagacttttccaaatgcatatgcttggtcttcacccccaggagattctgatttagtggatctgatgtgaggtgcaggcattttttaaaacagctccaaaggagattctgatatgcatccaaatctgacagccactgtagtatacagtcgatccatagctctttgagtgattagttaaaaggaggaagggaaggagagggcttcttgaaatttttgaagaagcagctggttgactttctatgctcaacagtgtattattgtgtgagaaatttactaaatgaactttcctgtcttttaatctttttttttttttttttttgagcggagtttcatgcttattgcccaagctggagtgcagtggtgcaatctcggctcattgcaacctctgcctcccacctcccgggttcaagcaattctcctgcctcagcctcccgagtagctgggattacaggcacccgtgggtcacacctggctaatttttttgtattttttttttcacttttttttttgagacggagtctcactctgtcacccaggctggagtgcaatggtgagatcttggctcactgcaacctctgcctcccaggttcaagtgattctctgacctcagccaccacgcctggctaatttttgtatttttaatagagacagggtttcaccatgctcgtcaggctggtctcgagctcctgacctcgtgatctgcccacctcagcctcgcaaagtgctgggattacaggcgtgagccaccgtccctggccttcctatcttctaatcttaagggtccacaaatgtgatgttatagtgttcctggcttcaacttgcagacagaacactggctgagagattactggactcactcaaattcaatcttttcttatatttttttacattattgatgaacatcccttcttatagcaactcgttctttaacattttttgtgtgcttttacatatttttcatttacttttttctcaatgtctattcctcctactagactgatgttctatgaaagcaagcattctgtttcttttgttcactatcgtgtatgtaagcactgacctagcaaaacacacacgttcagtcaataaatgagcaacgagccagatttttctggtgaaacatttgaagccacaatgcattattttcaatatgcctataggtacatccatgagtgtattatagattcagaaaatggtttcagaaataatcaaaagcatacagctataggcaaaacatgtttatatatatgtatattttttacctcgaggaaacctttgactcccaaaatttttatgttatgtaagacagccccttacatcagcaaataaaattaaaaatagggaataaatatctaaaagggtgaattaggcacagaggtgtagcctgagaaatagaagctaaacctcgttcctgttccttatctattaatagatctcagaagcctgaaccttgaagtctgataaatctagagctttcctgtcatttatatctaatgatcaattctaacagttagacaaaaaaccactaaatgaatgaaaagatgaattattgagaaacttagagggtcttttagcatggcaattaaagaagtagaaacaagtggctaacttgaagagccagaaatgttaaaaatctctgtattaatagtgattactgaagtgtttttaggttccaagttaaacatttgctgacactgcttactacaatatgtaggtaactcacgacatttttaaagacattttactgccctgagattgaatgtgagtttttttaacaaaaaaattatcaaaatcagaattctactttacctaaaatttgccaagcaactactatctgctactactttcgcatgtatcatctcatgtagtttccataaaaactgtactttaccaatcagaaaactaaaaataagagcaaccttagatgaatgcctaaaactagaatgctataaaaagtgttaattataatacaaatcactgaagtatcattttatccaggtaaatttatacatatgtataaaagtgtatttttaaaaatactaaatatgaacctcaatcataagaatgatacaagaatactatgttttgattaatgataaatttggctaactggagaaaacattgtttcaactgatgttatcaaacaggttttgaaagcagtaataagacacattgacatgatatgcttgatacacttgagaaggttacaccacctctgtggtattcttgccaaaattttataacctcaatttaatcatgaaagaacatcacacaaacccaaatcaaggatattctataagataaccagtacgcttcaaaaatttcacagccatgaaagacaaaaaaagactgaagatctgtcctactgatttctgatatttctaatgtaagatcagtagtcattacatactattggttgtataaatataggcctaagaaattggaatgattccatgttgcatccagcgtattaactaagtgttatgatgcaaagttgtttgtatattagctgcaatttcccccatgacttataagaaaaaaaattccttattaactaatgactccagttaactgattgaaattacattctactaagctaaatatacatgtcatttcttacaagggctgtatgtttttataaatcagtatctcagctcgaattgttggaattatcatggttacttccattgttcagacaggaaaaaagacaggagtagtaaaacaaagggagaggggccatttgcagcaaggagaaaggaaacacgattctaaaacacattcattaacccagggctactactagatgctctaggctagaaatgaccaggctgcttctaaacagattttaatttttaattcagtagaataggtcagatacagctctcccacctggaggtcctgccctagaacctacctgcccgaaggcggcactgcgggtctgctggtaatcatcatctttgggcaaatgaaatctccagtcagctacacccgctctgtatgttgtgatcccaagaaccagtaataaaagttggacaagatctcacaatgaagtggaggttttctccttcgattttttttttttaggagcaagaaagaacacttttttttttaagccattagaaatgtttttaaaggtagaggtagaaggagggatgttggtgtttgaaataaaattctaataaataaagatcagttttactacttaattaaaattgggtagaggcatatatgtgggtccaaatttgatgctcaccatacaaatgcccagacacgagagagatctcctgggaaattaaaacgcctacacgtagggagaattgaacagaccagggccccagagcctccgcacatggagctaaaacaagcatagaggagccgagtcggactgattccccagctcttcacagcccccagattagctgggtattagtgcaggctggtctcagctgcccatgaaaatgagaacacattttaaaacctgcatttgaattttaaaggtactcaacatttctagtattgtttactgaaaaaggtcaacactcaagtgttttatttatgcacggcagaacctcagtctaaaagcactaggctttccatatggcatagcctgagaatgtgttaaatatgtagttccagagccaagaatattatttttcaacttagcgaatgcattattaaaagacctctgctgtgcccaccactgggagatagggcaagaggcagcagtgaccctgcattctgaatgcacagagacactgacagtcactcactctaaataccaatgacaatatccccaaacccacaccaccctaacccatgccttgctctgaatttgggcagtctggaaaaaatgaaaatggaaacctttaaataaaactcataaaacttcagttccaagcacaatatttttggttctttggacaataagtgtttcactgagatttatgcctagggtccttttccatatcccggctctgtgtcagcgttcacatcagccctcagttcttcttgcaaatcaagggtataatatactgattccttcaaataatatttgtgttaaaatcattaaatgcccatgcaagtaattttttattaatgggatgagaaataatacataatacataccaattttatgacagcgagaggagttattaactttagaatatctgttgtataaattaaaaatcttaagaataagtccagtgttttaaatatactatggaaaaacaaaattaatgccaggagaattttgactggaatatagaaatgcctttatcattctgggaaaaatactaccctataaaagccacatcctctgataagttcagaaattatcctttttatataaatattattcacttggaaaaatgttttctataaacagctcccttagtgcattttaacacatacttttatttacagacattagatttacacatgtttccagtataaatctttcgtatatagcaaagagaatctgtgaccaaaaattctgttcaattcggatgtggggagcaaataaatgaccaatgttcccatatacatagtaatatatggctaattttatataacatgttcacattaaaaataagaacataaaaatttttaaatcttcaggaactgtcttcaggaaatttcagaagactatgacttttaaattacgcttttacttgatccaccttccaaaagctcagaatccttatattaaaagagctggcactgacataatttgatttaatcctgtaaatatgcatggaagtcccgatgtacatcatctactatgctctgcctgcgtgatgcaaggtgaatcaggcaccatccactgtccctcttgttaaggagtccacaactgtgctggcaggacagacacgtatataactgattataatgtacttgagataactggtatatcccggtggtgggaataagaggctttggcagcacacggagtaaagagcgaggatcctggaaggcaacctgcatgtagggagagtggaagctcacccgaggaggtgacatttgagctggttgtaaaggaagaataggatcagaccaggcgaaggagaggcattccaagtgaagaaaaaacaattatccacacatgccaagtttttcagatttgacttttagaagcgttttacttcaaaaaggtttaagtgtgcaatgtctaacaagaagcaaaaattacaatctagattgtttctttatgactagcctgctcttctcccacggatcctagctgtttaggaagtacaggtagtaagaagaggatgtgaagtactttggtagccacagagaaagtgagaacgctgcagtaactgaactaaagattagaattagcactgtaggcctgtgagtggggtcgggggagctaccagtgaattgaggaaaagcaaaagtgttttaagcagactgcaatagcaccccttttcagtctgcttaaaacataagccttaaccttcttaagaaagagtctgctaaaacacagtctgccaggcctatcaactacagggtctgcgaggaatttgctctgagctgggacctgttagtcatcagcaaggagagcaaggagagcggatcattttctttcaataatttaatcacactggtgtgagtggaggtgaaggctgagctgcaggcttcatattctacttctttcacagacggcaaaggaagagtagaaaagcaaggtcccctgggtggacctggagagagaaaaaagttctgggacatcccttgtcttcagctgggttctaggaaaaggccaggggtgacaatagctcaaatgaagatggccggtaaatggctgagaagaccaagaagacagactgtgacccgtttcacagtgcctaactaaaccagaatttcaaattcttaagttagctagaaacatatttcatttattcacattttaaaaaaatcaagttaattcattcatattggcatttaaaaaacgtgtataagagaggtacaaaaactgaattgtgttcattgttcacctttctttgagttctacatacagagtcaagttgtaggagggatgtattcaggaggacaagccttggggatttcactcttttattattctctgtataaaagaagatggtttgttggatccacgtgccacccgtacctcttccctgggcatgtggccacgaggcagggggcagaagctgccctgggctagggagacctgggttctggcttccagttctgggtctgccactgacccactatgtgaactcgggctggtcacagttttctcaagtaagaatgagaagcaaggactggactggactcttttcctggctgttttctgctccagtgctttctgattctatagaacaatactatgttctagagaaatgtttccttctttctgggttttttttttttttttgatacggagtcttgctttgttgcccaggctggggcacagtggcacgatctcggctcactgcaagctccacctcctgggttcacaccattctcctgcctcagcctcccaagtagctgggactacaggcacccaccaccacgcctggctaattttttgtatttttagtagagatggggtttcaccgtgttagccaggatggtcttgatctcctgacctcgtgatctgcccgccttggcctcccaaagtgctgggattacaggtgtgagccactgcccccggcccactttctgggtcttatacatttcttttttttaaaaaagccactgcaataacaacaatgtcccatctagtgttaaaacagggaacatggtccaggactgcagaatgaggaatggcgctcaggtctttcctggcttgggggttctgaatggcgattgaagggcatggatcctgctcaggtggtttttgttggatctcaatgacccaactttttcaaagagggcattttttaaaagactgtgttttacaacttttatgtgtgatgtacaacaccagcataataggaccattaccaagggcacatggaacaatctttcctattatttttactggcagctatcaccaaaagcaaaagagcctcctgggatgcaggtcatcaggcagccccttcctgggagataagaagagattctgggtgtgacgcaagcaattcagctaagctctggctcctcactgaaatcttcacagacataaacctgggagttctgcagggtttaatcagttcagccttcccttttcattgctttctttctgaaagctcccacgaggaaaacatctccaatctgggtaatagctaaccacacactcagaactttccaggttccacagtagtctgtctcccttcttcctaaatgccaacccacaagaaaagaaatcaagggagggaacaaatgtaaatactgagacaatgcaggtatctttgaaacaaatgatcatcttccttcttgtgggtttgtcctgtgccttgttttttttttttcattaagtgccaagacaatttaatttgtaaactgccatataaaaatggcctcattttggaatctgcctcccttttggaacccaggtcagttccgtggaatatttgtggagtgactacagcatgccagacactgtcttaatgatgtctgggctgagagaacaaaatgagcctggactcagaaattctccatctcactgcctattgctcagagctttgtggcccagattaccagaattttcagtggcaaggatttcctttttttttttcttcttaaacctgagtttcttgatggttgaatacatcccagtggctccttatcttctagaatgcttaaatgcctactgggctgatggctctaactcacccgcttgttaacctgcgttgatctctcctaactggctacctctctatgccctccatggctattctgccttctgggcttaccttctagtcaaatacttggaattctcctgtttataagccccatctaacttctgcccaaccttcagccttggcttgccagtttaatctgtctctactgtgatccacatccccaaatcagcttggttctcatgtgccccaaattgtccttaactccctcatccaacaatcccatattcctattccacagtctccatgcccatcctgggggcacagtactctttgactaaagtttagaatgatagtctctggtcagtcctgtcctaccagtcaaaccctaatctcaatccaggtctggaagctgcgataatcttgagtacaatacgaactggtaatcagcaagtggggtagctcaaacagaatactggcaaatgaaatttgccttagagggccatgagaacatagtggcctctgattaataccaaagaaagaaaacatctagaatatttcttgaacacctagagtaatgcctggtacaaaataggagctcaaaaaattggcaaattatagaaagatgtcttttaaataacacattgcaaatgttgaggatatgactgtctattgtaagattcttctggataaactgtctgattcgtgtgtatatcccaagggcccagcacagtgcctgacatatagtaggcttgataaatatttgctgaactgaaatgactttgttgagaaaagtatgtcgatgtcacttggtggaggatatctacttttccagcagtgtggatgagcaggacatcttaggatgtctaaactaaaggatcagcttggttgggcccctaaatttacatgccaaggtgttcttaaggcactagagtatggaagtctatcagatggacagggaccacaataggagaggggtaggaaccctgcaagatagtctgtgccctgacttacattccctgtctactggaattctctggacctttgggttttatccagaatgcaggagatctttttgacacctttttcactcattcatatgcaaaagcagaaatctgggtctggccaagcatctctgatgcatacatgaaatgtacatgagcataaaacagccagctatagcccttctaatggagaccttcatagctgccataacagctgatggattggtgtaaggctagtagttttgaagttatattttgtatttattgttgaagctatcagaaatgtagagaacactgaggtcaatcaagagtatatgattttccaagtatattaaaatgtgtttgtgttcctttcatacaaaacataaagcatccatctttaaaatgttcacagcaatcaatgcctttaattgagcagaaaagcatatacagatatagaaatgtttagtcctagccgtggttcctgacaatcatcttcagagataaatttccacaatggatgtttcaattaagacagtaatatttattgaaaggtaaaccataaatgtatagccactggaaacattattgaacagaagtaatttatgctgcagctggtgcactgcatttttgcactgctttgattttatcagcatttgtcaattaatcaacatgaaccttgtaaaacatgttctcttattagttggaacaggcaattgcttgcaaactttgcaggagaggtcatttaataatttgctaattgtgcaaagacagatttaaaataaaaataaaaaaggttaactctcattaccattgtacctaaataggactttgtttaagcttaggcttgccaatttaaatattgtcaatggtttaatttttaaaaaaacttcaaacggcaaataaagattaagatgaagatcaacttagctctaggtttttaaaatttaagagcattttttgtttgcatctttgccatttcaaagagttactagccttgaggctatagttataagacaaattgactatattttattgggagaaaagtgaagagaaaaaagaaaaagcaaaagaaacaggaaatgcagcagcacaaagagcaatccagtagtacagttcttttttttctcccccttttttgcctcaactcattcttcattgatctagatgagatgtcacctccctacttttgactgctggttcattttcagttcagtaagtgagaaagaagctgagtcaagccctctctttgggtaattcatgcatcagcacactcgccaactctcctggcaaccaagaaagcactttaactcagagcggcatcgccaccaacaagcattctgcagccatctaaaaggacgcaactgagtttaaaacgggtaacataccttggagagcaatttctacactggggtctgcagggctgaatcgagaaatccgcaccatcttagaagtgtaagtgaaacttaaaatgaaatggcatgccttaaggcatttataagagtaagaattttgcacagagttcacagagacaatgtttgttgaatgaagatgggccttgccagatacagtctaggcaaagtgctttgctgcagagctccttttataagagtttagaggcccaagttgctctctgcctgttcaaactggcttatcaatccattccattccattctgttctcagttctaaataagtcattatttcacgcacatttccctaagcagacgcaaacactgttttccagtgtgagactcccttgggcaaattaggtttcttggaaaagggtcaaggagcgatcaaacaaaatacctcctagaaacaagtggtttcaggggacattgtgatttatgcaggctacaagtcaaattttagacactggttgggcagtaatgttgaatctgatagggctagttatggggagcaaaatcctgctacctgcagtttctttttaaggtaataataaatgggcgtatttcttatggaaacaaaactgatgatcataaaacaatcaatagaaagtttccttttctaatattttgaattaaaaggtgttaaacaaattttaatttcttaataaaattgtagtaaagtaactttcataaggcaaaagttcatatcttctattctcacagtcttacctaacaaacatgaaatacttctaaaatagatacttcttattgttttttttttgtttgtttgagtcacagggagaaaagtcccttttatgttcttttaatacttgcttttattaacctcagcttcagttagctcacttccatatatcaagattctttctacaaccgaagagacaagaggtaaatgcaaatgtgggaagggaagctgcttggtaacacactagctgctccctggcagcagttatttctatctaaagcatatataccatattaagaggccatagtgaaaaatgaaaggatggaacggcaggttttcatttgtttttaacattttagaatgctgtaaataagtttgtgtgtttcaattcaaatggttccattacctcggaggccttaatcatttgtaatagcaatttcggaagcgtccaaagcttgtgcttaaggagtattattggcattcaatatagtcatatgatattaagcagatttacaacgttctatgtggttatccctgatcatctttatttaaaagtaagttctggctgatgaggtggcttagtatcctcatggattttggcttgttagccgtcccctgccagaaaatctggctctgctggacaccctcacacctctccaaataaaccttaaatttgcaaggtgaagtggggggcagcagatggcaggaagagttcaactaagaaagaagtttacaaaggcagctttttaagaaaatgtacctggggttttggttttattcaagtacgacgaggccaacagatcaggaggtgactgtcattgagaggatagtttgtcacagttccaagaagagcaggcatgccagaccacactgggctacctggggaggcaccagggtcagtaggaggcagaggaaatacggggaaaatgtggggaagggcctttattatggtttccatggaaagaacaggcaagacagagtaagcagctttaggatagctaatttaaataatttcagcaggctctgtggtatagggacggttcctagttatgcagtacctggccctggagtgattcagggcaggtaaatagtgttctggattgcaggagcctgataaaaggaagcaggtagtggcgtggactcaggattggttggtttgaatatcaaaggcgagctcatgggcaagatgtttgctatctctaggtatcagctgacccaggaaggtttagcatcccaagtccacaaggccccaagatgtcaaagcactgtaaaatacagaaaatttttaaaaacaacaacataattaatagaagcctgtctgaaacactgctataagaaacatgaaaacagagcttctgaaacttcactgtccacagggatcacccgggtattttgttaaactgcagattttgattcattaaatcaggtaaacgttgagaccttgcatttctcataaacttcttggtgatgttgggaccacattttgagtagttagaagtaaaaatatcatgaagggtcttctctctggctcatcttcggtcaggaaaggggaaggaccttacataccgagtcttaccttggaccagacgctgcaaggcactgaatatatatacttggtcttattttgctttaagagcaaactttgctagtgggaaaattatcccaattttataggtaagggaactcaggctggttaagtaacctgctctaggtcatttagttaaaaggtagtagatataaatgtatctggcctaaaaatccatttttctcccaccacaatgtaagtacacagggcactcctctgatggaaaatgaaaagtctgttggtaaaggcttcataaaatataaagcccatgaacttcaatagtggcccatttacaacttgacttatggaaagaagagaaatcagaatggtacttattgtctcacaattagaaataaatggtgtttattaataagtgattattttatcatagccttcacaaaacactttaaatgggagtccctataaaactagtgtttttattaaaaaagatacgtacatgtacatggtaagatatatacaataaaaagttagtcttgctcctagtctcctacttctactgctcacaggtaactactgtgaagtttgtatagccttgcagtactgtttctatgcaaataataaacctttctcatataaattcattcatttggttattctaggtacttggggaaaagcagtaaataaaacagacaaaatcccttatgtaggttatattccagtatgaagatagatcacaaataaacaaataagttatagattatatcagatggggataaatgctaacagagaaaaaggggagagcagacaaaacgttttcaagtacgaattcagtggttaaggaaggcctcattggaaaggtgacagttgagtagagacctgaaggaggtaatcttattccacacttactttttcctttaacagtacgtattaaatgcttcaccacagcagggcttacagatctacctctttctttcttttttttattatactttaagttctggggtacatgtgcagaatgtgcaggtttgttacacaggtatacacgtgccacggtggtttgctgcatccatcatcccatcatctacattaggtatttctcctaatgctatccctcctcctgccccacaccccttgacgggccctggtgtgtgatattcccctccctgtgtccatgtgttctcattgttcaactcccacttatgagtaaaaacatgcagtgtttggttttctgttcttgtgttagttcactgagaatgatactttccagcttcatccatgtccctgcaaagaacatgaactcatcctttttatggctgcattgtattccatggtgtatatgtgccacattttctttatcctgtccatcattgtatctaactatttattttgagacggagtctctctctgtcacccaggatggtgtgcagtggcatgatctcagctcactgcaacctctgtctcctgggttcaagccatttttctgcctcagcctcccaagtagctgggattacaggtgcccgccaccacacctggctaatttttgtattcttagtagagattgggtttccctatgttgaccaggctggtctcaaactcctgacctcaagtgatccgcctgcctaattctcccaaagtgctgggattacaggcatgagccaccaacctggcctaccttattctttttaaagactccattgtaccccattgtttgcatgtatcataatattgctgggcttttgttattgccacaggtggatgttttagattaatcctgttatagtctgttagatgatcatttgaatggttataaaagagacttggggcttgtggtataaagcctgattaaatagaaagaaacctgaactaagcatgggaagctatgaatgcaagtccaagctgtgctatgcttgctatatcattatttgtggacttccttttttattttcctgttctggcctcatgacagggtttccattttcctggcatgtcttgggctgttcaccagccccagggtcatgtctaggtgattcttcagttggagacctaactgacatccttcccacagcaacatcagtgccaggctacctgtaaccctgcagagtcaaattaaaacttacaagctttccacattccccacgaaggaagtactagcaaacttttagggagcagtacctctgggctctgtgcacactctccgtgcttaggaggaaagcacatgagcttccttaaaacaaaaacaaaaacaaaaagccatacattctagtgatgtttatttttgcagatagagatgtttagcactgggtcatgacagagtggatttcacctttaatggaagattaatttgcccatttgattaatatctgcggcaatccctggaatatgccagcactctgcctggcactataggaggaacaaataccagtgtaatatggttcctgtcctctggtgttaaaggcaatacagcaggaatgaaaagaaaggggagaacactattatccggggtccctcaaagatccctcagagagctttttgagctaatatgtaaacaggtagggaagtgttcaagggatggaggtgctgcaaggggaccttggtaagggataagtgtatgtgagtgtgtgtgttaggaatatgtgtgaatggaaggtgaacaataattgcactacaagcaaaggaacagataaaggaaaatataggtgttgtacaggaaacatgaagtagctctgtttagtttaaagaaagaatgtggggagtaggtgtagatgatgggaaatgttggttagagtaagactggcagagggtcctgagttctactttgctattagacatgagatagataaatgagttttgaaagattaaaaaatcaccatcagcttcttcctctcttgtttttgctttatttggggtgtgggagcattgtccatgttggttttataatttctacttcttattccagtaatttttaaaaatcagcttagtatttattaaagtaatatatgcctatagtttaaaaaggtgaatagtattataaggcctataattaaaaagagtactcccttcccccactttgcctaccactcctccttcctgcttctcaggggaaactattttttttttttgcttttattatgaaagatgtttattttccagagtgtgtaacctcatatataggtaagacttttgctgcaatcaattgttcttggtttggttaatctatagtcttgtccagcgcaggaaaactagcactgtccagcaactgtaaccagggagattgaatttcaccatgggagaggaaaccacttttaactatgctatttacatccctatacttaagtactgtgtatatactgatatttattaacttattcttagagattatctgccttactactatgcaaaataaggaaaatttagcactctgatactatcacacgctcccaagttttctttcctgatctttccagtgggttaaatggcaacttggggttaaattgatattccagtttaccttactatgaccatgtaatattgtttactaccaagacaagtagtaaaagagtatgcgttcgatgttgttcaacatcttatttttcctggtgttgtcttttattttgctcacctcttttgtgtatctatcattaaccattcatgaactacccaaaagaactatagaacttatattgaaaccatttttttttttttttttacacaattagcccactggttagtctactggatctctttttccctggaggagcctcccgtccagcccctctggtctaggggttttccaggccagctgcccacctgttgtcctggggcttctttttaacaccattttgtgaaatccctatgcctctttcctgtgttggagcccccatttcctggatcccatgatttcctctttgttggtttacatcctcatttttgtagagcacattctctagtagcttcctgagaaaaggtacatgggaggtgaatttgttgagacctcatgtgtctgaaaatgtcttaattctactctcatactgagttaaacttgtaattgaattttaagtaaaatgtaattttccctcataatgtttaggctgtacttcattgtcttctagcttccagtattgcagtctcaggccactactattccttttaccaggtatgatcttttacatgtgacctgtgttactcctctggaaggttttggaatcttctttttaatcctggtattctgaagtcttagagtaaagaaccctaatgagctaatgagaatcttttcttacccatcattttgggcactttatggtctctgaaaatctggaaaatagcattgttccattttgacaattcttcttctattattctttagtacttgtctctgaatcatttttttcttgttttctccttctggcatgcttatggtaaaatatggaacctcatggattaatccactatatttctcacctccacctcaccccacgtccgtctgatatggttggctgtgttcccatccaaaactcatcttaaattgtagctcccataattcccattgttgtgggagggacccagtgggagacacttgaatcatggggggtggtttcctccatactgttctcatgggaatggataagtctcatgagatctgacggttttataaggggaaaccccgtttgcttgcttctcattctgtctttgcctgccaccctgtaagatgtgactttgttctttccttgccttctgccatgattgtgaggtctccccagccatgtgaaactgtgagtccattaaacttctttttttaagtaaattactcaatcttgggtgtgtctttatcagcagtgtgaaaacgtttggactatctactttctagaaagtttgacttctatacctctgaatcattttatattcttctataagtttaatttccaatacctccttcttattttctaattgttcctgttctatagaatgctttttattttatagatataacagtatctctcatctttctgaagttactataggtttttaaaggctttcatttgcttcctgaaatatctatatcttctctgagctcctttagcccctttctctgttttgatctctatattttattctatattttatgtcagtggatatcctcaaatatctgatggcccttcattactcatttatatttaagaaatatatatgtttatttcatatatatacattatatatgaaacaaacgattcatttatatttaaaaacagtgggtctagtttccaagggaaaccctgagtgtagacagggtgtgctttttccttgactggcatccctccgaggtaacagagtggggaatctaaccatttcaacagggactctgccaatcagtcattttttggactgagtttctgcagataagaatctccaaacccctgcctaaggagccagtccctagctgtaggttccctgggagctatgtcagggaatagtccaggagggtttcacctgttctctctgtggagtttcatcctctctcctgggcccaatccctgagtctagagtatctctgattcaatgtagcctaagactatccctgatacctcacatagggttggggaattggtagagtcagtgtgagctagggagggcagggcctaactactccatatactctgttggtctgaagctcctggcaatcaattctcctttttccagtctcatgactcctaagcctccacagcatcccgtgcatgaatctgaaggctttgctcagtgcacctcagctattcctcctccatcactctgctgtcttccacaaattgcctgatatctcacattcagtagcctctcctctgttctctcatttgctttgtgtccctgctttgtggtttttaaaattctttactaatttcagtgagatttattttttgttctttactaattttaatgagatttattttttattctttactaattttagtgagatttctggaacaggaagatatgaaagcatgtgttcaatctaataaaaccagaagtttctagtgttatacattttactttgtagttatatgtacttatgtattttgttttggtctagtttgtttgtccagagaactttatgagttacttggacaaactagtaaccacctcacaactactgttaaggagggtattgacaaaatcattttacttctttgttattttttagggattatcaggcaaggtcaagttgactttccataaatgttatctttatccagataacagcattttgttatcttggctccagaagtttggacaaataatcaatttgaggtagacgcatatcaatttatcaataagaaggaaggaagactataaggaggagggaagaaagaaagcagaaagggagggagggggaaggagaaaaaggaaacagacataaaagattttaaaacagaacagcaggaagactggcccaactaaataactatactaagaaaagctatgtatgttcactaaataagaagataaatttcggaaaatcatctggctttaagataattccaaacaatgatcactgacttggaaggcagttaagcaatttatgtcactgaatgttaatggtcaaactacgttttatcagtcaacaaaatgtacccaaaatgcatatgaaaagcagtatagcctgcaacagaacctatcacataatgatttttcacaattacatgtccagaccaacttctaactatatactgactcttaccactctgaaatatatctattttttggctcaagaatatatgtgtatatgtatgtaccaaggtatatatgtgtgtattcctcccctcatctcccaaagaaatttatgttagcttgcaggtaatccttttacttgaatatatgtttattttcctgcttatatttcttataaatttgtctagctcaaattatgtagtcctctatcctctgtcatactcaattatggaccaataacttttttaaaaaagttaactatgttgtcaacaacatcacttccaatgtagccatcatcatatctttgagcttaacaaaaagcttgactttacagtcagattgaccttattttaaatcccctgtcttccatttactaaataaactccccgataggaaaatggacatattctctattttgcaggattttatgagaattaaatcatacaatgcatataaagcacctggcatactgtaggtacccaattaaaaaaagctattcaagtcagaatatgagatgatattgaaaccttaagctgtctaaaagtacatcttttccaactgactaatttttcatttccattttttaggcatcgcatcactggtaagctggtcacctggaagcaacgcatcagttagccactgaaaaggggtgtgcagagctcttacagaaaattgagaaaatcattatattgatatattgattatattaagaaaatcattatattgctatctacttttatataagtaggggaaagggaggactggacaaaaacaataaaggaaaatatttggcccagcatcagtttcttgacccctttagaattctatttaactacaaaattaggaggttatatgaagtccctccaagtgttcaggacaaagagttctgtggttagatgattttgaaacacacctcgatcgtctcacacctccccctccccattcttgaagctttgaaacacatatgagtttattcaaggtatctgtcccattttgttttaccttccgttatacaaacttacttgactacagactctcccccttttttcttttctttcaggtaatatttattgacatactttggaaaagactggatgagttgctctgcgacttcccactctaacatatgtttctctgagtttctacaacttcagctaaatgttttaaggaagaaaagaacaacagaatatgtgctaattttgattgattgatgctccctcctatagcagcatacaaattttagagtgggagaaaaatctattacgatttcaatgaaatgagctattttatcttgtccctatgtggtaccatcaacattttagacagatgaacaccaaaccattgactgaattgctgcatagtggatttgccttgattataaagacagttgaatgaccagggtacctctggcaattttggcaatcaataagtaacatgaatcaactatgtagtggtcagactggctacccagtgctcaatcaaaacagaaaataacagagataagttaatccttaggttgcaggactataccatgataccagcataaaactcaaatggacattcatgatgaaaaaatgttaatgctatcattatacaataaactgctaaaagtatttttattagtaaaatactttcatttttctatcaatctaacaacacttatttttatctgaaaggagggtactatgctaaacgtcactgggactaaaaggatgtagagtaggaaaagggccaaagatcctaccagaaaatgatctaggagccatatgttagttctgtcagtaattttctatgtagctgtcaataatcctttgttttctctttgtaaaaataactatcctctgctgggtgcggtggctcccacctgtaatcccagcactttgggaggctgagacgggtggatcacgaggtcaggagtctgaggccagcctgaccaacatcgtgaaaccccatctctactaacactacaaaaaaattagctgggtgtggtggcacgcgcctgtagtcccagctactcaggatgctgaggcaggagaattgcttgaatctgggaggcagaggttgcagtgagccgagattgcaccatcgcactccagcctgggtgacaaagcgagactctgtctcaaaaaacaaacaacgacaacaacaacaaaaaaccaaaaccaaaaaataacaacaagaaaaaactatcctcaaggggcttattgtttagttaattatatttacaagtttgggatttttgctccatgccttcttttgttacaaaattatccttaatttacctacataacagagacaaaagtgagtgaatattttgatgttctttaattaattacatgccataatacccctccttcatcttaactgcagaaattctgtgagaacctattgcaatgttttccctttttctcttgatatgtctctttcccctcaaggctgctaaggttttaaagtgttctgtttctatttttttcattaaaaattctatcagaaaccccacttcctctcaagaggaaatttatccaaaaccacctctgtggtatccaagtcataagtgtgttggtagtaggatggccaactgtcctggtttgcccagtaataaggagtttcctactatgtggaactttctgtgttaaaaagtgggatagctgccgggctcagtggctcacgcctgtaatcctagcactttgggaggctgagggatcacgaggtcaggagatcgacaccatcccggctaacacggtaaaaccctgtctctactaaaaatacaaaaaattagctgggcatggtggcgggcacctgtagttccagctactcgggaggctgaggcaggagaatggcgtgaacccgggaagcggagcttgcagtgggcagagatcgcaccactgcactccagcccgggcgacagagcgagactccatctcaaaaaaaaaaaaaaaaaaaaaaaaaaaaaaaaaaaaatagggatagctctctacaaaccaagggagtaggtcgccttgggtgttagcttgagagaaggattggatatggcacggaaacctgcaccagagagctgcaattttgatcctattagaaacactcttctttcactgctaagcagctatgtacaacaatcaaacaccagatggatatatgaatttaatgacctttaagtttcctttacactggtggttctcaattctggtttcttactaaaatcatctggttagctttttaaaaagtgctccctgatttaactgatttgaaggtgagtctttgccatgggcatacatgtttgaagttccccagccaattctcatgtaagtcagagttaagaaacactactttatacacattctgagattcaaactataggcctagcaagagctgtttaaagcaaggagaaatctactttgtgatctctgacttgttaattattacatgcaagtttctacttcaactttaaaacaaatgagaacctgcaaactgactttatgtattcatctacattcatttattcacctagggttcatgatctataagcatctcccttgtcatgtttgtattctgaacatcaatcaccaccatctattgatatatatatttttttcttacaagaaactgtattaggcaccgtggggtataatgatttaaattgcaaggtctctgtcctcacggactctataagtagaatatatgaaaggtgactacatgatcaaggcaaatgaccccaccgccaaccaaggaggacgtggtcatggcctgggatggttaggaaatcttcatagagcaggtatgatttttaaggggctttgaggactgggtggaattttaattagagagccataaataaaaactacaaaaagggagaaaagcagtttgagaatgagtagggaggaatcagtttaccaaagttaagtatgtatacaaataatacagttcaccttttgagccatgcaaactgtatctaaggaggcacagaaccttgtatgagaccaactgctgagcaaggaaatgtaattagcgcaatcacttttttggtgctaattacttaagacattgaaaaagaggattagactgaccaatgaaacaattggttctggataaacatacaaagcttggtctgtaatgtggagaacaagccactgaatagcaatagccaagccccttccctctggtgctgggcccactcaagagacctgatcacacagacagtgaggcaggtgctgcatagatcactgcaagaaccccgagggacccactctatctgatccagtgagatgatttagggttgaagaaataaatttagaacacaagtcatgtaaaaagtacatgttactttatatgtgatgttatgtgattatcagtcattgattttcaattacttttataatgcaagagcttttcttctggatttcagaatttaagaatttctgcgccatttgtctttgcctacgaaaatagttaattctcatatttattccaatagctggtcttcatgtaagatattaactaaatgcccattaatagtctgggtatgcaactcaggaagtcagttggcaaaattaacatttagaagtaggcaccactggttatttcacacattattaacttatattacaattcaaataagcttacagctggcaaaaaaatctcttctgtaaagcgatctcaaacataataggcttaatcagagataaattaaattaggcagccatgcatactacagcatattaattctgagtagttattactacattttctgttatcactggtgtgaacaacattatgtgcaaacaaattcttcgagagggtagcaaataaagtttatgtttgggatgccatgtgcctagcattttcccatgttttcttaaaatgttaaataatcttttctgctaataatggcactaggttaagtccccataaacgagtcaacctcactcccaggaaattaaacaaatgaacatcagacgaaactgctaagtgtggtttggatttttccaaagggaacttctcaactttctctggcaattaaaaaaaaatttgttaatgagtcatagctagagcaaaattgtccaaaatgtaaggtagtgcatagtcgttacgttaaaaatcggtgcctctcattctctgttttggatgaactatgttgccttagaatactcaaagaagaaaattattcaggtagaatgctattttctaaataagatcctgccattatctctctctttctttaaacggtagtaatctaagccagcaaactagcactcagatcccacacgctagcaaatgatgcttttgtgaaagaaaatgaaaagatgcatctaacctttatacacacacacactcatgttgccttttttgatgcacttttgtcagattatctgattctttgttaatgaaccaggccctttaatttctgtatccaggagtaattcaagttactaggcatgacagccactaccgcccccaagtctgagaaacatgtttcacattctttgcgctttgcacatttaaaactcaatgtaaggtgacaagaacattaagctgcccagtgagtaaaatgtgaaactaatcactatctgttctacagatagtgggtacaataattggcaaattaaagtgcctgggaagagctgggccacctgcatcaaaaagcatcaccttggaatggctaatgaagataaatgtatgcagctagctttactgacaactacttcaaacaccagcagactgaaaaagcaacactacagtacttatttcatttactgtaaagtacgcaccatgtgaaatttttgttatttaaaggaaaaaatacccaacccctctcaatatgttgtacacatgccggctgaatcgaggctagtacttactcctaaaaagccaatgcttttcttttaaactggcaaactgggatcaatttgcttattaaaacgttgaatttgtattttcatgacaactagattcaaataaattagaagactacaaaaaagaaaataatccaatttcaataaaattgctactcttattcatccattcatttatttgacagttattgaatacctactatgtgcaggtactgtgcttgacatttggcagagagagacgaatgacatctccttaaggaggttgtggactatttgcaggcaagaggcatgcttacaggcacacacacaggcaactagaaccatgtgctattgtagaaacatttcagaaaggtgtccctttcccttagagtctttcaagagaaggctcactcttaagctgaattctaagatgatttctgaagagtttttgagggtgagtaagcttgagaatggtcttccaagctgaaaaaagtagcatgttcaaaatcaacaagaaggtcaggatctgcttgaggaaaaaaagtgccttcaaaatatatgaaggaaataaatacagaaataaatataggaggcaagaggtcaacagatgatgaagatgaaagctagacaagggtaagaatatgaagggccccagaagatatgttgaggagcttgcatttagttctgcagggcagtacttttcagaatatgtgacagagaaccctggggacctggggaaggagggaggcagcctggaagggagtgaggagtgagaagaggctgagcagtcaggactcaggccctgtacctctactcataccacaagagctttgccaatatctgtttcaccttttgggccttcttattattagtgtttttgacaattttttatactggaataatcttaaatttgcagaaaaaattgcaaagataatagaaagagttcctacatactcctcccccactttcccccactgttaacatctcacattaccatggcctggtacgtttgtgacaactaagaagccaacattggtgcatcactactaactcaactccagacttcatttggattttaccagtctttctattaatgtcctttctctgttccaggatccagtccagtctaggatatcacattgcattgtgtcatcatgtctcttcagtcttttttggtctgtgacagtttctcagttttttcttgcttcccatgacattgacggtcttgatgtgtattagccaagtatttttaaagcatgccctcacttttggctgattagggttattgggaagaatatcaccgaggtaaggtaaacttctcatcacatcacatcagggggcaggcaaatgacatcagcctgatttatcatggtgatgttaaccttgatcacctggttaagataatgtttaccaggctttttcactgtgaagttactatttcccctctttggaagccagtcataaatccagcccacatttaagggggagggtaagcttcactatctgaaggtggatatatctacctgtactatttggaattcttttagaagaaagactctatttatttatttgttcgattgtttatttatattaggatgaactcagacatttattttatactttcggttataatcaaataccatgttatttattttgtggctcaaattgttccagctttggtctctgggagctctattaaattggttcctgtatgcctttcacatgcctacatctttttgttttttgagcacttatttttttagggcataccatgtgctccaagatcttgtatttttactgtcccagccacaaactcagtcatttctctgaggatccctagttcctattattggaggataatatttagaaaccacggtctgggcactgcatgtgcttgatgctactgaggtatcactgctcccaggccccctcagcagaaagagccaagaagtataaatacatattcaaacccagttatatgcacatgtctataattgtttctgtgtctgtccgtatgcatatttatcaaattaaatagtagttaagctaacatgaagttagctgatatgtccaactctaatccagcattacagggtttgttgcagccccctctcctagcttatggaaattgtcctgacaatgagaaacctggcttgcaccacctaccatccattcatttatttgttcagcctcagtatttgggtcttcttttgaagagatttctgttactttaaaataataatatataaaagggctttatttttattcattaccatcactccaattgctctgttttcatcaaatcatttcatgtttctcctaggcacccaggaagactataattctcatgatcccttgtatttaggtccagttccagttaaaggaatgtgggtagaagtgatactgaccacttgtagccctaggctctataatctgttgtgggattctctacatatattgtctatttttttgataccaggtataagacacagtggaaaattccaataataaaagagaaaaactatatgacgattcaatggaaacagaaaaaaatcttgaaaaaagtaaaaatccactaaggatttaaaaacaaacactcatcaattagaaatgaaagagaacttccctaatacaataaaatgcatctctgaaaattctacagtgaaaattatacttgattgttaatataataaaaaattcctcataaaatcaggatcaagacaaagatgtccactctcaccacttgtactcagcatttactcctcaaatgggaagtctgagtcattataataaagaaaaagaacaactacaaaaaatagaaaggaacaaaactttctgaatggtatattttgtataaaaaatcccattaaacctaccaaacaactatcagaactagtaagtagatttacaaaaattatagagtacaactttatttttttattggagatataatttatataatgtatagttcactcttttaaggtgtacagttcaatgctttctagtacattcacaaagttgtgtgaccattcttcttatctaattccggaaactttcatcacacaaaatgaagtcttgtacccattaacagtcactccccattccccccagcccagtcccttataaccactactcaactttctgtccctgtgaagttgcccattctggacttttcatataaatggaatcagacaatatgtagtctgtgtgtctggcttaatgtgctcaaggtttatccattttgtagcatgtaaatgtattccattctgattttaggttgaataatattctgctgcatgcgtatatcacattttgttcatccattcatcagctgatggctatttgggttgtctattattttggttattaggaataaaattgctatgaacactcacatacaatttttgtgtgaatgtatgttttcagttctcttaggtctatacctaggagcgagataactctatgattaactttttaagaaaatgtcaaggtgttttatcaaagtggttacagcactttacaatcccatcaaaatgcatgaaggctccaaatttaccacatctctgtcaacactgttattgtctgtcaattttagacaattactacattactatatactatattactatatttactgtctaaaaatgatagactatagtaattcgacagacagttaaaatagtaacccaagtgggtatgaagtggtaccacgttgtggttttgatttacatgtcttaagggctaataatgttgggcatttcttcatgtgcttattggccatttatagtatcttctttggacaaatgttattttaaaattttaaaattttaaattttaaaatttctttatatatctggtatactctttatcaaatataaaatttgcaaatattttcttccatctttgagttctcttttcactttcttgctagtgtcctttgaagcacaaaagtttaaaattttgataaagtctgatttatctatatttttcttttgctgtacatgcttttggtgtttcactcaagaaactattgcctaatccaaggtcataaagatttatacctatgtttccttataagaatttcatagttttagcttttacatttaaatcttggatcatttttaatttttgtatatggtgtgacacaagcatccaaattcataattttgtattattaatacatgtggaaatccagttgtcccagaaccatttgttgaaaagactattctttcttccattgaattgctctggaacccttttgaaaatcaactggccacagatataaggtttattcatggattctctattccattccatttatctatctgtctatccttctgccagtaccaaagactcttgattactctagctttgtaataagttttgaaattgggagctgtgagtcctctaacattgttctttttcaagattgttttggctattttgggtctttatatttccatatgaagttcaggatcataaattcctttttttttctttttttgagacagagtttcactctgtcgccagctggagtgcagtggtgtgatctcggctcactgcaacctccgcctcctgggttcaagcaattctcctgcctcagtctcctaaatagctgggactacaggcgcatgccaccacacccagctaattttttatatttttagtagagatggggtttcaccatgctggccagcatggtctcgacctcttgacctcgtgatctgcccgcctcggcctcccaaagtgctgggattacaggtgtgggtcaccatggctgccctataaatttcttttaaaaagccagtcaaagcaggcgcagtggctcacatctgtaatcctagctcttagggaggcagaatcaggaggatagcttgagcccaggagttcaagatctgcctgggcaatatagtgagaccccattctccacaaaaaagaaaaaaaaaaaaaaacaaagccagataagattttcatagggatggcactgaatctgtagatatatttggggagtactgacattttgctaacttaagctttctatgattatggtgtgtttcaccattatttaggtcatgattaatctctttcaatgatgctttgcagttttcagcgtgcatgtcttacactgcttttgttaagtttattcctaagcattttttattgatgctattatgaataaaattgttttcttaatttcattttaaattgctccttgctagtgtatacaaatataactggtctttgtatattgattttatacgttgcaacctcacagaactcatttattagctcatagtcaatagtacattattgactagaagtgggtagagtagaaatgtttgtcttgttcctaatcttaggtggaaaactttcagtctttcactaataactgtaatgttagttgtgggttttccatagatgttctttagctggttaaaaagtttccttatattcctagtttgttgagcatatttatcatgaaacggattttgtcaaatattatttctaagtttactaagatgattgtatgtttttcttttattctattaatatggagtttataccgattaattttcaaatgtttaagtaaccttttattagtgggataaattatatttggttctggtgtatagtcttttttatatgttgctgtatacaatttgctagtatcttgctgagaatttttctacctgtattaataaagaatagtggtctacagtttcctttcctcttatgtatttgtcaggttttgctatcagggtaatattacaattgtagtttcatctattaacaggaaactttgaaaaataaaaattttaaattctatctgaaatatttaaaaataaaattctgagtaataaatataatagtaggtatttaagatgtttatataaaatattactgagaggttttaaagaagatctatataaatgcagagatagtgtatgttcatatattggaaggcttgatattggtgagaagtcaattcttcccaaactgatccctagaataaatatattcccaatcataatcccatttggctaatttcttagaaaccaggaacataattctaagataaatctaaaattttacaggaactaggatatacaaaccaattttgtaaaaaacaaaaaaagaacaaagatggaaggcttataccatctgacttgaagacttactataaagctacagaaatcagtgtagtctggtacactgatatataaagagctacaaaaccaatggaacagagcagagagctcagaaatagatgcatatttatgtggtcatttgatctttaagaataacattaagaaattccagtgggggaaaggaacgtcttcaagtagtgctggaagaattaaatatccatacagaaaataaaaaactctacactgacctcacacaacaaataaaaattaatttaatatggataataaatctaaacataaaaagctacaactgtactataaagttttcaaactatatgtgtgtgtgtatatatatatgtgtatatatatatgtgtgtgtatgtgtgtgtgtgtatatatatacatatatatatacatatatatacacatatatatacatatatatatacacatatatatacatatatatacacatatatatatgtatatatatacgtatatatatatgtatatatatacgtatatatatacatatatatacgtatatatatgtgtatatatatatatatataacagagataaccttgttttagacaggatacagaaaataattaaccatgaaagaaaaagaaagccctgataaattagacctcaaaatttaaacttctgctcatcaaaagacatcactaagagaataaattagcaaggctcagattggaaggaaatacttgcaaaatatacctaataaaatacttgtttatatatttacatacatatatatttttatatatggctcatacatataaagaacttctatacttcaataagaaaaacacaaataatccaatttaaaaatgggaaaataactgcaatgaacactttacagagaaaattatataaatgaccggtgagcatatgaaaatgatttcgacatattagtcatcaaggaaaaggcatattagattactattaaacatcaccacaaacccaccaaaatggctaaacctaaaaagtcagactgcaccaaatatgggtgaggatgtagaacactaaaactctcacattttgttggtgggaatataaacaattactttggaaaagatctggcaatttcttcaaaaattaagagtacacctatctatgaccagaatcctacttttagatgttgacctactataaatgaagacctatgccctcaaaaacatctgcacaagaatgtttatagaagctcattcatactagtcgaaatgtggaagaatggataaacaaattggtaaaatggaatacaactcagcaatagagaactaccaatgaactcaagaacagactgatctcaaaaacattatgctatatgaaaggagcctgacacgaaagagtatatagagtatggttccatttatataaagccctgaaagaagtgatttactcttggtggggtagggatactgggaggggcctgcaggaactttctggggtaatatagattcgggtgcaacaggcagatacatttgtcagaactcacggaaattcactcataaaagttgtgtgtcttatcatatgtaaattttacctcaaaagaaaaaacaaagaatcgtaaaatttaaattctggtaataatgcacacgttcaagtatttaggaggatatgtactaatgtctataacttgctttgaaatgtgtccaagccagaagtggtggctcacacctgtaatcccagcgctttgggaggtcaaggtgggaggatcacagggtcaggagatcgagaccattctggctaacatggtgaaagcccatctctattaaaaatacaaaaaattagcctggcgtggtggcaggcgcctgtagtcccagctactcaggaagctgaggcaggagaatggtgtaagcccaggaggcggaggttgcagtgagcagagattgtgccactgtgctccagcctgggtgacagagcgagactccgtctcaaaaaaaaaaaaaaaaaaaagaaagaaagaaatgtgtccaaaaataagattcatgaatgatgaatggacagagggatagaatgatgcacagtggtgggtatatgagtatttactgtaaacttctttaaactatttggaatagttaaacatttgaatataaaatgtttaaataaaaaaattctttaaaactaagactttcacaaaaaaaaagaaaagaaaaattaaaagaaaaaaagagaaagcaatcccagctttgtaagttactagccatgcttcataaatagtctaagcataatttcctcatttataaaatataaaaaataatatctactatacaggactgttaaaggactatacttgccaatatatgtaaaaaacagttcctggtataaataagcactgaataaatgttttagctactatttttagtaagcatagaacgtctgtagccataaacccacaaaaataaaacttcctgagaaagaagacaatgtttgcacactttgttaaaacaattgttatgtttgttgcatagaaaaaaatcagattcaccgtgatttttttctacatgtgaataccatttattaggctccctaagtgaatgagctagtagaaaggaaatattatatttaaaaaaccccataaggcatatttttagaaacggtatttccttgactttcattccaggaaaattctaacacacggcacggtgcatgtggagcccagaaaagaaagcctgccagatgccacagcaataaatagagtagggccttggagacgaagcataaaaggaaaatgtggagcatcatatctgcagcacccttctccatctggtatttagcccactgaggttatgggatttttggaaattcacctttgtaggctacctttaattatttttcttgtttatttgtccagtaaacatttaaattgtagcctaatatgagccaagttctatgaaggtcttccaggacctttggaaaatgaagctgggtacggaaatttcaggaaaaaaatgttctaagtacagagtaatgaaaggttaatactatttacgtcttgccatctctttttacaatattaatttcacaaatacaattttagcatttccaaccaataaattaagcaacagcatattttctcaaatggcaggaattctcagacaggaataaaagggagtagaatttcttaagtgggttatgtctcactttgctaagaagggcagaaatgaaaataggttttcataaattatattttctatgggtcttgtattatcatttttataaacagatattttccaagcaagtggaatttcttcacatcgtctctcaatttagtaatctttctgatgagcaaactgagctgtagaatgttgaacattgtttcatcctactatgactgtcatcctttggcttgttgaatatatattcttgtgataattctaagaaactatgactaatggatttttatccagaattttaaaacaacaaaaagttattttaaattaaatgaaaaatacattctattcccttaacttttcttttttggggggattacacattctctgctaaaatttaggatggaatttctaacagtgatggcattgttcggtaactaacagtcttttgtgtgtgtgaaaaattctaaatgagtggaaatgatctcagaaattttatcttgaaaatgtttgcctatagtatttattcaagtgttgtccacattttaggaaagaacttcaaaaatgtccttttcataaaaatatgcagttctcttgtgtctatttaaaagggaagtccctctcctaactccagcatacgcactcatctctgggctatcaatagaagctaaagaaaaaattaaagaaacactggctgcatgccaaattttgggttaatagggaagagaaagctggttggcaatctcccttcctagtccttatcttttcctccccttatctctcctgtgctaggggtgctgggatgtctgtactctgtaacctctttctctgaatggagacagaagcaggaagtcaggtgccctgcactttaatgtcttattattcttctccttgagtaaatcctaactgttaacgggaaataaaatgctatatgtaaatgaacatcgtcacttggaaatcatcattctgggctacagcaccaatacacctgtaatcttaaaacatccttttaatagtaatgaatttgtcaaaaaagtatattaggacatctatattcaaattaagtttaccactggcttaggtttttaaaattaatacaagttgcttaagatggtgaaaggccaaactgttgtgattccttccactatgtatcatcctggagcaaaactcataggggaaaattagatattcgtgaagcaagatagcgagggtttttgttgttgttgaggttcccatcaggaacaagcttatattattggatttacttgagagtgtacaactgcccttgaaatgaaacatcacctacttccaacaagtgtgctctctccctagttcaccctaattaaggaggcttccctatattaattttgtctcttatacaagcatccttgagactctttgtgcttaattatttatgtctatgtctcaagtattaagagcacacttgaaatttaagatttttctaagtttctaacacttactagctttgttttttgcttagacctgttaatctaattttgtcttctcaacacttttgggaataatgcattgcttatccttaaattttgctttgcagtttctgtatgaaagattccaaattcaggtttcaatgtatttgaaacgaagttgctgattcctctcactggaattaagacctacacttacttttctcactcttctttattctatttcaaagtttgatgaatattttctcaaactgtatttgaaaaatttagaatccaataccatgaccaatcttcctcctgctaagccattggtggtctaactattactttttaagaaaaattaatatggaccctgatgtaaaaagaaaagaaaaacaaatatagagtgatttcagcaggtctattactagacatgttttctcatgtttctcggtagcttgaccctcttgtctggtattcctgagagaatgggcctacccacagagaaagggagaaggaggtaaagaagttgcaggtttgctggtgatttgagatgaatcctcatgcaacaacttgaaggcagacagattggaagagcagtgagttgattttctaaagtaaaatccaccagaaagagtttacacggtgttggaattctaccacatttacaaattaatgtgccagatgccatcagcagatctatcattatgatggctattgataaatatcaaaatttgaccattaagaaaatagtactactaatctcatactggggatatcagtaccactacagaaaaattctacttaaaaacatatgtgagctaaaagtgaaaagcatttccctgctgattccacatgtccacaacagcctaagcagtgtggagatggccagcggagcagcaatagggaacgtgtgccaacatttctgataggaactctattttctgaggatttaggctcaattatgaaagtctgctgaaaatgaaacttggcataaatactgtagcttagtagaattccatcaaatacaacaaaaatgaagattaaggagagggaaatcctataaactcaactttcagaaaagaccagagcattgctaaggaaaatcaaaggaagttctcaatacttattaattaatcttttcataaacgaaatcatatttgagaagtggtgagatcatttacagcctaataatttccagatatggaagggaataaataatttaaaggggtaatgattgaacctaggaagggctgtgtcagttctagaaatagtggcttttactcttgaatttttaaaagttccattttcttagtggtggcattggcccaggccacaatcatatacaaaaacataactgaccaaaaaaaaaaaaaaaaaaaaagaaaggctttaatctcttagaatagcaaaacagaatttgagaagagcctaaactctaagatatacagctcttaaaattttaccataaaggacacttttttagagccctaaataaggtgggaaccttaaacacagaccttaattttaataactcttgggaatggatggtctcagttaactctaatcttatatttgtttatagacctcagttttcaattacaggaggtctaagcattgaagtgttagagtgtttcaatagatgaaagatgattaatagaaactttaatatctctccaagtcaaatgaccatgtaacctctacaaatattactgtaatcgctacaaatatttgttactttgtttattcattcagtaattcaaaaaaagatttattgagcacatgctaggtataacgctccataaaacaagcctaaaatctaccaaaaatacaaatatgtattcacttgagaatttctgatagctctcatttagtgaaggtaccagacactaaacaacatttaacttgagatacatctggaacctttaacaacatactaaactttaaaaaaaagtgcatatttttctaatgtggttctgaaacaaagagacaaaaagaaattttttatttgtctaatggaagagaaaaggcctcaaaaactagctgacctcccagataatgaagtgtaaaagaatgtgcaaatgtacttcaaaaagtaactctcctggacaccaactgaacccttagaagctaaaggcgggaaataaccccttcttccttcttttactctctctagtttgtctttgttctgtttcccttgtcatttcccactcttcagacacaattatagttgattgagatataacgagtaaagctacattagaaactactcatggaaaaatcaatagaaaaggatagaggcacattcaacagaaacaacaaaacagaagcactgttaggaagaaggaagtgagaggtttttgtagcagaatgtacggaacagatatttcccaagtgcctcttctatggtaggtgggacatagcagcatcatacagtcacctcatatatccactgtaaaagaggagatgggtgggtgcaggcaggtaattgtccagaaaaagcaacagactggttctattatgagaaagtgaacatacttcatttgtggaaaactatacaacaattaaccactatgaatgaaacagatctccatatattaagagagagattctaaaaaaataaaaaaaaaattgagaaaaaacaagttccaaaggtatatattcagtatgatcccatctatgtaaacttaaaaaatattgcacatatatatgtgtgtatacatatatatacacatacatatatatatatagtatacacacatatatatagagagattaattataactatatatgtgataaatggtataatatacaacaaccttattatcatgatagtacctctgggaaaggagaagtagatatctgaagaacattttaaaatttttaaatatgggggtgaatacatacgctttgctcttttctgtaggtttaagctacttgacaataaaaattaacatttttttgaaatttgttgtctaaaaaaagaaagctgtagaaattgagacaattagaaggagctgttctagtaagtctaactttcttatttctgagctgagctgagaatatacaaggctgattattttccatcttcagaaagagaaacaatggagacttactgtagaagaaaagactatccttgcaatgagaagtcagtggcacttttggcaaatgaatggtcattttcaggtggaagtgaattatctgaatgtagttatattgagtcctccagctttaaaagaatgtttcaactcatacactatttatttgagttactcttttttttctttatggggtgtgaatatgaggtttaagggacacagttaatagatgccaagttttcattgtttctacaaatgtttatagagtctggattttggaataacaatttgcacacttacaagtgttgattagctgggcaacattgcaattaatattacttttttaagctcctcgcaaagacttccttttctttcaaaattgccaataaacattttcaaacataatccccaaggagctcattcactgggtgctgggggactccagcaggaaggaaacctactaacattttattaattttggatcatgtgtaattcttaggattaatggcaaggagccagagaggttttttttttttttttttttttttttcattttttaaatcacagtggaaaataagcctgaaacatttcactagtaaggcaagagtcacttaagatatattattaaatatgaggggtagaaataaatcacagacacaagtggtattatacagtgggcatttttctgaaaaaacagactccgtgcatgaggattagatatacgcccacaataagagggcatattgatctataattttcagtattacatccttgtattttttattatatgctatttttcaactagtagaggaacgtgttctcataaagctaatatttattcttccatgtttatacagctagtagtgcatttcaggaaatgagaaattctgagaagccaaatataacttgatgtcgtatgcaaaaaagaagacaagacagaaaaatccccatattttaaaaacctgactcaggaactcactcataaagctttaaataattaaataacacaacataatgaaagtcttttgatattattttttctattcccataaatgtagccttttcatagatgatacatcttatcatgtagtattcctcattttactagaaatcaaagaaaaggaccctttagtccagttctcattttcaacactgtactcactgtgtgtattttgtggaagctgaggcagatactcactgtaatcccactataaaaattgagatacccctactggaaactgtattgttaattcatgaattcttctcattttattattaagtaacctgtgtactggggaattcaatgatttcttaaacccaaagaaaatagtagtgaatgataatttggtttttcatggagaggctgtattcatattatattacggtaaaagcctcaagaggtcagagccatttcgggggagaaattccccaagcctttggaggagaaactccccaaaggtcaattgtttctatgtcctctccttttagtttataactttacttgagcccttggagaaatcaggagaaacagaagttgtcaagtcatttccccatactccgcatgcataaagatggaactgggtgttggcaacagtaagtaagtgaggcagaaggcagaagtgttgagggggatggcaggaggtgaggccaaggatgttgggactaaagggagagagcagttaggctgtaatcaagggttctttgagctccccacaaaccgatccttgattttctgaggaagcttgtggcctagagcagacagctgaaactatggtgcttggtgaaaagcaagtgaaaaaaacaactactactttattacttaccttttcccagtcatcttgcagatttcagattttctaccctttccgttctcagtaactgaccggccacctttgtggcatcagccccaccacttctcctgaggtccaagcctgtctccatctccatatccaacagctgtcctctctctgccattttcctgtactgagttctaatattatctttccctcatccatgttcctatatcaagaaaaatgatctcctttaaacaccaaaccagaatttctcgttcttcgaaagagtctatccatccatttatgtatgttagtgtatttctaggcagctaaaaaataaatgtaatctcagagtagaagtgcaatagaatggaaagagaatggtacccggagttagaaaaagggggctacacccagctccatctttctgcccatttgggcactgtcagctctaagtgaagtttctgtagtctgggcagttgcagacctccactgctggacaagggaaagaaggtttgagtctggttattacaataactggggttgggggagatgttggcttttggttcctgagaaccgtggttactaaacattcttttatttatttttatttttatttttttttttttgagacagagctgttctcttgctgcccaggctggagtgcaatggcgtgatcttggctcactgcaacctccacctcccgggttcaagccattttcctgccatagcctcctgaagtagctgggattacaggcacccacgaccatgcccagctaatttttttgtatttttagttgagatgggatttcaccatgttggccaggctggccttgaactcctgacctcaggtgatccacccgcctcggcctcccaaagtgcttcaattctaggcatgagccactgcacctggctggttactaaacattctaaacatgcatgggacaaccttgcatcacaaagaactgtcccacttaaaatgccaatactgccctgatgaagaaacatcaatagatgattttcaatgttccttcaacctatttggcctctaaaacttaagtgaaatgtagggaacttaagagactcaggaaagaactgtgaggataattaaaattttggattatgcagatttataggaaaagttttaaaaatgggcttatctctcccaaagagaaaaaggatgatttaaaaactgagactaggatgatacaggggaagtctgaccaataaattttctttttcaatggaagcagaaataaattaacatgatatgagctcagaaattacattggctttcttgagaaagacttgaaatcataaatgaaagaggagacattacaactgatatcactgatatcacagaaataaaaaggattatgagagactacaaggaacaatgatatgccaaccagttagataacctagatgaaacagatacatttctagaaacacacaacctaccaagactaaatagagaaaaaatagaaagcctaaacagacccataactagtaaggagattgagtcagtagttagcaatcttccaacaaagaaaagtcctatatcagatagcttcaccagatcattctaccaaacatttaaagaactaatgctaatccttctcaaactcttctaaaaaattgaaaaggatggaacatttcctaactcattttataaagccagcataagcctgataccaaagtcaaccatgccacaagaaaactacaggccaatatccctgatgaatgtaagtgcaaaaattctcaacaaaatactagcaactttttgctagcaacaaatactagcaaaccaaattcaacagcagtatgcagtatgctgttgaatttggaagcctcatacttcccgatgtcgaaatgtaacaacaaactctctatatattatatacagagtttcagtcatgcaagatgaaaaaattgtaatatataaagctacaatagtcagaatggcatggtactgacataaaggcagatatatggaccaatggaagaggatagagagtccagaaataaacccatatatatatgggatcaaattatattcaacaagggttccaagactccacaaaagtgtaagaacttattcttcaataaattgtgctgggaaaactgtatatccacatgccacagaataaaactggatccttattttataccagacaccaaaaccaacccaaaatgaattaaagaattaaatataagatttgaaactacacaactagtagaagaaaacccagggaaaaagctccatatttggtcttggctgtgatttcttagatatcacaagaaaagaacaggtaacaaaacaaacacagacaagtagaattatatcaaattaaaaggcttccatgcagcaaaggaagcaatcaatagagtgaaaaggcaacttacagaatgggaaaaaatttgcaaaccatatatctgataaggggttaatatattaaatatgtaataaactcctacaactcaactgcaaaatatccaaataatataatttaaaaatgggcaaaggacttgaatagacatttctcccaagaagacatacaaatggtcaacagatacatgaaagatattcaaaatcactaattatcagggaaatacaaatcaaaaccacaacgaagtatcacctcaagatggttattatttaaaataatagacaagggttagcaaagttgtggagaaattggaacccttgtacactgagggtgagaatgcaaactggtacttctgctgtgcagtatgaagattcctccacaaattaaaaatagaactaccatatgatccagcaatttcacttctgggtacatatcaaaaaaactgaaaacaggatcttgtagagatatttacacactcatgttcactgcagcattattcgcaatagctaggatgtggaaagaacctaaatgcccactgacaaatgaatgagtaaatatggtctatatgtagaacagaagattattaagcctaacaaggaaaatcctgtcatatgtgacaacatggataaactaaggtcattatgctaagtgaaacaagccagtcaccgaaggacaagtactgcatgatttcattcatatgaggtacctaaagtagtcaaactcatagaataaggtaaaattgtagttgccagagctgaagggaggagaaacagggagttgctttacaacaggtatagcactttagttaagcaagatgaaaaaattgtaaggatttgctgtacaacatgcagagagttaacaacactaaagtatggacttaaaaatttgttaaagggtagatttcatattttgtgtgtgtgtgttttaaccacaataaatgaaaaaaaaaactaagaaaaaaaggaaattggatccctgggtatgaaggtttgaaaacaaatggatttttattggtttcagacagttcacgcagaatcttgcttgtagactagggaggagcatttaggtaacttctcacgtccttcccagcacttctgtttctatggatacagttattaggttccagcacactgtgatatcctactgaattgacaggctagagagctgaggatggaggcacaacttctcatctaccccataccctagtaaataccccctgcctcactgttcaatgggggttaatcatgaggcccaacagcgaagggtacagtgggaaaactggagtctagcccagcactacagtaacatctactttgattcttagtagaaataaaagaaataaaaaaagtagaaccacagtaaagggctactaagagagaaagcatttgtcaccgtggacagaataaaagtaccaccaaatgaaataaatgcctatgggaaaagatgtgtcatgctagaaagtactgtgttccttctcctttgctcttcatttagttttcatccactcaatgtaccaagccttatcctatatcctgtttccttttccagctttgaaagatgcatggactgaatttagcctttggttaggtctttgtcagaaagtaccttcaaaataaaagtgttttacttggtactatctcaatagcaaacatgtatttccaaaatgaaatgcttgctctactagcaagctttttccttgagtaagcaacaatattgttagtaatttttcaaactgttaatacacatacacacacacacacacaaaaccccaaacaagccctattctatcatttataaatcatagggtgaatatcctctggtagaactaaatgaaaacattcagggcactgagtttttataatttgaaaaatgataatactagttgatattgacaaattcagttttgattttcaacgtttcaaaatataatttatccacaaggtcttaaacaattgaaagtacttaactaaatctgatatatgtagatgcttggcataaatttattgaatctattcagttagaatttataaacacaaaaataaaatttgttttaagtcaatgtggggtatattttatttctaatatccttgttacattccacagggtatacataaataagtatgacaagatatttattttcatttaaatctaactttcaatgaaattaagaaatgaaaatctgtttaaaatctacccccagagttctaattgaaatagagtacaaatattttccattaaaaaatatccctcaaacttagtatcttcagtaagaaaaatgaaaaaattaacacaaacctcaaaactgccagcagctcagaagacaaatgtgttctctggggacttgattgaaaccatgtattcataaaagtcttttaaatggatgctcttcacaaaggaagtctcatggaagacagcatggttctgacatatcagaggcttctggaagcaaagaaaagcacaccgttaggatatgtctaaagtaccattactgcctgtaatggtattattatcacttatatgtgttatcagcatgatgttattaatttctattatcaattttgtaccctaaatcatcttattcatcaatggcagagtgggacactaacctttcaatatcgtatttagaaatttctaaaagtcaggagtatttataactaagcaaacctctgcttttcctcttatctaggctgggattgaataactgtgggcagggtatgagcacaagaacagtgacagtatttactgagtgtctaccagatataaggcactgtgcaagtggcttttaaatctgggatctttaatacaaacaacactgcaattgaaaagtattggctccattttacagatgagaaaaaaatgcacagattgctgacctcaggcttagaacctgtaaccatcaaagttcaaaggccttagggcaggtactttccctcatctcactctgtagccttggtgatttagaaaaatatttcccaaacagaactgacaagagaacagataatgctgcaacatactaaattaattcaaatattactaattaattaagaacttgtcttgcctaatttactttagttttatattaaatatcatcttattcagtcaggcccacataaatacaaatgcccagctttaagcagtatatttttttctaccaacttttcttccttagacaaagagagaacttgctggaaactgagaagctcctttgtgtttggtgtgggattacatgcagcgctacatcaaggctggcactgcaaacttctcatcttcctctggcccatccatgtgacccacagttcctccactgtcctgatgaatgagaacacttagttttcctgattgcatcaggaactgagcccacatcctctatggctattactgagtgatattactgtatctctttgtggctacattcaccttaatggctgagggtgacaaagcgagggctctagttggatttccattctcatttttagtcagctatctctatatttgtttctgatggttccagtgcaacacagagaccccctgcaacttacccaccaccagctgtcccagtacccactctcacactgtgttgcagggctactgctcaccaaataaatgcttcaacacatcccttgaaatgatagctttggatgccatagacttttgtctgtcctgaaccttttagctcatggccccactgcaggaccaaaagtcccttagagagactagaaaatgatggagccaggaaggtcatgcataacttttgaaatttttagtttattggatttttggccacaaaagcttcagtcatgaataaagaaacaagggaaaacgattgatggtattttcaaattctacagaaccagagcctaggattattacacaaagaaaaaggaaaaagaacagaggaaaacagagctagtttatctttgcatgacagaagaaaggtgagcttgacaaagaatgaagaaaaaagacttgaaccaatggatctaaactaagtgagaggaatgtgaaatgaatagcaactcttcttaaaacctcatacactagcattctgtttacttcataccactcagaaacacattttcaggcagggcacggtggcccacgcctataatcccagcactttgggaggccaaggcgggcagatcacttcagtccagaagttcaagaccagcctggccaatgtggtgaaaccctgtctttacaaaaaatacaaaaattggccaggtgcggtggctcatgcctgtaatcccagcactttgggaggccgaggtgggtggatcatgaggtcaggagatggaggccatcctggctaacactgtgaaagcccgtctctactaaaaacacaaaaaattagccgggcatggtggcgggtgcctgtagtcccagctccttgggaggctgaggcaggagaatggtgtgaacccgggaggcagagcttgcagtgatccaagatcgtaccactgcattccagcctgggtgacagagcgagacttcgtctcaaaaacaaaaacaaaaaacaaaaattagccaggtgtggtggtgcacacctattaatcctggctactcgggaggctgaggcataagaatcacttgaacccaggaggtggaggctgcagtgagccaagattgcaccactgcactcgggcctgggcaagtaagtgagactctctcaaaaaaaaaacaaagacaaaaacaaacaaacaaaaaaaccaacaaccaaattttcagattaaatgcctaaactagtaggcccagtttttataaaatcctaatgacaatttttaaacattcattcagccactattcattatatacttatgagccaaacaataagttggaaaattccaggaacactgcaataatcaagatagccttttagtcaagcatcttaactgtcttgtaaagagatacaactaggatgtcaaaaaccataagaaggtggtaccagtaggtgtttgtaataatggggtctgaaaccaaactggcgggggtgttcctgcttcattacttcctggctgtatgaccttgggcaaggtactaaaactgtataacttagcctccttatctgcaggatgtatttcccgcaaaggctgttcgaggattaagtaagagaagccacataaagtgctttgtgcactgagtaacatacaataagaactcatcaaaagttaggaaatgttggcgggatgcagtggctcacgcctataatcccagcactttgggaggccaaggcaggcagatcacctgaggtcaggagttcgagaccagcctggccaacatgatgaaaccccgtctctactaaatacaaaaattagccaggtatggtggtgcatgcctgtaatcccagctactcaggaggctgaggcagggagaattgcttgaacctgggaggtggaagttgcagtgggctgagatcgtgccactgcactccagcctgggtgacaaagtgagactctgtctcaaaaaaaaaaaaaaaagttaggaaatattagtagtattgttgtataacagatcatgggtggtatcagtgatggaaaacgtgctatgaagctcagaggaattggagatcctttctgttggggatgaatggaatcaagaaggcttcagtgaagaaagtagcatttaagatcaactataagtaaacagagagacatgattaggcatttacagaaattctattataattgaaaagccagaatatgatatactttagaaaaacataggttcatgaaattagacattattttccaggatttggtgtgaaagtagacacctaacctaacaacacagccaggtcatagtacaaagaaaatcaacgtactgctaccaagagaggtacacgatcccatggggtcctgttctatttaactgtaatccaaaatgacaccatggcttttaatggagcttggcaagctctagacgtgccaattataaacttagccttaaatttaaatcatagggcttgagactcaaatctccaatgtgacctttcctgggtgttgttcaagaaaacatgtctgtcactgtggacagaaaccacacacccttttactctggaaagtataatataaagatgtactgtattttacaagcacagagccacaaaatgatggtggctataattccctagaagcaataaaagcaaaggctgtttgatttgtaacattcatttagaaatgtcttattgcattaatgaacattcttatttcccgcatattcgggactttaattcaaaaaaagcttggcaggaatctcatcatttatagatttaacatatagttcctctggatacattcattttgcaagggctcactaagccacactactttgtccttgccagacccatacaatattgtactgaacagaggagctaaaagcccacagtggcttgaattctcctataccctccctgtttcctagccatggaaggtctaatcaaggagagttctatggttgaaatgtgttcaggtgttgccaatgtgatagtgtgaagaggtatagcctttaagagatgattaggccatgaggactcctccctcatgaatgtgatcaaggcccttataaaagagtcttcacacagcattcaggtagctggcccttctgccttccaccacgtgcaaacacagcaatattcccctccagagaaaccatcttggaagtggagagcagccagcaccacagacaacagaatcttctggtgctttaatcttgaactttctagcctccaggactgtgagaaaataaatttctattctttataaattacctaatcaatggtatttgttataggaacaacaaaggcagaaattggtgccagaagaatgggatgatgctgtaataaatacctaaaaatgtagaaacagctttggaattgggtaatgggtagaagctggaatggtaatgggtaaatgctggaaaaagcctgtaccgtcatgaacagaacattaagggcaattgtggtgagggctaagaagaagcagaagactagagaaagcctgacttccttatggattacttaagtgtttgtgaacagaatgttggtataagcatgaacagtaaagattattctgttgagatctcagatggacataaggaacagggtactggaagctagaggaagggccgtctttgttataaaatggcaaagaattatgctgaattctgtcctgtcctaggactctgtgaaatgcagaacttaagagcaattaactagactatttggtggagtaaattctgaattttccattaattcaaattgtgagcatttgggaaattttcagcttggacatgtggagaataaaaattaagtgcgtttagaagagaaaaccaagtgcatgaccaagtgactgtttggtaaggagattagtatggatagaagaaagccaggtgctttagaagaaagccaggagccattgacaatgcaccaatggctctaaacacattttgaagatctttgaggctgcccctcccatcatgggcccagagtgctagggctttgagggcagaatggttttgaggaaggggcccagggtgcctgggggatctggggactcactgcccagggcaatctcaagtctctgctccccacattctgttacggcattcctcagcctccccagctgtggcttgagtggacccagctgcagctgtaaaccctggcagcctccatatggtcgtaattctgaggcttacagagtgcaagagctgtgagacacagctgcttccgcctagatttcaaaggatgtctcaggcagccttgggacctaggcatgaacttgcttgccacagaggtaggaccatggcagagacccttcactagtgcaatgactagtggaactgtggggtcagagccactgcagagagtccccagtagggcaatccttagtgcagccatgggggcaggttcactcataaaatcccattattgtagagccacagcatgcaactccagcctgagagagctacaagggctgaactccagcccgcgagagctgcttcatgggctatgctcaacaatattgtcatagaagggtctcctggaggcttggagacccaacccagctgagtatgtcttgaagaagatatgaagtaaaagattactttcaagtcttaagatttaatgtttgccttgttgggttttagacttacttgggacctgttacccctttcttctttgctatttctcccttttggaatggaaatgtctatcctatgtctgtcccatcattgtattttactttatttttgagacagaatgtcgctctgtcacgcaggctggaatgcagtggcatgacgtcggctcaccacaacctccacctcctgggttcaagcgattctcctgcctcatcctcctgagtagctgagattacaagtgcctgcccccacgcccagccagatttttttctatttttggtagagacagggttttgtcatgttggccaggctggtctcgaactcctggcctcaagtgatacacctgcctcggcctcccaaagtgctgggattgcaggcataagccattgcgcccagtcccatcatcgtattaatattttagaagcgcataacttgtttaacttcacaggttcatagcaggagagcaatttgccttgacatgaattatgccttgagtctcacccatagaggatttagatgagactctggattttagactttgagttgatgctagaacaagtttagactgggctactgggatggaatcaatgtattttgcatgtgagaggacataaatttgggagaggggccagggtagaatattatggttaaaatgtgtccccttcaaaattcaggtgttggcaatgtgatattattaagaaattgggcttttaagaggtgattaggccataaggactcctcccaggtaaatgagattaaggaccttattaaaaaatgtttcacacagcatttggataattgctcttctgccttctgccatgtgagggcaaagggttcctcccctccggaataaccatcttggaagaaagcttccctttccagaaaactgaacctgccagtgcattcatcttgaacttttcagcctccagaactgtaagcaaacaaatttttatgctttataaattaccccatctattgtattttggtatagcagcacaaatagactaagagagtgagcctgcaataaatacagtatccttctttatccctttcactgaaaacctgttaacactattttccattcattccaactcataacatcacaatttatgcactaccattgtgtcaattcattcttagattgctataaagaaacatctgaggctgggtaattcataagcaaaaatttattttggcttatggttcttcagcctatacaggaagcatggcgctggtgtctgcttctggcgcatcctcaagaagcttactatcatggtggaaggcaaatgggagcaggtccatcacatgatgacagcaggggcaagagagaaaagggagaggtcccagactcttttaaacaaccagatcttgcatggacttagtgagaactcacctatcacaaaggacatggtgccaaaccattcatgagggatccacccgcatgatcccatcacctcctaccaggccccaccttcagcattgggaatcacatttcaacatgagatttggaggggacaaacatccaaatcatatcaaccataacttctagctagtatttattcttgtagttcatcctgaaaagagcccaaaatgggtcatcctcaggctatagtggtgataaacatttgaactaaagtaaataaggcagggcactgtggctcatgcctgtaatcccagcactctgggaggctgaggaggcagatcatttgaggtcaggagtttgagaccagcctggccaacatggtgaaaccctgtctctactaaaagtacaaaaatagccaggtatggtgatgtgtgcctgtagtcccagctacttgagaggcggaggcaggagaatggcttgaacccaggaggtggaggttgcagtgagctaacaccactgcactgcagcccgggcaacagagtgagactccatctcaaaaataaataaaataagtgaataaatgcatagatgagataattcttaaaatgtaactctaattatgtacatccactactaaagaacttacaagggctccctattttccaaagatcagacctaagttattcaccagaaatatctgttcccaccatcctctgtaatctcaaaacagactatttctgaccaaaacccttggatccagtagaaatggtctgctcactatgttatatagtgaatctcaactagaggtgcatcacaggtgcatggggtgtcgcctatgacaaaagtgataaatgacatctctcttgccctgtttctctgatcagctactactttgtgaaccaccctatggcgaggcccatttggaaagaaactgaaggatctttccaagacaacagccagtaagaaacttgggccctttatctattagcctatgagaaactaaatcctaccaacaaccaatgagcttggaaatatattctgccccagttgagcagagatgctgtagatgttgctctagttgagatgactacaggcctggccattgctttgactgaagccttgtgagagacccagagttggaggacccagctaaggcatgctcagattcctgactgttgtttaagcaattaaaatagggggtcaggcctgaaaaattcctgagcaaatacaaccagaggtcttaaaaatagccttaatcttgcttaaattgccaacataagcaaaacttaactcaggtcacttctgataaatgcttacattagaactaaaacttaaccccagtgcatcgtaagcagctaatgaacataattatgtgactggactttccaagaaagtaccaaagaaaaggccattttgtcattgcaaaccggtcaaataattttattttaccttagcattttcccaataaatacttgcctcattctgtcattgagacactaaacctcttgcaatctggtgttctccatccataaattgtttcttactcaaactctttaaaattttatgccttaaattttaatgcagtgatagttaattttatgttgttaacttggctaggccatggtacctagatatttgcaaacacaagtctagatgttactgtgaagatgttaaaattaacatttaattagtagacactgagtaaagcagattactttccataatgtgggtgggccttatctaatcagttgaagcacataaggcaaaacagactgaggtcccccaagaaagggaattctgcctccagactgtctttggatttgagcttcttccctagatctccagcctgctggcctaccctgcagattttagacttgccagtgtctataactacatgagctaattccttaaaatatcttaagattctctctctctctctctctcccccctcccactccctctcctgttggttctgtttatctggagaaccttgactgttgagatagaactgataggacctatagagagagagatgtataataagggatttattaggggaattggctcacttgattatggaggctgagaagttccatgataggccagccatctggaagttggagaacaagagaagctgatagcaaggctcaattcaagtctgaaggccttagaaccaagaaagtagtaactctcacaccaagcccaaaggcccaggagcctaggggcattgctggtgtaagtcttggagtccaaggacaacagagtctggacttctgatatccaacagcagaaggaaaaggccatcctggctcccagaaagagcgagaattcaccattcctttgccttctttttccatctgggaaccccagctgattggatagtaaccacccacattgaaggcagatcttccccattcagtccactgactcaagtgctaatctcttctggaaacaccttcacagattcccctgggggcaggcctatcattctaatcaaatgccaaaacagtccatctgggtttccctttcatcaggagaaggacaagctcagtgcctactgaagcactgagaataattaatgctttaccagctatctgggtatccctttgttttagtctattctcacgctgctacaaagaactgctcgaggctgggtaatttagaaaggaaacaggtttaactgactcacagttctgcatggctggggaggcatcaggaaacttacaatcatgacagaaggtaaaggggaagcaaggcatcttcttcacaaggtgcaggagggaaaataaatggaggaactaccaaatacttataaaaccatcagatctcgtgagaactcactatcatgagaatggcatgggaaaaactgcccttatgattcaattccctccatctggtctctcccttgacatgtggggattatggggattacaattcaagatgagattttgggtggggacacaaccaaaccatatcatccttagaccagtcacactgacacccaatcaaccatcacaataatcacaattaactaatacgaagacccacagatactgtgagactaatatgacagccctcccatcacatttatcacaatgaattataatttttggattcctctctaatatggtaagcttcatgttctgtcaagcagagaccacgtacatcatgtttgcaaacaaatattgtactgtgtccagcacagtgactacattcttgttaaacaaatgagtcaaaactaaagcttctccagcagtgtcttcatataacctaagaaaatgacggaacagtcccccaactaacttattgtttacgatttatttgtacctttactgaaggtacctttaatattgtaagaaggcacatatattcattctttcacaataataaacaaaatagtagagatgagacaaatcatgacacacgggagtgacacacagagtggagttttatggagttggagaataagatgattgtgaaattgagaataacaaatttgaaattttataggctgctttagagcagaagtatcagatttcaattaaaagtgtttttgaagatgaacgtggcatcaaagtttagaataggaaaaaaggctattgctatttgaataggtcagttagacagcagtggaaatataaaagtagggttggatggaagaaaaatgcagagaaaaaattccatcaattagatgaaatggataatgagaaaaaagatgcagtcaacaattataggaatattttgagcctaggtgtgggggagactgtaagaacactgacagaatgtggagattcaagaggggagctggtatatgtctgcatgcttagggagtataaaatgatagtgactttactttgagatatgccaagtttgagaaatgccacattccttcctatgttttatgaatacagaaaatctaagtttgataaatgtttcaccaaagatcaatagagactatcaaagactatctctaatttattgttcagcgagtataatatatggtaaaatgcactgattttaggtgtacagttcactaggctttgataaatataccttcccaagtaacctacacacaagtcaagatacaaaacatttccatcacccctgaaagtttccttctagtcaagccccactcaaatgtgaaatttcaatgtctatcaccataaatggctttgcctatacttgaactctgtatataatcatacggtataccagatagcatatgttcttttatgcctggttccttttgttcaatgtaatgattataattcttgttaaatcttccagtagttaattcataagtattcaattgtataaacgactaataacctactacatataatattacattatatgaatttaccataacttatccattctcctgtctatggtcatttggcttgatccagtatttggctattaataaacaaagctattacaaacattcttctcagggctttatgttcttatacaaagccatatatcctttcattcttaagtaaataggtgtgaggttgccagggcattaagtttataaggaaccactagttttcaaaaaaatcctgtaatatgttataccctcaggagcacggtacaagaatttcagtattaccacatcctcaccaatgtttggtgagctcagtccttttatttttatctttttcttgtggatgtgaagtggtacttaaatttacatttccatcatggctaatgatgtcattattatggcttcaaatgtttattaaacattcttatcttcttttgtgaaggttctgtttaagtaatttgccaattggaagaaaaatattttctttgtattttttgagttgtaaagctttgttaaatattctagattcaattccttttcatacatatgtattgcaaactattaatatttgccctttctgtggcttgcctattaaaaatgtttttttatagggagcctttaatgtttgtggagtatagttaactgatttttttctataatgtgagtgcttttagtatcctaagaaatagttatcatcttttgactttttctagaaatcttataaattttactttcatgtaaagatctaattcaaagtatatactttgaatcaatttttgtgtatggtctgaagaaggtgttaaggttcattctgtttcaataattgctctagcaattggctctttttctttttctatttttttttttaagagactgtgtcttactctggttgcccaggctggagtgcagtggaacaatcatagctgactgtaaccgagtacccctgggttcaagcaatcctgcctcagcttcccaagtagctggaactactgatgtgcaccaccatgctcagctactttgactatttatttagagatagggtctcgctatgttgcccaggctggtcttagactcctaggctcaagcagttctcccacctcggcctcccacagtgttgggattataggcatgagtcaccacacccagcctccatttcttaatgagcctttctcctatatgtaacaaaattgctttgttattaaatcaatttactgtataagtctgtgtctatttcatgataacatattctgttccattgatctatttgtctatctttgtctagtatcatattttcttaacacttttatagaagtcttgaaatcagaaagctagtcccccaacactgtcatctttttctaaaataatttgacactaataagtccttataattctgtataaattttagaaccaatttattaatttccaccaaaaaaacataaacttttgggactgtgttaaatatacacatattttgaaataaaaatcttaatatagagtcttccatttgcaatttcatttaccaaatgtttcttactgtatagaaatagcactgatactttacatttatcttgcatcctgaaaccttgtaaattcaagagatttttgctaagttcaaatagatcttttttagactccataggattttctatacaattttttaagtaaatttttgacttgctgtctccaaatatttttattattcttttccaatctatatactttttatttattttactggcctgactgcattggttaggacctccagtacaatgttgaactggtgagagtgaacacccacatctcttttcctgatttggagggaaagtattcactgttaacatccttagttgaaggtttttcacagattccctttaacagattaggaaagataccttttattcctagtctgagtttttatcatgattagaggttgaattttattaaatgctgtctctctaactagtaagataacctttttttctattaatgtggattgattttgaatattaaagaatgcatacatacttgaaattcatttttgtcaggatatattactgtatgttaatacataataacacatcactgcagtgattatgtgttatttcctaattgtatgttaaacatttttgtgtctatgatcataaggcatatcgatgtgtgacttttttaataatgtccttatcaggacttggtattagaattacaaagctctcaaacaatgactagaagtgttctccccacctctatttcccgtctttgtttaagactggtatttcttcttaaatgtttgaaggaattcattagtgaaagcatctggatctggagtgttctttgtgggaagcctctgaattataaattcaatttagttaacaaatacagagctattcccattttctgtttcttctaatataagatttagtaaattttatcttataaaaaaaacttgtccatttcatctaagataagtttgtttcttatggcttctcataccctataataataattccttcacttgactaaaccatatatatttcactggacctcctttcttggtacattaaactcgctggtactttttcctcttctgagagcttctccagcccttactgacataattttgcactgccatgtgttttcagtcatctttattagtttgttttacctttgaaaaacagattatagtgtcctcagaggcggaaatatcttaaactttcattgttctccatggaatttagcatagtctgttaacattttatatgtgtttctgagattatggatttgttcactgttggttagcttgatatctattacagatgtgcttggagcatcttatagtaataacaggaagcatgaaaatgttagaaaataatgataataataactaagattggacacatcaaagtaacagaagccaaccttaaagcgcttccaatggccaaactgcaacaatttgagaaacaataaataataatactggactatatacctcaaagaataaaataatgatccatgagttcataatattgtcaatagtcaactgaatgactgaatcaataaatgggtgagaaaagtatctttcttgcagaattctaaatttaaaaaaaaagatggaatgagagaaacaataattagaacatctagttagaactgctacaggcaaaactcaatgatgaatacaaaaaaatgagtggccaaaagccactcatttaacaaggagcaggacagttaaaatgactcaaagtagtatccctaacatattaattactatggtggcttttaacatgtgtctacaattcttttatattcttccatcaggagatggaacttaatttttttccccttgactggatgatagaattagtgacttgcttgaaactaatatggaagaggaaagtagtaattgtggagaaacctggcaagcaccaccttaatcaagtaatcaaggttcacacatcaccatttaaagtcatgttgatatcatgtacctttgatattatgataaatgtactttaccactgtggtatttttccctaatatccctaatgctcttctaactgtgataacatattaggaaactaattaatattctatgaaatatcagacctttactcttaaatattgtcaaggtcatgaaaatcaaggaaaacctaaaactgtcacagattggtggatactaaagaaatatgatctctgtggtatcctagactggatcctggaacaaaaaagggacacagttgaaaaactacttaaaaaaagagtaaagtatagactatagttaattgtattgtgtaaatgttaatttcttagtttgataaatatactatatttaggggcaagcaagagtaatttggaaacatctttggtaacagctataaccactacttccaaaaaagacacaggttgccaatagaaaaattaataataaaggtcaatatccacaatacaaagaccctggacacaaatccacttactcacagacactgacacccggcccacccacagccctcatcaacagggccacctgcagaccctgtcaaatgtcctgcccagaatctctttccaggatgacttgtggagggctttccctaccaaaaccagtctataaagatggagagaggtgactgcttcttcaagtgcacagacaccaacacaaagatacaaggatcacaaagaatcaggaaaatgacaccaccaaaaagacaaaataaagctccagtaaccaaccctaaagaaatggagacctataactgccagaaaaagaattcaaacaattatcttaaagaagctcagtgagctacaagagaacaaatcaggaaaataaatgaacaaaattagaagttcaacaaagagatagaaaccataaaaaagaaccaaatagaaattctggagctgcagttattatgactgaactaaaaaattaaacggtttcaacagcagattcaatcaagcagaagaaagaataaactcaaggatatgtcatttcgaattattaaagaagaaagaaaagtgtgaggaaattccactagacttaagagcaagcagactaatcagcaagtaagctaatatatggactagcaagcaacatcagcaagcaaactaatatatgcattatgggacactcagaagaagagaaaaaggaacagaaagcttatttaaagaaataatggctgaactttttaaaacctgaagacggaaatggacattcaaattcatgagagaactcaaataggtggaacctaaagagttctaggagaaattactattaaattgtcaaaagtcaaaggcaattttgaaagcaagagaaaaaggactcctcacatatataaatctccatacaactattagcagatttttcagcagaaatgttgcaggcaagatgagagtgggatgttatattcaaagtgctgaaagagaaaaaaagttgccatctagaaatactatatctggtaaaaatgtcctttaaaaatgcatgagagacaaagatgttccaagacaaatgaaaactaaggaagtatgtcaacactgggtcctccttataagaagtgtgaaagggagttcttcaagttgttacaaaaggatactaaacagcaacatgaaagtatatgaaaatataaatcttggctggtaaaggtaaatacacagactaatacataacaatgtatattgtaatgaagatgtataaattacttataatcctaatataaagtaaaaagattagttttaagaataactattaccaaaaatattaatgcacaatataaaaagtaaactatcacatcaataactgtgtaataaacatagtttttgtgtgttattgaagatatgttatcttaaaatagactgttataagaagttttatgtacacctcatggtaattacaaaagtatagtagatacaaaagatagaataaaagcttattactacaaaagctcacataataaaacagcaaaaaggaagaggaacaaaagaactataaaacaagacaactaacaatataacaatagtattttacttatcaataatttaagtggatcaaactcaccaaataaatataaaaataagattcaactatgtgttgtctacaagagaagaactttaaatttaaggacacacagactgaaagtaaaagaatgaaaaaaaaatactcaaagcaaacagtaaacaaaataaagcaggggtagctatttttgaaatatacaaaatgcttttaagtcaactgtcacaagagacaaagatcattatataggggaaaaaagagtcagtttaacaggaagataacagtagtagacttcaataactcatcttcaatatggattgatcacacagaaagttattaaggaaaacagcagtcttgaataacactatataccaaatggacctaacagaaatgtacagaacattctacccagcagcagtagagcaaacattgttctcaagtgcatatagaacattctctagggtagatcacatgcttggtcacaaaacaaatctttattttaaaaagattaaaatcataccaagtatctttctgaccacagtgaaatcaaacacaatatcaataacaaaaaaagagaaaattcacaaatacatggaaatttgaaaacacactcctaaacaactattggctcacaaaaagaaatgaaaaggaaatttaaaaagtatgttgagaaaaataaaaatgaaaaatatactaaaacttattggatgcatcaaaagaaataataagagggaattttatagtataaacacctaccttaacaaaaaaaaaaaagctaaatgaatgacctaattgtatgctttaaagaactagaaaaagaacaaaccaggccaaaagctaacagaagaaagaaaatattaaacgttagaacagaaataaatgaactagaaaacagaaaaacattagaaaataatataacaaagagttggttttttgaaaagataaaatacacaaattcttgcccagactaagaaaaaaagattcaaataagtcaaataaaagaggggccattataactgatgccacaaaaataaaaaatatcataataaactattatatgtgacaatatatacgaacacattggataacctaggagaaatgaatacattattagaaacacaggacctaccacactgaatcatgaagaaatagaaagcctaatcggatcaatgacaaataaggagagctaataagtaatcaaaaaccacctactaagtaaaagcccagtatcagatggttccacaggtgaattctatcaaacatttaaagaatgaatgccaatattcttaaactctcaaaaactagaagaggaaacactttcaaactcattttatgagtccagacaccccaatacaaaccaagacaaagattccatgagaaaagaaaataggccaatatctctgttgaacattaatgtaaaaattttcaacaaaatagcagcaaaccaaattcaatagtgcattaaaagggtcatacaccacgagcaaatgggatttattcctgggatgcaaggatggctcaacatatgaaaatcaatcaatgtgatacatcatagtaacagaataaaggataaaaatcacatgataatattaatagatgcagaaaagcactttataaaattaaacacgctttcataataaaaacttaacaaattaggtaaagaagaaacttaccttaacaaaataaaggccttacatgaaaagcccatatgtatcatcacactcaacggtgaaaaactgaaagatcttattgaatccagaacaagtaaggatatccactcttaccatttctattcaaatgagtactgaaattctagccagagcaatcaggcaataaaaagaaatatatatatattttttactttgtaaaggaaataattgggaagaaaaaataaaataatctgtttgctgatgacatgattttatatacagaaaactctaagaagtccatacacacagaaagtgttataaataataaatttagtaaagttacaggttgtaaaaatcaacatataaaaattagttctgtttctatacataaacaattagctatctgaaaaggaaattaaaacaatcccatgtacaactgcatcaaaaagaacgaagtactcaggaataatctttaccaaggaggtgaaagacttgtacacaaaaactgtaaaacaccgatgaaagaaattaaatcacacacaaataaataaaaatcccatgttcatggaaagacttgagatatcaaacaaaaatattttgatttgaagaatatcaaaatgttcacactatccaaagcaatctacagattcaatgaaacctctatcagaatcccagtggcatttttttacagaaacaaaaaatacaatcctaaaacgtatatgaaaccataaaagaccctgaatagccaaagcaattttgatcaaaggaaaatctggaagtatcacatttcctgacttcaaaatatagtacaaagctatagtaatcaaaagaggataacctggcataaaaacaggcatatggaacaatggagcaaagtagagaatccagaataaacccaggcatgtaagatccaatgatctgcaacaagggtgccaagactaaacaaatgatggtggaaaaagtggacatccatatacaacagaatgaaattttacccttactgttacactgtatacaataaaaactcaaaatggaataaagacttaaatggaagacccgaaaccacaaattttctagaagaaaagctccataatgttgacttcagcaatgatttattggatatgataccaaaggacaggcaacaagagcaagcaatagatatgtgggatcacatcaatctagaaaactacaccacaaaggaaataatcaacaaaatgaaaaggtaacttacaaaatgggagaaaacctttgcaaaatgggggaaaataatttatctaataaagggttaatgtcaaaaatatatcaggaattcctgcaactcaatagcaaaaaaatccaataaaaatgggtaaagaaactgagtagacatttctctgaagaagacatacaggtatatgaaaacatactcaacagtaccaatcatcagggaaattcaaatcaaaactgagataccacctcacacctgttaggctattataaaaaataaaaagataacaaatgttggtgaggacacagagaaaaaggaacctttataagctgttggtgggaatgtaaattggtgcaaccactgtggaaaactgtatggggattccttaaagaatcagaactaccactggatagtagaaatcccacttctgagtatataaccaaaggaatcaaagtctgggtcacaaagagatttctgcactatcatgctcactgaagcattattcacaataggcaagatatagaaacaacctaaatacctgttgacagatggacaaataaagaaaatgtggtatatacatacaatgggatattattcagccttgaaaaagaaaatcctgtcatttgcaacaacatggatgaatctggaagacattatgctcagtaaactaggccaggcacagaaggaaaaatgctacatgatactactaatatgaggaatctaaaataatcaaactcataaaagcagatagaatggtggttgccaagggccagaggaagggcaaaatgtggaggtattagtcaaagggtaaaaatgttcagttataaaagacaagtcctagggctctactgtacagtagagtgcctatagttaatattttgtaagacttaaaatttgcagtgacattatttgctcgatcttatgttaaatgttcttactgcaaaataatatgaaacttttggaggtgattaatatgtttatggcatagattatggtgatggtttcatggttatatacttatctctaactcaccaagttacatacattaaatatgtaaaaattttacattattcttacctcaaagtgatttctctttaaaaagatcaatatccaaaaccactctgacttcaaaagtcaggtagatagtactgacttttttaggaaataaaagaaacacctatcttttggtgaggtaatatccaattattttacattttaactttcaaacaactgtaaagagacatgagatttatacttgttctagatgcttccagttcaacatggtaatcggatcacatcaacttattccatgccttctcaggttcccaaatagccataaatctacaaagccaaagaaaattggagtgaatgaggaaatgctagaaaaattctagatgatagaattgaacaggactgagaaagctacagcctaagtacatgtgagaagaaaggatgatcaaaagaaggcagaaatttgagagaattctgtagggaaacaaccagatttctagactataccctaaaaagcaagatatcaggctataatctctgatacaaagtttgcagtcaaattttctttcttaaatataattgtataacacttactgacagacatttgaagaaagttggaaagataaagaagtctgcaatcaacaaacaaaaataacccttgagaagtgtctgtttatatccttcgcccactttttgatggggttgtttttttcttgtaaatttgtttgagttcgttgtagattctggatattagccctttgtcagatgagtatgttgcaaaaattttctcccattctgtaggttgcctgttcactctgatggtggtttattttgctgtgcagaagctctttagtttaattagatcccatttgtcaattgtggcttttgttgccgttgcttttggtgttttagacatgaagtccttgcccatgcctatgtcctgaatggtattgcctaggttttcttctagggtttttatggttttaggtctaacatgtaagtctttaatccatcttggattaatttttgtataaggtgtaaggaagggatccagtttcagctttctacatatggctagccagttttcccagcaccatttattaaacagggaatcttttccccattttttgtttttgtgaggtttgtcaaagatcagatagttgtagatatgcggcattatttctgacggctctgttctcttccattggtctatatctctgttttggtaccagtaccatgctgttttggttactgtagtcttgtagtatagtttgaagtcaggtagcatgatgcctccagctttgttcttcttatgcagccaaaaaacacctgaaaaaatgctcatcattactggccatcagagaaatgcaaatcaaaaccacaatgagataccatctcacaccagttagaatggcgatcattaaaaagtcaggaaacaacaggtgctggagaggatgtggagaaataggaacacttttacactgttagtgggactgtaaactagttcaaccattgtggaagtcggtgtggcgattcctcagggatctagaactagaaataccatttgacccagccatcccattactgggtatatacccaaaggattataaatcatgctgctataaagacacatgcacacatatgtttattgtggcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaacccaacaccgcatgttctcactcataggtgggaattgaacaatgagaacacatggacacaggaaggggaacatcacacaacggggaatgttgtggggtggggggacgggggagggatagcattaggtgatatacctaatgctaaatgacgagttaatgggtgcagcacatcaacatggcacatgtatacatatgtaacaaacctgcacattgtgcacatgtaccctaaaacttaaagtataataaaaaaaaacccttgagggaatttgagtgattgacagaatagaacttttaaaactctaaaaacataaagaagattttattaaagaaataatcagacaattatcaattttacaaaaatcaatataaagaaaattgtgtttaataattcttccagaaagcttttaaaaactgaaagagaaatgaaaaacagaagacaaaagacaaaggatatagagaatccaaccagaagacccaactactaagaatgccaaggagaattcccagtaagaaaagcaaaggagaggaattcaaaagaaatttccacaagtgaaggtcaggtgttttcaaaattaaagggctcatcaagaggtaaacataatcaatgaagaaaagaatcataaccagatatgtttttgtaagagttcctacagataagtttctaaaaactgaggaggaaaaaattagtaacttacaaaggggcaggaatcgaatttcttgtcagcaatactggatactaaaaaatagagcaatgccttcaaatttccaagggaaaattgtttttaacttatatgtcttaatctagccaaatctagccaaaataataagtcactttcagatatacaaagattcggagtatttacttcccacatgtcctttctggaaaaattcttgaggatgtgcttcagcagtaaataaaattaaagtaagaaaaggcatgaatccaagcaagagcaaggcaagatgcctgtgtaccagttaccccaacctgggacagagggaggtatctaggaaaaaggggatttctaaatattttattctatttcctgaggtgaaagtacttaaaaatgcaataaaggcagattacacaaagaaaagtaaaagcaattagaaactctaggaaaaacaaatacaatcatagtatacaacttagatcagtagttataactacatattcatacctatatattgatttttaaccattagaatcaacctaacaatattacaactagagttgtaatatatttgaaaaacattatatcaaccttaataatttaaaattaaaagcacatatgagagaaactggaaggcattaaagggaggagttatagaaagaatgattgttatggtctgaacttgtccaaaatttgaaactcaatcctcattgtgctgttattaagaggtggatggaagctttggggaagtgacaaagtcacgagagctccatcctcatgaatggatcagtgccttatagatgggctggagggaactggcgtaggtccttttagctcttctgctatgtgaggatatggcattttcttcttttgctcttcctcctcttctatgtgaggatgcttccatgaaaacacactatggatagaacaggcctacactagacacagaaactgccagcaccatgatcttgtgctttccaacctctaaacttagaagaaacaaatttctgttctttatatatcacctagtgtcaggtatttttgttacagcaacacagactaagtaatagtctcatcttaaaaaggaatcatttggtactgtatatgattgagatagaaatgaaagaataagtatattattcaaaggtatacaggtaacgagaacttctgggttttcctctctaaaatatttagaggttttactctctaaaataggagggtattttagcaatggggagctgctagatcattatgtatcacagtgattaagtcaacagataatattgaaattttataaatcaagaaattgtgatcacatacacatgcaatacttgattcagccaatattacacagttagaactaaaaaggaactaacaaaaatataaacatagaaacagctaaaaaaaattattagtttttctttgggcagtaagtctagaggtgggatccaggactatagtttttcattataagccctcctatactctttaatttttaaaagcatatatatgcatttattgatcaaataaatgtgaaacatttattaatgtttaaaaatccatctggaaatcatccagctagactaatgcttcatcataatgcagctctcagcatttaaataaggtcttgttggtaattcagaaattactacattttaaagctcaaatagcaatgtcttctacacattctactctgtggtaggaaatatcacagcaatattttagaacagatgacaaaatagcctatatcagggatattaggtgttaaagaaataaaactggttaaaatatttgttaaaaatatgaggtgaataaatgcctgtcctaatgagtctccccactagtatctaacacatgttagagaaagaggaacactggtctctctgctcactagtacaacaatggatgactgcttaaattgcagccatcctgaaataccttgagtctgtcatttattccctctgatttcctatgagaaagattacaaattgcccactagaatcagggtctgtgagccacatcctccactttcatttctaggacataatacctctgccgtcaatcacagcacagctcaaattttttgaagcatagtgggatacaacagaattgtcacttaaaatttggaatacatctgatgtagcacgaactggactttctaagtgtgttaactactctgcaatatagatttggaaaatgtgaaaatgaagtggaaaaccttaaaaagacaaatgtccaaataagaaagattacagtctgtggatggtattctcattcatcttcaaatttcctttgctttgtgtttaaaccaaatgaagaggttttccaatgtcatttgacacaggcaaacatctgaaattcaacagcaaagtccccttcttgcagaagccttaaaaatgaaagctggtttgcttttcctaaagaaagaaaaaaaaaatgtctccccaacccccaacacccaccctttcctgaaagagaattttccagcagctggaagtttccagacctatgttctcagtgttggacagccttatatttacccatttttagcaaaattagggctcagaaagtttcatgagtagtggtacacatcagacgtctgttggaagtcattgtggaaagggtttctctgtacatatgtatagatctaagtaggagatggaagtcaccaaaataattttgtaacagaacagcaacaacaaaaagaataatctataaatattataggactttcttggtgtggataaaatcagagctcaaaaagagcctccagatcaatccatgtgagattttacaggccttctagaattggtaacagacaaggttttgctctcctgccagccggcactcctatttctgatgcattcatacagagtgatggttgttactaacattgtaattacttatacaatccttttaagaatgtaagttccatgagagcaagaatgttatatcatccactactgtattcaatcatttagaagagtgtctgacatataataggtattctgtaaaatttttaaatgaataaacaccttgtaaatttactgtaaagagcaaaggaataagtacaggtgaaagtgctttgcaaattaaattctaaaaggtgagcagttgttactctgcataatccaattcctgttggggcccgctcctaaaggctctgacaaagccattgcccgcattttgattccttctactgggccataattagactcatctacgtgggagaggcaggataatgcagttgttcaaagtgtaaaccctgaaactggacttcctgagttcaaatcccacctctatgactgactgactagctatatgatcttgagaaagttatttaacctctctatgcttaatttccttatatgtaatttgggagatgataatgatgcctaacttatagggttgtgataattaaatagattactatctgtaactcattgaaaacgggctggtacaaagtaagcattaagtacggctgctagtgttgttgctaccactcctattactatagggatgcagaaaaaatataaggaaattcagcaatgtccatactgcgaactttttctactaatgccacgtgcaagtttaaggctatattttacattgctgaattcctctgaagtttcaacttcatgaactattcttctacatatttagttccttaaagagctcaatggagctacagctcagtaagttatgtgttttggataaaataaggatatgagctgaggcatttaatcatagaagcagcctcaggctctctatccattcttggcttgtttttcaaagcacattgctaaatgtgttttctctttcataaagttttttaaaagttacttggacatgacaagcttctttaaatataaaacagtttcaatttttattgagatttgcttcaggaacattcttagtgttggtaatatttttagacaataattttattcagaagaccttattttatagattaactgcacaatagagttcatgcagttacatttacatggactttgtgctccatagtactgaaatccaaatatcagtttacttcagtataagcatatcagattgacctgaaatgctctagaacttttaaaaggcaaacgccaaaatgaaacaacacaccacctctcaagcatgtattctgtgctatgagcaagatctttcagttagaacttactaaattaggtcaagaggttctcctgggataaaggagtttgccaaagtaattctaaaattcccaaaataaggcacacagcactataacatttcactgattcttactcgttcttttatagtgctttgggaaatgttagaccattggtctgcatcatttcacctccttgtaggggaaaaactgtcaccagcaactgctgcttcaaactgtaataatcttccaggttcattctagggaatccaaaaggcgagcaccacatatttcctttcctttccacaggcgatcatgcaaattccctagcttaaggctgagaagtgcgtatgtgtgtatacttatgtatattatgtatatacagcctatggatattatatatatatacactatggacaatatatatagtatctatggatattatacatatgccatccatggatattatatgtgcataatctacgaatactgtatgtagatgcatatctaatatacatacatatacatgtattcattattttatagaatcaagttgagcttttcaattactggcagatctacaaaggctgttgagatttaaaccattacaaacaattacatgagagttgtcccggagtcacagagcccagaaagctaattctaacctgctttccttcttatgtactatatacttctaattacccagcacggttaggttctcataccattttgcatattttcatccaaaaattcaaacctactccatcctgagaacaaaagctggcaagaagcactcaagtgatgggtgaacaaatgtattaaaaaaagcaacattctgacatggaaatgtcatgtgagctgccgaatggcacacagctccaaagtctaccataatattttgaaacactttgccaatgagcatataattgactgaaaaacttgccagcactattccagagatgtttaaatactacataataaaacaatttacagaaaagaattaaatgttagaagtacatttttagaaagcttccaaaaccaatgtgtgtgggttttttttttttttttttcccattttggagccaaagaaataactctgatattctcagttctcacactttgccttccatatttgacctgctgcctatcacttgcatttttgcatagcagtcacatcagtcagtaataaacctgtatttattgagaactttagaagtacagatatcttggcgcaaattgctataagatcctgcctcatgaggtcagcatctgtgcttttttatgagcatttttccatccatctatctttctaacaagtatttattaagcacctaagatatgtcaagtattgggttagatgccagagagataatgatgggcaatataatgtgactgccaccatggagtttatagcctatctgggaagggtcacagttaaaggaataataatcataatttgtggctgggcgcagtggctcacgcctgcaatctcagcactttgggaggccaaggcaagcagatcacataaggccaggagttcaagagcagcatggtcaacatggcgaaaccctgtctctattaaaaatacaaaaattagctgggtgtgctggtgcaagtttctaatcccagctactagggaggctgaggaagtagaatggctcgaacccatggggcagaggttgtagtgagctgagatcacgccactgcactccagcctgggtgatagagcaggggaagaaagggtgtaaaacattaaaaaaattgttttcagaaaaacaatggctggtatgtagagaaaacaaggggcaaagcggtaagaaaaaagaccggagaggtgagcacaggctgggactattactgtttttctaagatccattctttgcccttggtcactcttctatgatcatttatagttttaataaatactggactgggtaactaacaacacatcctgaagtaataatacacaataaaactattattccattattcttaacacagacttctccttgtaacccagtgaatcatctgtaacaaaacccaaagcaactatatatctattccacaaggaaatttttagtttttttattaatagatgataggtcaggctttatgaccatatctgcatttgtgactgacatttcctttatgagatttattataatgaggacaaataatacaaaagcaatacatttaaaatcaataaaaaaggagaaaaatcataagtactcctttacctttcaggaaaagttaacccttagctattaatcacatagtttaaaaaacaatataggtttcaaagaaatataaggatctcaaaactatgattctgcattaatttattgtataaatgttttcatagaaaacatcaatatttaacagtgaaatgtatatattaatgcaatgtttgtttatgttcaggtacatttatatacatatttgcatgtgcatttatttctgtcaataggcagttacaggagcagtaataattagcttttattcttgtgggttaagtagaacaataatatctatctacttcatgttcacttcttgagacaaagaggcaattttttatttcagctcttttctttttgttggattctattaaagttgaggtagaataaaatacaattcaaaccagttttacatatctttaatgtgtaattgagagttttttgtttttagtcctaaatactttggctccatcacagtaagtccctatgggtagctgctaaattcttaaaccagaagcaattatatttcaggaaagagtcatttaaatgtttgtatctagcaccaaatgtatttttgtcttaataaattataaaatgtctttcctctcccttattttttctaagtccaccctttcttctctcttgactttggcatatgaacttgtacttgtagccaaacacatcagttgagctgggagtattatcttaaacagctggaagggaatgatgaagatgcttggccagcccatcacccagccagccttcctctgtttcctccccacccaagttctagattttggcttcacccaatccaaccagcctcttctaattaactcttccatactcagttgtctaaagcgatatggcaaaacttactgccagtcctattttggattagtttgtagaatatttgtgtctttacaagtcatacctttacaacagctcttgttatatgaatattctacaaattaactcccatcacctatgtctgctgagcattggaatattagttggactgtcaagatgccatagaggagacaggtggtttctatggagaaaagcagctagctgccagaggtccagctccaactgtagcccccccttcctaaaataaccttgtcaccaggattgaggctttctatatgccagattgtaggttgaggcacccacagtttcaacaagactacttagctatggtagcttcatcagtaactttcagatacacattttgtttcattttcatgggaatgcaacaatattaaccccacagaaagaaatggatgctcagagcattaactgatttgttcaagtcacgcaaccagtacacggcagaggtgggaccaaaacacaggacttctgagtgcctgtgtgtcatgtactccaaaacagcaaagtctttggcaatgtctctcaaaaattctcagactgtatctgcataaaatcgctgtgggtgatttttaaaatgcacgttcctggatgcagtcaagacctaagaattacattctctgagagtggggccaagaatctgcattttaatgaggtccctaggtaattttcattcatagtagagttacagaaaggctaagtcttttcttctattcctaaactttggagtatccgtttttcatcagaaatgcttctgggatctttaaattaattgcctgggttgtcttaggaacaagtcaaatacttatataatattttctacatcctaggtcttgttaattgattaaattctcacaacaaccttacaaggtagataatagtattacaatactcatgttatagataaggagacttaggcacagaaaagctaaagggacttccctcaaattacacacaagatgtgatcctgggccatctggctccagagtccatttgtcaaccactacactatgctagtgctacagcttcaaacaaagaatcacagtcactgaaaagtgctggagagcaactgctcgtggaaatctttgctctgagcttcatggaacagatcagagttcctccaggatgtcctgctccatactccaatgccttcacagctgttctccctgctaacatgccatgtatgccctcctaatctgacaaaacctggacacttcctggatgtccagagtgagcctgatgtccctcatttttgttcccagggcctagtgcacacaagcctcctggcactaattatactaacctatacctgcaaatctaagcctattttccacaggaaactagaacttcctaagggtagatattgagccttatttattttctgccctaagtatctagcagtcagcgggaactccatagatgcttgtggaataagtgaatggtggaatatacagtaaagaatggttattccctttataacagaatttaccaaaagtttctgaatccctgtgttcattgacatatcattaatgtcttgacagaaagcctaaaggactgaaaggtaaagccactgccaactggagatcaatccagtatcagataaaacatctttgaagtcatgatgtaagtcagtgggaaagcttctacgggatctaaaaatgtgaattagacacagcttttcaaggacactcctgttgcacaaaagggagtgtacacgttagagaaggtttgcctcagtgctatcaacatgtaagcagatggggacatgaaacagcttgtgaattcagtccttttctctccagctggcagaagcaaggattttgagaactctgctctcctgtctactgaaggatcatgtttccctgctctgcaatgaccatcaaagccatctgggaaaaacaaaattcttttgcacaagaacatagggagcaacagggaagaacaaagctgcagtactttggttctttggctcccgcttctggaaaactctagttggtattttatctagcttgttctctcagtggtgtagtaaatcaaacaggatagttgcaaaatgttctacagtgttggggaagaagaatttcttacatgcctagaaagccaccagggttgtaaattaaattcctcaaacaaagcagccccaaacacacagaatattagcttccccattttgtgtagttttctaagctcttgagattgtgtacatgttaaacacattcactgccattttcttccttgaaaaagattttgagttttctgtcacatcaaagaatgtatatcaaagaaatacaaaatggaatttgtgattagtagaaacagagcatattaatttttccttctaaacaataccctaagatgaaaacaggctaaagccattatgctaatccagtgatggaaggcacagattaccacacaaataaacaatgtgtgttacagaatacagactagagtgtgcctcacaattatattttatggtggaatatatgtttacggagcttttggcctggtcatttaagaaaaatgtccttaggctgggtgtggtggctgaagcctgtaatcccagcactttgggaggccgaggcgggtggatcaccttgaggtcaggagttcaagaccagcctggccaacatggtgaaacccggtctctactaaaaatacaaaaattagctgggcgtggtggtaggtgcctgtaaccccagctatttgggaagctgaggcagaagaatcacttgaacctagcagttggaggttgcaatgagcccagatcgcgccattgcactccagcctgggcaacaagagtgaaaccctgtctcataaaaaatgcccttaagtttgtaggtctctacaagtttcatgtgaaatatggagttctgtgaaagccatatctcatggaataaatcccaatcaatgtctttgaccagaagttcaggagtgagtgccctctgcctatggtcacaggtttaatcaactccagtatgggccagttatctctgctactatggtctgaatgtgtgtgtctccccaaaattcatatgttgaaatcctaacctccaaggtgatgttattcagtggtgcgggcctttgggaggtgactacatcactagaatgggattagtgctcttatgaaagaagcccaaaagagaaccctcattccttccaccatgcaaggacacaactagaagctgccatctatgaacaacaaagttggccttatctagacattaaatctgctggcaccttgatcttgaactgtggaaaattcagttgttcataagccacatggtttatggtattttgttatagcagcctgaacagactaagatgtctgctctgcccaacagtcaaagaatgtactattatttccttttaacatggatcctatgggacaattaggcaggaaacatagatgcttgttcaaagaaacagcatccccaaaacaaaaccaatctaagaagtgcattcctcatgaagaagaatttatcaaccatattaacatgttgttctctcttttaaactcctattttttgcttctttttattcagttcattctcaggaagtgtgttgtgagaacagatctaagccaatgtaatcatcaatattatcaatattaggttccttctggtaggtgagatacgtgggtctcctctcccataccttactaccaaatttgtcatacgttcaaatgtctattagcaagcagacacagcacaggtaatcagttccatgataattcactgtctctgttcttttcagtgccccccagcagtttgcatcaagagctcaggggaggcagatgcgttgatgttctagtgcaatactcagcattattttagttactatagaacaatcctgcaagcagaatggtctaggctataaacctacagtgatattagaaaggtgaccagatttccagacttgtatcactagattcccaaattttgttcatgcaatagtacagaatccacaaatcttaaactccatttaaccattgtaaaaaaaaatacatttctaagtcttctttgttgatcagatatgttgataattgaaatgtttatggtaactacctcatgcatctttgaaatactaaacactctgaattgaatatcctcaattaggtgcttcagatattggtttaccatctctgagagatagaataattcatgtgtaatacacacactccacagtgtccacatggaagaatttaaaagtaaattacagaaagtaaaaacaagtggaacctctatttttaacattctttcattaaattcagcatcaaaatgagtgattccaggaagtacatgacaaaactctccccacccatgtcaagagtccttagcaaatcttgtttcctttctacagtatgtgaaagcctggggatccagagagcatggatagagaacaacaacaacaaccctgagcattagttccaggtaggcaaataaccatacaagtccatttagtttggaatttttgtgctaaagtttccctaagaggtattgtcagaccaactgagatacatattagttcttcctcagacaagtgcaacaggttcaattcggttgagttaaataacattatggaatacatgcttgtgtttctcccaatctcaccatcaaccttatatgccagctttgaactattggcttacaggactgcattaatcacatgcctgcttaaaaaaagtatttgcctactaataagaaacaaattctttagcctaaaaacaaaacttcaacctacctctatagcctggttggcgactgctttgaccatttcttcccattccattgagaatgtcagtgtgagctagtctcaataaccaaaatgacttttcacacctctccaaggatccacccttagctagctctgaggatgtggtaaattaatctgtctcaccacagcacgtggcagaaagcttatactggatgttggtctggcagccagacaaactgggccacccaaagaccaggagaccccagaccccaggagtaggcctgaggtagacaaagtagctagtcagcaagagaaggcagcaccaagcaaagaaagtccaaggaactctgaatcccctgcgatcctctctgacttaccccgtgaagcctgaaatgtcttgtgccataagcaaccttcttggcagtcccagactcatattcaaagccctcgtcaagtttcctctgctctctatgcccttgatttagactgcagaattggtctggacttgcagtgggtttagtgtccctcccaggtccccagtgacatgtattacatctccctccttgaatgctttaccttgctttttaagtatttactaacgtaactgactcctcactgggctatacatttcctaaatgagcctgggccccattcatcttagtgttcccagaacctagcaaagtgcttagctcatagtaaatgcttttaaaaatgttcatcaaataagtgaataaataagtgcactctagtttagaaatgtaacagcacttcctcattactgcatagcttgttgatctagattctcattatcatgaccctggatagtacccattctcaaactcttccatagtggatcagaagcaagcccttgagccccttccccaacaaactttactggaatgtacttcattatccctggttttcattatccttggtaagtacaacagtcaatctgcacacacacacggtatcttgatgttttaattatcttactaataaattccctgaagtaaaaggcatgtttgtttgtttttcaattttatgacaatgttttatttaaattcttaaaaactctccggtatcactaataaataccatatgcaagaaactaggctagctgggtggggcccaaaaatgatatgatatcatctttcttttcacagatctttttatctacatggggaacaggatatagacccatgaactgaatcaccatcacacgaaccatgcagacagaggattagggaggctttgccggggggcggccactggtcaggtagagatggcatgtgaggatttgaaaagaaagtggtactgagacagaagacataatttaagcacttaaggtcaggaaagtggcagcaagcaagtctaggctctaaaatgctttgcagcaaccccagcagtgagcaagaagaggccgggatcaggcccagtggaaaggctgggtcgaaacaggctctatttaagatcagtggtggtcacccaccatatccaaacaatatgattcttccaacttagctaagggaagggagtaagggaagcagggagggaatgagggaagctcttagtgtaattacttgtagaaatttggtaatatatgtacactatgcaggaaacaatggtttttccttaatatagcaatgcatgaggacatatcactatttttcaaacaaaacccagaacagcatactcaaccctactctcttatttggagctgtgtgaaaaagtaaacttaacttttgtccagaccttctgaataaggtaaactgactcatgtctagaaacaggtttttttctatagtaagagaataattaaattttatattttatgaatatattattaaaaacaccaatcaataaactccaaaggatgagttcaagtttagaccaatgagatagccaccataagatgtatctgggtacaacccgatgtgatgacacatattgtgcagggtactataggcccctagagagcagcagccagtattatccaaagactgatatcagaggctcatgtcaggctgcttaacaaccactgagctgggctgggtattcccgctctcatcaagggggactgtgtccaaatcccacataaggagggctgcaaagtctcccctataccttagacagactgcacacaagtcaagtcctttgatgccaaagtaattttgttactgagccctataagaccactctcatgtccttccccctaaaaagtaagagatataaaatatactttgccctggaaggtccttgcttggagtgaatgtaaatagaaggctttgagtgcaaagacctactgaaaatataaatgttctaataatgatttatttgtaagcctaactcttctactggactgggagctccctgaggtctggtctgaatggtgtctccaaggcttcattcagtgctcagtggacggtgtaggctcagtacatgcttttttgagtatacaaaaaataaatgctacaaggcaggagagtggccctaaatgaaaatttgagttttaaagttgctatggcatataagtacttaagagacactgcagaaactgtatagaatcatgtatagaatcatgaatagaatcaatcctacatgtataacaatttatttgtagacaagatcataggagcagcattgtggatatcaaggtgggctcactttctaatgtcagaggctggtgctcattggagtgtgcctctcagtcacatctagttcttgaaatctgaggaaaaactctatttaaaagtagagagactgaaaaaaatgagtcttggattagctagattcagataattcaatatttttactactaaaccacagagatctagattactagggaacagaaattgccttgaattaaataccactctgggtaagctagtattggcttaatgagctttttgtgtactgggcttaataaaaaattgtattagtcattttatacaaatatagtggagctgatgaattactcataataaagaaaaataacccctaatccattttaataattcccatatttcaaaatacagaaatttgtcctcaagcacacagaatcctagatgataatacaggcccagagaaatgaagtgagttgctaaagtcacataactaattaatgaaggagataagattggaaccaaggtctcgcaacgccttgtctggcacacttctaccacatcagtgatttccaaacagtgccctgtagaagcccttcgaggatcctgggacagcaggtgagggggcctggcaggcacagttcccctctttgcatcatgctgtcttttcatgcagacccttgtgctttagtgcactggtacccagatttgtggatttcatgctactgtaaaaaaataaagaatgactacatacaattactatcatgtcataaaagaagggatattttaaaactcaaaacatttggaggagagaatcttggaataaatagaaattatttataaaacacagcatggttccacatttttctcatttcactaagaataacaggaaaaaatcctcaatgtggaaagtcactgttctgtagaccttcatttgggaagcagtggttttgtggcaagaacatagaatttggatttcaaccacatcacagtagcagtgcatcttgaatgactcattttaatttctaagttttgtttcttatgtataaagttcaatagtaattcctgacacacaccacagtccctcactcccatcctctgcaagagttgctcctttcaaagatatctacttctgttattctcaaaaggtgggctcaggactacttgcatcagaataatctgaggtgcatattaaaaacccaagttccttgaacctaacccagatgaggtttccaagaaatggggttggttttaagtggtttagtttagaaggcacaaagcctgagttgttattttttaatgatagtttacaacatctgctctaattaccagaggctgatggtaagattatgcagataaaattcctttggaaaactgcagcaactataaaaatagaaaacagagaataagggaaaggaagacaagaataaggactaaagagaagatgcgaggagggcaaaccatttattcttaaattagttttcttacctgatgaacaaggactgtgaacgggatcaatgactttttaaccaccccattagcagctaaactattttcaaagaaaatcttttaaggaaataaatcttttaagaaagcaatgtcttctgacaaaggcagagttgctctagtagaagtggcccagagttctgtcccgtcaatgccctatctcattccctccatcctcctggtagcctctgaggccccctatgctagaagataatagaatgacctgcttgctctctgaggtattgttctgattccagagaaggtaggtctaaccattaactaatgctatgtattttaatataatcaacacagaaaatgtagccacccaatcaccagattctccctgaaaagtgattcacgtgcaggacatcttaagcagcatggcacaccacaaacatgatcaataagaaggtaccacacttaattttttagtccattactgttcttcacctaacacagaggttctcaccaagtaatctgctccctttctttcctcaccggacccatggaatctgttgcttcctttccatcctccatggctacagccatcgtacaagtttcaggaaggccacccaaccaccttcttcacatcatcctagccttcagacccctttagtccatctaatatcttcttgccaactcattgtcttgatagtgacatctgaaaacaagttctcaccccatggtcttcatagagacaattccaactcattaaccccagacactcacatttcttagctcctctcattaaaaagcacactggtctaggggtctttttgagtcatcagggtccaagctcctgctccacacctcacacacgtgttcctctccaggctcctatctcaggagatgacagattccaccactcaccaaggtgttgagatcaaatccttatagtcactcttgacatgtttacttctctcaaatccccatcctacccacatgtatgaaacaaggcccctcctcacgccctccaccctggccaccatcatgcctccctggcttgctctctgctcccatcttcttctacttttcttcttgctcagctcactctgctccagctccctagccttcttgctgtcctccaatacaccaagcacattccagtttctgggcctttgtacatgcctgttcctctgcctggaatgctcttccccaagatgtctgcatggatatagccctcttttcattgaggttctgcttcaatatcactgcttcagagaggtcttccctaagcaccttatttcaaagagtgcttctacaactctatctttaccctgcttaatttttcttcataacatcaccacctgaaattcaattatatatgcatcagttgacacatttattatctgattccactctcatttgttgtggagcagcatgaagtctgagtggtaactttgtttctgacccagtgtcaccgatgtctagaatgatatagggcactctgaaggttttcaataagtcaatcactcaattaaacaaaaatctaactcatctttaaatccctcattttatcaactactccttcacatttaatattaaataatgtatatttttaaattttttaaattgtggtaaaacacacttaacaaaatttaccatcttaaccatttttaaatgtaccgtgcagtagcagtcattgcattcacattgtgcaagcatcatcaccatccatccacggaactctcttcatcttgcaaaatggaaactccacatccatgagacaataactccccattcttccttctctagcccctggcaaccaccattctactttctgtctctatgaatgtgactactctaggtacttcatataaatggaatcctataaactacaaatcattatatgcaaaacttgaataattctctttaaaccttgcatcaactcaattcaatttttgactggcttatttcacttaacataatattctcaaggttcatccatgttggttctttggcctatattcccaaaagtagaactgctggatcatatggcaattctatttttgtttttttgaggaactgtcctaccgtttcccacagcagctgcatcattttgcattcctattaacaatgcacaagggttccaatttctgtacatcctaaccaacacttatttggttttttttgatagtagtcatcctaacaggtgtgaaatggtatctccatgtggttttgatttgcatttccctagtcattagtgatgctgagtatctttccttgtgcttattagccatttgtatatcttctttggagaaatgtcttttccagtcctttgcccattttttaatcaggctgcttgggtttttgttgttgttgggttgtagaggtttttagatattctgggtattaaccccttatcaaatatatgatttgcaaatattttctcccatccagtggggttactaaataatttatattcttcattttttaagttggttggttctcttaatctatccataacggtttctactttggacagtgtactcacagagaacagagatggtgcctgttgatttgatccatgcaatgcttaacaaacaatgctctatgcaggctggatggttaaagttttttgaagattatacaacaatatagtgtactatttggtatcacttttctttcaatagtggcagacaaatggaagtacaactgttaattaaaagcacataatgttgcctgattatgagtaaaatgtcccagctcactacagcacaattcctacagcattagtggagaattaactagctttattaaagatttggaggactagtcactttttcatcatcctttaattaaaacctccacatcttccacttaaaagcctttgtttcgtacccattattttcattctttattctggccttgaaaaaccaggatgaaaaacagtaaaagcaaaaacgtttctaaatgagcttttcatgctgtaataataaaaaggcatagctttctaaaatactgaaaaaaaataaaattttaatgttctttgaactagaaggccaggaaaagaaacagagaaaagcagtgtttagcagaacattttggagttcaatgttcttttatattctaaaatgaattaatgctactatataatttctctctaccttcccactcacactaactgaaagataccacagttgaggggtaccagttcaaggtcctaaagtggaaagctattgttatactctagcctactttacttttttcttaacttggaatcattatttattttgaagtaaatggcatgatgcagtggtttgaatgtgccccctccaaaattcaggtattgaaacttaatggccaatgtgataggattaagaggtgacatggtcatacgggcttgttcctcatgaatgggattacggcccatatgaaacaggcattacacagcattcggccctcttgcccttctgccgtgtgaagacacagcattcctcccctctggaggatgcagaaacaatgcactctattggaagcagagtgcagccctacagacatcaaacttgccagagccttgttcttgaaattcccaacctccagaactgtgagaaatgaatttatgttcttcataaattacccagtttcaggtattttgttacagcaacactaatgaactaagacacacggcaagacagaacctccctcaacctcagctccctcctcccgaagatccacgcataagggtgcccagcacagaccctcacaaatatcagacacttaataataaattaataatttaaaaaccattagctagaatttggtggatgttctgggccaaacctcatactgtgtgcttcatattcacaatgtcacaacaactacataggcagctgtggtcacttgatgaccactatacaatgttacacttaactgcatatttctccccataacttgcccaacccaagttacagactttctctcccctaaaaatactagaatatgctacttagggaaaggagaacttgattttttaaaaaatatattgattttggagcctacatttctaaatctttgtatacagtttatagagttcattacatagctaatttcagctcagctgagaagaaatctaaaaataatatgctttttggtttcgtcactgaaacattcattctgtcattgaatttagcctgatgcatcttacaagaagaaaaatctgatataatgtgtgtggaaaagaatttgactgatggaaaggaataaaagtgagccagtgcaatgtctataccagaattattatttgtatgattaaaacataaagacacctgaatttatcttttctgcttctgctgtttcagtctcattaagactatgtttctgctttcttctaaatattgttttccatatttcaaacatctaattaagtaaacacaatacaaagtgagatgatatactgtttggaaaaccataaaattatagagtagatagacttccattataatccaattttcattctgtcataattttccaagagagtttcctttggggttaaaattttctaagcttgatttcagttcaaaattgaatgttttcattcacttgtatgtagaaaagactcaattcagtcttttctgttgatcatatgagtgtgtttcctttaaaagtagacaaggcttaattttgttgatgaaacctatgacagacttctagacccaccttactttcaacttcttgggcacttaaaataattacttaagtaatataaagggtacagaagccaacagagaatatgtttctttgccttagtcctccagtcctaccctatgtacaacgtgcccccagcatataccctttgtatacataggactgttgtcttaccacagaaactaagaactagaattgttggatcaaaaggaatgcactttttaaatagtaatatatgctgcccaactatcttccaaaaagccttcactacattattataatctcaccaaaagcacatagatgagaatacctattgcctatatttattaacactgaatgttattgatctattgaataaaaagttatcttaatataaaatttcaaaattatgagtattttattgtccatttaaaaaattgtatctcttatcttgcctttgaatatttatttttcattttgctgcagtagagctgtaagttattctttcatagaaggttttgtacctctaaaagtattttgcctttatgtttgagaatcctaggttcaaaaagttttccacgagaattttaaagtcttgtgcttcactgtattacagaatccagggcggccaaaaagaagtccactaacagaatcctctttctttcttaggtagattttttaatatataggttatttgtctttcatcatgctgggaaagtgattgacccacttaatctgaaggcacaaatctgtcttcgatttagagaaattatcttatttatttgataattgccttgtattttgagaggactgcttcaatttctcaagtaataatattaataatgataacagaagctaatatacgttaaacgtttctgcttgttttaaatattttacatgtattaggtcatttaatcctcatagaaaccgtgttacagtagcccctccatccttagtttcacttttttgcgctttagttacccacagtcaaccacagtctgaaagtattattgcatgctgttctgagtagcatgatgaaatcttgcaccgttccacccaatatgtgaatcctcctttcgtccagaggatccttgctgtaggcactcattcccagttagtcacttagtagccctctcagttgctaaatcaactgtccttgtatctcagtgctactgttaaagtaacccttatttgacttactaatgggcccaaagcacaaggtagtgatgctggcaatttggagatgccaaagagaaactagacagtgcttcctttaagtgaaaaagtgaaagttcttaatatggaaagaaaaatcatatgctgaggttgctaagatctatgctaagaatctgtttgtcaaattataaagaaggaaaaagaaatttgtgctagttttgctgtcacatctcttcaaactgcaaaagttatggcctcagtgtgtgataagtgcttacttaagatacaaaaggcattaaatttgtgtgtggacgacatgtacagaaatgagttccaattgacagcaattgggtttggtactgtccgtggctttaggcatccactgggagtctcagaacacatccccttggttaagggggcactactgtattcccattttacagatgaagacatcgacagaagctaagtaactttcctaaatgatactattagaagcagaagtgccaagtttactcctaggccaactgtctctaggccccaattatataagccaataactaaaaattgtttgcacagctattaaaacaacaaactatgaatgcagctgtcacactaacctgtccaatccaggtagtctgagtttaaatgccaagaatgcctctgactcaagatccttctgaatcagtgactaaagtcagatgactctcctgtgtacatatgctgtttcaatactcatctaatattttatgttgcctgtgagtgaaggttaccttggagagaaggggaagcaactaaacaaagcatccaatgttcatagtatttcaaacaatacctatcaactttcataaatggtcttattcaatggagatagcaagtttgacattgatattgttaagaactaaagtatatgatcagagcagacaatgtatttacaggatttatttcctgatagaaggagtagaatttttccaaaagaatcagagctgtacaaaggaaaggtgcttccatccaattatttcctacttgtcatctctgataggaacccacctgggggtgatctgcagagtctacctgtgttaaatttcttcacatagagctagctcatcatgcaagtggtactaagaaatgaaaattatatggcttagaaaatggtttagcagaatgccaacaagcagaactatctcatgtgcagatattatgcaaccccaggatttgaaaatagttacctttacccactagtcccatgctgtgtgtagaataaaccaggttgagaatgatcaaaagttaacagattatagcaacaatatagttatagcaacaattgtataaaacaaaactgtgtctaaattgaaagtacctctggctacttttaaatcttcaagaacaggaatttgccaaatcattaaaatcaaattagcataattaaggatctaaaattgttagagtattaatgtgattacatttatttaaacccagttaatgaaaaattactgttacacccttttaagaaaaaaattacattaaattatatcattgggtaccatttagattagccagttaatctcaatataaccaaaatctgtatcagtaataggagtgttagtaatttatatataattagaatgaaagctttttggccataaacaatctggggaagtccttataaaataataagtgggaaaacaaattgtcctactctataaaagacattatgcaaaatataatacaaaaaaactaaaataatataatacttttttttacaagaagtaaataatactttttttttacaagaagtaaaaatagtattattagggtaacagtactgtaggaggttttatactttccttaaatttttaatttaaaaagttttaatctacaatgaactcaaacaaatttacaagaaaaaaacaaacaaccccattgaaaagtgggtgaaggatatgaatagacacttctcaaaagaagacatttatgcagccaaaaacacatgaaaaaatgctcatcatcactggccatcagagaaatgcaaatcaaaaccacaatgagacaccatctcacaccagttagaatggtgatcattaaaaagtcaggaaacaacaggtgctggagagcatgtggagaaataggaacacttttacactgttggtgggactgtaaactagttcaaccattgtggaagtcagtgtggcaattcctcagggatctagaactagaaataccatttgacccagccatcccattactgggtatatacccaaaggattataaatcatgctgctataaagacacatgcacacatatgtttattgtggcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaacccaacaccgcatgttctcactcataggtgggaattgaacaatgagaacacacagacacaagaaggggaacatcacacactggggcctgttgtggggtgaggggaggggggagggatagcattaggagatatacctaatgctaaatgacgagttaatgggtgcagcacaccaacattgcacatgtatacatatgtagcaaacctgcacgttgtgcacatgtaccctaaaacttaaagtataataaaataaaatttaaaaaaagaaagttaaaaaagttttaatttttaacatgttaaagactgaataaatagctctgttaaaataaagaaaaagaagaaaataaaatggtattattttctatccagtttaacattttggtatatacttttccagtttttctctttattattcatatttttaatttaaaatctgtaactcttaaactataatgttaataacaattctgttcctttgtcacttaacaatgcactgtggactttttttacattttaaaatgttcttctatgacagtggttctcaaagtatggtccacagaaccctagatgtccctgatagatccttttttatggtctgggaggctaagtctattttcataatactaaaatgttttttgccttttttactgtgttgacatttgcaccgatggggcaaaagcaatggttggtaaaactgctataagattcaaaagaaacaaggcagattttgattgttgatgtagtatcaaagaacaatatccaaagttatctgaagaaattattaaaacactcctctatttacaactacttatatttctgaggctggattttctccattttcctcactgaagcatcgtaacaggttgaatagtaatgcagctacgaggatccaaatgtcttccatcaagccagagtaagacactaaaaagatctgcaaaaatgtgaaaggatactaaccttcttgttatatgttttgttttcaaaaatatatttttaaagagtatcttatgttaaacaatgtgttttatttttaaatgtgtaaatatatatacaaatatattaaatatatatattaaaattttctattttcatttctaatacagtattgatggatataaccacatgaacaaaagctttttgaagccccaaataatttttacgagtattaagaagtactgagaaaaagtctgagacgtgcagtttataacagcacttttacagaaagcacagtgatctttttcatggacatgccttaatttatttagccctggaatatacatacatttcttgaaaacgaggactactacgtaaatcctaaagggcctggtgagaaatgtgcacccggtgagtaatgacctgattttggagccacagttcatggtcatcatatcttcccccaggaggagggctgattgaagaagaggatctaggactagataaagccccctcagctatgggtgcctacattcattctcctgctgagtttttttctcccttctcaatattttgtgtcatttttctaggatttccacagaaaaacactgaaagaagttggaatacaatttatttcaataaatcgagtattttcctttagctctcatgaagtctctgatatattttttccatttctgattggcattctatcaggtagagtcctgggtacatgagttttgtcacccaactaccttcctgtcctcactacctctgagtccatcactggtgatgcacacggcccttaatgacatggcccagtttatacgttttctaactctagacttcttaaatcagattacttacactaattaatttttaaaattagtttagaaattaaaaaacatctgcccagagtttgaaagcatacaaattctataaaatgccattctctcatgccttatattacttaacaaattaaatatatacagagttagcctcattaaactcgaatggtctctgggagacctacctaagtaactctgaagcagactatattccctaaaatgtattctgaagtactgaggaattttcattgttatggaggcgtttgagcacccattttttagtaggccaggatatccttgccagaatgctaaagagagtagaactaaatgacagtacagccatgtaaggttctcaaactgtgaacattgatgctgtttattccgtaatttagtgtaaaatgagtgtgggaatctttattagtgattttcaagtgcaaaagttgaatttgtcctccaaaaatttgcactggcttttactgttgtaaaccaagccacagcctccttaatccaacataccctttccgttgtatgagtccaaccacaaacacactttagatcctcaagaaataatttctcaagaaaacatagtggagtaagtagcaacccacttgggtccttaaccaggctcctctgggcctaggataactgcacctgggctacaggcttgtgttctgaagaacaggctcagtgttgctggcaactgctgagttaaaatttccaaccaccacactcctcgtccacagccctgatgtctacccctttcctctcccagaatagttcagtgatttccacaccaggtacagagtctgatcagtttccagggataatattttaccttctctcactcctatgaaaaaaggaaaaaaaacaactgttcgctaccccatcccttaactcctagagggtaaagacaataatgctatcacagactgaagacggtaggtgtacctaggctaggtcttctagggattgtggaaaatgatgcttttagtctctttgcaaattacaatattccaagatgaccacagtaggaatgggtgctcctaaagcgcagatgcctaaggtggtctcttcagtccagtatttgtcaactggcaacaattttgctctccaggagacatgtggcaatttctggagacatttttggctatcacaatggggctggggggtgttgccactagcaactagtaagcagaagttaggggtgctgctaaatacccacaatgctcaggacagaccccaaaacaaggtattatttagcccaaaatgacaacaggttaagaaatcctgtcccagtctgatgtcaaatgcatgcttctggatccatggatttaaatgaaaatattgcttacattacttgatagttcattcaattatttgcattcatgtacagttttcattatcagagatctgagcctggctctaacatctactagttgtgtgacctttagcaaggagcttaaacactccacacctgatctatgaatagggaaaataactcctccacacaattgtcatagagattacactacagagtacatataaagtgcttagtgagtagaggttagctgctgctgctatcattatcatcatcattatcatgaaagacttaataactactaggtgcctgacactatgtttagaaatacaaacacattttcttatattctgaaaatacaagaaagaataaagacttagaacctatcactaaagaactcacagaaacacctagctgagcaaaaacatatgagaagacctatctgactatgtagcaagatccatcttttcatttgcctctagcatcccaggaagcaatgcttggccctcttgggtcttcttataccctgccttccagtacctctccccccatcgttaactcaatacactgtagtacttcaggcactttgtagcaaagagttactctcacaaaaagagaaaatagcaagctagtgaatgacttctcgtggacctcagaaaggacctcagaaatcttcaccaagttcacgattcaggtgttaaaagtttcagcccatgagcagcacacggtcagcacatatcatcaggctacttgctccccatggtatttttgggatttgtcaggtagaaactcttaatttagaagaactaagcatctttcaaggaaaaaaaaatccctgctaaaatattattcataatttattttccttattgtatcaagtgacttttacttatccttcttatatcacctgatacagttccactccttgttctgtgcaggaaagttttaatttgcacatacacattataatttgtaactgtaagaatgactgcagcgtcacattcactagaataatggcctgtagcataaataaataggggtcataagggaagtatatgccttaggagaatatcctttaagctgtgcagttcagaaatgaggttctgtcttgcaccgttctacacattcagcggcaggaaaaattacttggaaggtaaaagccctattaaatgccatctttttttgttgatttggattaaacccaaatgattatttttaagttaatgtaaaaacactgtggaaaaatgaatcatgttttaattgctataatgctgcatcatttacttaaactagaaatgattggtgaatctggtttggtggtatgtcccaaacaagccaattagtacagagattaacctctataatcactctctagccgattgctttccataattttttcataaaatttgtttgcattcatgtttttgaatgaagcaggtaactagccttgcattttagaattttagtcctgtttcatagaaaagtttacaatatttgctttggagaaatttattgctgatttacttgcatgtaatacaaaaatcccatactttgctgagaggcttcaaaccataaaaggacacaagataattactttttggactatttaggaagcagggagtttcacttaaaaaaaaaaactccatggtttctcaactctataaatgcttctttaagaaaaatatacattccaaaccagaatgataaaggaggcacagaagtgtctgcatgacagccttcttccttcaaaatacatcaccaccttccataacatctgctctatcattttggtcactcacaaccttatatgctcagaaagaaatatttgtaagatctaatgtaaaaagtgcccagctgttcacccttatgctggggcagtcctagtggtatatttgtcctgtatctaaatggatgctctatttgtatctgtctctatcaaatgtatcagatacatatggaggatataaggtggattatctttagaccaatttacataaaaaaccaaggagcttcctcagatggaatggaagaaaatggagtgccaaggaaacaatctgcttctaggacaagacacaatgatgtcagaaaaatgaagtaatggtgaaaaaaccacacataggtaaagtctttgaatactgagagactggttcagtgggcactcatgaatcctgggcagagaaactgcaataaatgcagagctaataattcagaatggtttatctgaaatctcagtggggcactagaaaggcatgacgttggcactcatccactgatgggagataatactcattactgagctacacataactgccactagatatggggctctgtcaccatggacgggttatcagttgaagtcacaactcccagctaccaatgacaagtgaaggcacagcaactggaaaccttcccagggtagaaggggaataacttgctggtgattagtggtaaataagaggcctcattcacagaatgtatgtgagacactcactggagtctccagagctatttgggaggaatctgagtgagcaagctgaagccaaagaaatgctgttttgtaactgttactgtgatttgtttttatccccaggatgaagtggcttgggaaatacaggaaacttgcagaagtaatgatgactgcgataatagctactttattttctatgtagttctctgcattgtttctgtgaagtaagacaactatatcaaaatatttcactgaaaattaataagctctcaagtgaaattataaaagatcttgtgatgtgagacacactatccaaaagtactgaaccaggtggaggaaactgctgaaaatcaatgtctcctctattttctcacgatataccacagacagagaacattacctagcttattactgattggaactaaggagtagaaaaagcactatctgatttccctggagtctcagggttgtatggggcaccccctgcatctgcccagccttctacccgggaggaacactcctcaaacatacctggaggcagaagacatcctacagggtacttagcctctgtcctgcaaccacacaatagtcctgcctctcagtgaactggcctttcctgggctaaggacccagcctctccagatctatgactgtcacagtgctcttagcgctagctgatctccctcagcctgtaccagggttcaacccatctgatcaggctgcctctgagcctagccctcctgccaggtgtgtgcacgctgatatagccactctctcaggtaatgcctaacttaacatcatgatatatttaatcctcccataaaatatttccttcatttctcttttatttcatcattttttaaaaaaccatagagaagatgagaaactaaatgtggaatggtatgtcacaggtctgaataaggctagaatgaccctaacgtgacacattttagattgtagacttggggtacacatatataaattattgtagactttggggtgggttaaataacattcagattaggaaaacttcctttcattgcttttatactaaaaattactgtatgaattaatgttgaattttaataaatactttatcatcatataatgaggtaatcatgtgctttttcttctttataaaattagtatgaaaaattacattgagtcaatcttgtgcccctggtttaattccaatttgctcatgtattaactatttaatatattacttgctaatgttttcatcaggattttgtacttatttgacataaagttgttaatatcctcttattatatttctaatgtctgcaaggaactataatgatgtcctcctcttttttcattcttaccacctggctatagttttagtctcttctttttccttgtttgaggttgaaaatgttaatagacttctcaagaaaacatttgcctttcctccccgcccctgcccttttggagacggggtctcactctcattcacactggagtgcagtggtgtgatcacagctcactgcagcctcaaactcctgggctcaagcaatcctctcacatcagactctcaagcagctgggactataggtgtatgtcatcatgcccagctaattttttcatttttcaaggatggtggtctcgctatgatgcccagggtggtcttgaactcctggcctcaagtgatcttcctgcctcggcctccatagtcactgggattacaggcatgaaccacaacacctggctcttggctttgatgatgatttctgctgtacatttatttcttgtttttgtttctaaattttcattattttctgctctcctcgttactttccttcttcctactttgctttagtttattttccctttttctaagtttttgagatgaatgttgtttaatttttagtcttcctttgaacatatgcacttaaggctatacattttcctcaaagatggcattagttgcattttatatattttgatatgtcgacatttcaatatcattcaggtcaaaatattttctaatttccactgtgatttctcctttaacccagtatttatacagaactatgtttcctaatttttaaacatagaaatattcaagattttgctgttgttttcaggattattgttactgtcttgtagcttaaataaattatgatcaacttttaattatttataagttttcaatcctttgaaataattttagatttgctttttggctcacaagtttttttatatgttctatgtatactagaaaaaaatgattttctgcacttgtgtattcaatatctttatgtgcccataaagtttgtcatattatttaaactttctaaatgcttactaatgttttgtgtgtactctcaattcctgaaagagatatattgcaatgtcttactctctgaattttcctgtttctcctcttagttctgtcaatctttgatctaaatagtttatattattaactaaaactttgagattattttaacttccaggtgtattaaagctttcacacttgtaaaatatcctctttgtatctagtaatttttttttatttaaggtcttattagtgttagtgtagctaccatcaccctttgctaggtggagagcattagtatttacaacttatccattcttgtatattttgactttcaacctttttacacactcatattttagatatatctcttgaatgtagcattaagttggaccttatccagtcttacagtcttgtcctttaattgaaacattacatctattgacaatgaatacaattacaaacatattcgagtttaagtctaccatcttagcatctactcagctattctgaaccaagtatcagatctggttcagaaaaacataatttgtttttttccctaacactattcagcatcaacttcaaacatgtattatgaggattaaacacatttatatgagatttgtacaagtgctttgaaaatcacaatgtcctaaagccaacttcgtgttactaaatatgcttctattaaagattttccaaagatctctgatgcaggctctcgaatgcagtttcagacaagttgaaaaaaagaaaaaaaactaaaaacaagtattggcagcatgataagactcccaagatgacccttttaaaagaaagagggctcatgacctttggcatagaaaagtatgttggaaggctctcaggaggcaagggcttggtgagtttaaggaatggtaaagatgccagtgtggtgagaagtggtgagactggtgagatggctatgagctaggtcctgcagagctttgtggggttgttgactttgttagaaatgcacttcccagtatgtagtgcaatatcatggtcaggtttacattttcaattgtttattcagtcagctgtggccaaaactaattagaggaggcaagaatgtaggggagtggacaaggtaaccattcagtcttctaaaggaccccccctcaaaaaaggtggtgcctttaacttgagaaacagaagcagatagctttgagatgcctctgagggtggaatcaacagcacataagaatctcatgtggggaataagagacagggtgatgtcaaggatgatgttggtaattctaaatcaatcaacaggctgatgagaggtgtttgcagtaaatttatatctacagtaaataaagtctaatacttatagaccatttatcaaatctactgcatatcactgttgtcttatttctgttctttaatatttacaaatatcacaagcttatgaaaacctctcatagttccacactctccaaccttacacttcttccctctgtttttttttttttttttttttttttgctaaaaatgatttcagggaccagatgctgtggctcacacctgtaatcctagcattttgggaggccagggcagggggattggttgaggtcaggagtttgaggccagcctgggcaagacagtgagacctcatctctacaaaaacaatttaaaaactagccaggcatggtgacatgcacctgtagtcccagctactcagaagactaaggtgggaagatcacttagggccagcaattcgaggctgcagtgagctatgactgcaccactgtactccagcctgggcaaaagtgcgagagctgtttctaaaaaataagaaacaaaaacgatttccaataaaactgaacagtgcaccacatactatattattcttttcacaaaaggcacaatgaacctcagaggttcagaccaggttgacactgtctctaaaaaaattaaaacatgaaagtttcatcgtattgcattttcacaagaaaataaattgaaataggcagtccttgcaaaacacaatttgtttcttccctaacacaatactcgagtaccgctgctttcaaaagaagcatttctattatacaaccatcatgtttgtaattgaaataataatgtcaaatcattattgggcctgcattccatttaggttttcaagttctgagctctctccaaaataaaaagataaagtttctaatggaatcataagactgttgagtaactgaacatttttcttctttttctagttataaaagttatgtcaaaagaatccctccgaaaaaaagagaacggtttctgaacactagaaaagcttcactcactgtcgggggttccagaaaatcccctcagcaatcaatctgcagaacgtcaataacaaatgatacacttccctcaactgcaaaaacaaacagtagagatgccagaggtccctggaatttaaagcataagtgtcttcttcttttttttctttttttccgagatgaaatcttgctctgtcgttctggctggagtgcagtggcgtgatctcggctcactgcaacctctgtctctcaggttcaagctattctcaggcctcagcctcccaagaagctggggctacaggcacgtgccaccacagccccggctaattttttgtagagacagggtttcaccgtgttagccaggatgttctccatctcctgaccttgtgatccacccacctcagactcccaaagtgctgggattataggcttaagccactgtgcccggcctttttttttttttttttttctaatgagacagtctcactctgtcgcccaggctggagtgcagtgccacgatcttggctcactgcaacctctgcctcccaggctcaagcaattctcaggcctcagcctccggagtagctgggattacaggcacctgccaccacacctgcctaattttttgtattttagtagagatggggtttcaccgtgttgcccagggtagtctcaaactattgagctcaggcaatctgcctgcctcagcctcccaaagtgatgggattacaggcgtgagccacggtgccagccataagtgtcatcattcattcagactgctgtaatacaatactgtacactgggtggcttataaacaacagaaatcaatttctcacagttccagaggctgggaagtccaagattcaattcctagtgagggctcgcttcctggttcatagacggctgtctccttgctgagttctcacatggtggaagggagctctctagggcctcttttataaaggtacttgtctccttgatgagggctccggctacgtgacccaatcacctcccaaaggccctaccacctaataccatcatcttaggggtgaagatatcaacttatgaatttgcaggggacaaactttcagtctgtaagaacgagtatgcatgagggctgagaggaggggagtatgtatgttacacatggggacatggaatggggaagggtgtgaaggaaggtgaaggttgttctttcttctactgtttgttatagtgatgcttctcctggggttgagtggtaaaaagaggaaggaataaagagaggaggggaaaaattgggggatcagatagagccctgttttccaaacatcatgttttgagctattagtgaatggatcagaaacataaattgttttggtaagctagaacagaagctatcggaatatactgtatgtaatagaggtaacatttcatgaaatattttgtttcacatatagatgagtgttattgtgtgggtatatgtaaatttttgtgtgttgatttatcatataaaatgcttttcatattacggtttgtagtaaaaaatgagtcactgaactagagtatttaaggttccctgcccctgcttcccacagtacaggactgttatgttaaagacctgatgttcattttttacttgtgttttatgcctttagaacaaaatagtaagttttttctttatttctgttacccataatgatgcaaagaaaaaaaaacccttgcttctgacttttcagaaatcctgtcttattgttctcatttcatgccatgcattgatttcctgttaaatagttttcaaatctcaagccatactagatcactgagcttttaaagattatgaaaatcatctttctcttttatctcttttgtagatggtttttaaaactggcatgtgatgtggctttatttaaaaatacattcccatctacattattgtcttttttctttttcttttttttttttttttttttggatatgtagtctcactctgtctcccaggctggagtgcagcagcacgatcttggctcatggcaacctccgcctccagggttcaagcaattctcctgcctcagcctcctaagtagctgggattacaggcatgagtcaccacacctggctaatgttggccaggctagtctcaaactgacctcaagtgatctgcctgcattggcctcccaaagtgttgggattacaggcatgagccatcgcgcccagcctaagctactgtctaccagaaaaaaaagtacacagtgaatcagaatcactttcttgctgtataaacttggaaagttattcattctctctgagtgccagtttcttgggctgtaaattaaagctaatattatctccttatctagattgttgtaaggagtggagatgattcatgttaagtgcctgaccaaagttaggcactcactaaatgatattttgaattataataaaatgagaacccaagcacacaactatttcttagtaacctcatatataagcaggcctcttgttgtctactgccttgaagagcccatttaatctcctctcaccccaccaagggccaaaacatggcccgacacacagttgatgcttgataaaagttgacagaattgaattaaggggcggtgctgttgtgttttcctgatagagtacacttattgccaaaataattatagaaatcaagttttatgcccaaattagctcattaattttaggctgggagcataatcacaagagaaccgcctatctcccaaatgatccaactacaaagagaacaaaagtcaagcttcatccagtaagcgtcaccttacctggcagaggtttagcgcatctctctgctctgggaagaagccaataattgaaagcatctgctggtcaagacaagcagaacatttaggctgaagagggagtgatatttttgcttatctttaaaaggaaagaacgagttgataagagagaacagtggttttgctctgaaaccagcctgacaaactatattgaacacagaggtccgtacttattttctttcaaaaacttcctttcttctgctcccatttatacataaacaacacatatccctaaactccatccattgttttatcctcgaaattcttagccccaattggcctcactggcagcacatgctctcctgaccacacagctgcgtccaagggaggtaggggcacaaccttcaatggtatctctgctatctcaaaggaatttcagatatcattaaaacaatgtgtctgcgcctctaaataaaacaggccagtcatgtttcagtaaactgacagtcttctctaaaggaccccgaggtgtacgaagttactgagttttcccatcctaccatcttcaaagtgataaagaaaatgcaattgttatgcaactagcctttccagctgaccctagggtggcatttgctgtctactcttaaactacctcacaaaaatcatctttttgtaaagattctttgtttcctctctcatacatgcataagagaccccggggtggaggcagtgttaggatggggagggatggaccgggctcctgggaatggcctccatcagaggcctggtctgtgggccccagtcaccgtgaggggtcggtggggagtgtggagcttcccaggatcctgcctctctccctgttttctgccaagcagcaggaacacacaattcattaaagcaaagccaaaggtcatggactgagaaatagcaagaaacttccagggacttgttgattttggaaacttaatgtccacattgtgtaacagtgtgcatgttccccagggggaagtagattgctatttatgtcagaaagatgtttcagaagaagatgtctcctccaagcaaatagtatatgtctagttgttggcatctactatcctctctcctcttttattcaataaagtgatccaccttatctgagctacacagacctctgataggtgcaggggaggatgttggagggggtgccatttcgataggttggcattttctctgtaatggcaggaggcaatagaactatttgtttatgtttcaaacataaaataatgaatcagcactcgaacaagtcttgaaagataaaacgttcagtgttaattgaatctctatattgtgccagataatatttaagtgctaggaatacggtgctgaataaggtccctgccctcatagacaggtgttctagtaggaagagacaaaacagacaagctaaaacaaattttcaaagagtgataagtgctatgaagatggttaaacatggatagagactgaatggctgtggagggggcagatttcagcagatttagggaaggcctctcagatgagttggcattaaaccaaaaagtaaaggaagagaaagagctgccaagccctatcaagagcatcccaggcagcaggagcaaatgccatgcagtgatgtggaggacagtttggctgtgtgcctggagcctggtcaactacaggcacgtgcatgagaagaggtcacagggcagagcagtagggccagaccccacaggagcctggggatggtgggaggagttcctatgtcactctaactgtaaagggaaacactgagactgcaatcaaataaatctcctttgccgcctcactgtcggagccctgcttaccacatctgaaggatccatatcttccagagctctgcagattttgacagcagagatatgctcctcacacccccagcttctgctttttcattatttgtgactatcaaaacagaattttgatgacaaattatttataaataaaccaatcattaaaatatgtaagatctctcacctatcaccatacatctcacttaaccattctcatgcatcccaatgacttgaacaaaaagaaacagaaccagaaaatagtcaaaacagtacaatttaatctaaattatccttctcacaacatcactgagattgacttgccaagtcctgttcattgtcagattggattctctggaagtgagtgccttctgcaaagtatctcagacatggataacgcaggcaggactaaactgcttttcttcccatttgagttgccaatacctccctctgggccaatcgaggattattgtttcaacaatacatgcaagctaattgtttgttaagccggcccagccaaccataaaatcacaggagagtcaggcctggcccatcctcttgcctctgaactggatcacagttaatatctctgagagttccaccccaggttcacagaccaactggggaagatggctcttgagcaaactctgaattttgtttccatgaagaaaggtttctccaacataatcaactacaatcacaatttttgaaacattcacattcttaagtctgtatctgctttggtttccttaaataaaaacaagccagagataaaagtatggaaataaaatagtttcaaacagagagccctgtggaagaatgcactaacttaatatgtacttccagataaatgacaagatacatgtataagagaagcaaacttctacaaacattcattaacaatgtgtgaagataaaagttatctttgatagaaaaaggtaactgataaagacatcaaagagaaagatctgaaagtgaactttctacatactcaccagataaaacatataaaggggcaattttggtttgttttattgttgtaggtctaaaggaatactttcattttcagtagtttgtcagcaaacagcacaggaaactttactatttgaaatgagtagtctgagttaacaatagtgaccagatattataaaaccgtgttctgcctaaatatatccacaaatcttcagatggcctacaaacccaatattgaggctaaaaaagacatgacctcttgagaggctcttctagaaagtgggactctctggtactagggatatagcactgtgaaccccaaaagggagacagctctgacccccagtgcaatcaggaaagacagatgcaagccctaacttagtttacaggtttgatgtccccactgctgtgggcattcctgtccagaaacccaagtcctccccaagagagtggctagagagtatatgcaaacacaataaacctttcacagaaaaacaatgactttctatgactagaatttggccaaaggctcttcttttgagtgttagtgatataaaattctgctctaaaataatagttttagaactaagcttaaattcctgattatttgaacacattagaaaaagaaaaggagtttctatttcagaaggcatagttatttggaaactgccacagtttctttttaagtcaaaaataacaaaatttcataaaagcaaaacaactaacatccctctccctgaccctccaaagaaacctttcttagaagtattctagttccacacaatagaaaccaaattcaatgtggctgaagtaaaaacagggatgtactggcacacttaatggaaagttcaagggataaagcattcaggtatgggtagaactaggtgcttagactatgaggacctttctccatctcttaattctgctgccctctgcattggcttcatttttaagtaggttatctttaactggaggcaaaatgactatcaggacttccagatttacgttacatcatgcagcaacctcagttttataaaacacaacgaaacttcttctgggagttcaacaaatgtctcaggattgggtctccttaatctggctgggtccacatgccatccctgtggtctgctattcctgtggtctgaatggccagccctggtggcctattcctacagatgtaccacttggattccataagctaagacgggacgacccaaggtgcggctggcaggaaaggaatacaggctgacagatatcactaatggaatgtccatgtctctccctccacttacctgtttcctcctctttcaatcaaaagcctatcaaaactgggttcagatattaccttctgcaaaagcgcttcccaaattccatggaattgtttacttgaaaatggttaatttaaaaaaaacaaccaaaaaaaaccctcttcctagagtctctccttttggtgtaaagccctttctgatcctcccacaaactctgtttccctctaacactgaatttattatactttttgaaactttctgtccatatgtttgtcttaagcataatttcccaaaagacattttatccttgccatgtaggaaagtctttggcacaaaatagtaaaaatttatggaattagactgttgttgttgacagagacagttcttctctctcagagtgtatcaatcagtccactgtaatatcagtcacattgaatttattctgaaatatcaatgaaacagtctctagcaaaactcccacctttaatgtctctatcttgtaaacagaaatctgaaaactcagcaactgagaaatgcatttttacctagtcaatagaattcaaactcagacaagaatagcaaaataacaactgctaaaagtactttaaaataactcattaggaagcacaagtccctctattcaacaaaaaaacgagtaaaataactaattcatctctaacttcatttatattttcagttcatcttctgacttcacaagaatggaagttttgtattctactatgatcaatacctcatgtaaaaatagttacggcacaaaaatgcatgacttttcagatgatgttatttttaacattgctgaaatttaccattacttaaaatatactaactgcatcagtagattctagaggatactcctctgtatcttgcaaatgtatatatgctctgagcctaatgctcttatggctcctcctcagtgtccaatgaaaatgaggtagatcctaaaagaacccagttccaacatgtctggtttcagaattatccacttcaagttgaactcctgtgatcaaggccttaaaagctgtactgaattccacattcaggtcccactggttcaggagacactagtatcaaggctctaagacagcggctgccaatctttttggcaccagggaccagttttgtggatgacaatttttccacagatggcagcagggggatggttttgggatgaaactgttctacctcagatcataaggcatcagaatctcataaggagtgtgcaacctagatccctcacaagcacacttcacaatagggctctcgcttctatgagaatctaatgccttcggtgatctgataggaggtggagctcaggtgataatgctcactcgcctgcctctcacctcctgctgtgcagccttgttcctaacaggccacaaactggtattggtttatgacctgggtgttggggacccctgctctagggtgcaggaaaaggtgaactaatattaataaagggaaggtaaactaatatgagctgtgtgaggcatggtgctgggtatcctacacacagttggagccccacaatatgctattgctcattcaacacggtgtcttcctccagtgtccatcagcagttgggtgtcatactggagggacaatgggctgtgaggacttcccaagagatggtataagtagggagagaaccacatttgctgttctttatgagaaattaggcacatgtcaagaatagttttgcctacacatctttctcatcttctacttgactgcagataaggtatatccaatccttgcttgagataagatgtgactgcactgctcagtgcctcagctatcacaaaaactctgagagggttaaattattactggcccaatttataggtgagaaaacagtgcctcaaaggggttaagtaattttcccatgataatgtgctcaaaaactacaaaaactctcctccttacaaagtttctaagacttatcttcagggtatgtggacatagcaaagaagttgtactttgtattgagttaaagaatcaatcatctctagccaatgagccttttgtgacattacgatagcaatttagatcagcagtttacgttattaaggaaaggagttcgtattacaaaacatgctgcttcttaactgtttaagagtttagaccataagtaacccatatttagagagcaaaaccctggtgtcattgtgctttttcccagtaacatctttcaaatattatcatatccaagagacaagtattttttttaagtaattttgcataactcttaaaaagatacacaatcctaaacttaacttcactgggatttttaaaataaaataaaaattacagatgctgtttcaagatatgctttctcaaatacttttccaagtatagcatacctaacacagaacatagtttacatttgtccatggtgaggcttcaaaatggagcaattagatcaagttcaggggataatttattttctaaaaattatgtggcctttctttttaattctatttatgtgatgtatcacatctattgacttgtatatgttaaatgatccctgcatccctgggatgaaaccaatttgatcacgatgtattatctttttgaggtgctgttgactcaaaagttgttggaagaaaaaataataataaagagagaaaaaaatgaaaattatgcagaatatttctgcttcaggaaactactgacccattttttatcttttaagataaaaacatttttatacaccaaaaacttttatcttaaaaggtacattataatttagtcaaatctgatagtcatgggcttcataagctgcaacaactgattattacatttgataatacgatgactgaaaagcaaaagaacatttggtatcttaatatcaatttaaatttcacccgatcatgatggcaaaattgcccacaaagctgttctagctgttccttacacctttcctcttctacagcacactcagccagtgcaggagaggatgggcccagcacaattgtgtccacacaccacctcagacaagatgaggttattttgacttaaagggtatgtggtaagcttaatgaaatgatttaaataatctttacgcaggccttaatttttttccatttgcttctttagtttagaaaacactggttttatgaggagctgggtttcgttctcagcttctctgtattttaatgtcctgctggcctgacctggtctctacctgataccctgatgtctgagtcatctccaacctctccaggaagaagcagggacctttcgccctgtcactctgagaggtttctgatctcttaccaaccctctttgagagccctgacttaagaaaaaaaatgcttgaaaataaaacaccgaagtattcattgacagtttcaacttcattgtgggagacattctctgatgtcatgaaaggagcatgccagggaggccacccatcaattgatttttgaaattcctagaagccatagaaaagggctcacctctgctctaggagataaacagtacttcataagatatttattaacctagaggctcttaactaaaaaaaaaaaaaaaaagaaaacaatgcagccttttagtatattcctagaaccctcctcattcccctttcattccttagcttattccctcccttcttctttctcatttacacagaatcttagggtcagaagaaaccttgctggttaaataatttagctcttctggctatacattctcctccctttttatttctctgcatctccatgtcccagcttgcttctcctctcctctctgcaactgttcttccccctctcatttgttctgaaattgctgctgcctacatggtaggcactcctgggtatacacagtaggaccaaaataagcctgacatgaatggttttgcctgggtcattaactgaggtccaggactgactacccaaaaagaactacctaaccttgtagtcctctgcctgtcttaatacatgaaggtaagactaggcaatcagttatttgttgagctaatgaatgaacaaatgattgcttatccaagcaaatagcatatcattttctgttaaagtgaaaatacagccctaggagaattagggaggagcttcactggtcacagatatcttattaccaattaatttaaggatattgctccttcctaatagaagtagtcatgataaaaaatgggagtttgtaataatattgaagaggaagaggaggtaattttggaacctgggatattctgtatggggaaatatggggagtggagatgggggttgggaaatctgagcagtcagaggcaacctagagacaccaccggtacctaaagacaggtgttaggaggcaccagaagttgggaatggcacacaaaaacgaaatacagcagcaaaattcaacatgaatactattatttaatgtaggtttaggtagctattgtcataacaccaattcatatgtgctgaattgggaaatcttgcattgagcagtcaataaataataactaaagttaatagtgaatgtaggaccatcaccattttgctactttacttctcaaaacaaaacaaacgagaaaaaaaatgctatcccataagacagactgggcttgacacttggttgctctgacaacgaaggcccaaagaaaaagttcctgttttactggtgtcaaagtactcaccgcttctttaaaactggctcacttaaatatatctgccttatccctttttgatgtcatttgtacgattcacttttgctttggtttctggttttgcaaattgttagttcctgcagataatgacaagtagagggattaaaggaagtgcaggataatgaacaaacaaaaagcatgatataaatcaggcacacagtgatgtttacttaaggctgatatgttggagaactgactgttgttgttctccattctagtcctagagtattgtgagaataaagtatctttctttctttctttctctttaaagagggagtttcacttttgttgcccaggctggagtgcagctgcgcgatctccgcttactgcagcctctgcctcccaggttcaagcgattctcctgcttcagcctcccgagcagctggggttacaggtgtgttgtcaccacgcccagctaatttttgtatttttagtagagacgggattttgccatgttagtcaggctggtctcgaacacctgagttcaagtgatccacacaccttggtctcccaaagtgctgggattacaggcatgagccactgcgcctggctgagaaatcacaaagtatctttctaagtgcactaatgctacttggggaaaacataaataattacaggtggatcctagataaggagacattccttgttacttccaaaaaaattccataatctttggagattccaaagagattttccatccctcccgaatcatatggaatgcgaaaggcaggtatacatgagaatccatgtacacattgaatcagaaggaaagactatggcaaaaatagggagccacattaggcacttaacagcagtctgggctaaaatcctatttctgcctacagttaccttgaaaggaatcctttgctgccctttatgtaaatgcaagtgatttaaaaacatagttagatctgtatagtgctatacaatttacaaagtacttgggcattcattatctcctttgatttttgtaattgttttgtatctccagttccaaaatgagaaaagtggtacccagaagacttgtgtagccagtacaaaaacatgcagtaactggtttcaaagctaggactccaatcaggttttgtttttatttttgagacagggtctcactctgtcacccaggctagagtgcagtggcaccatcttggttcactgcagccttgacctcctgggcacaagcgatcctcccacctctgccttctgagtagctgggaccacaggtgcacaccaccacactcagctaatttttgtattgtttgtagagacggagtttcaccatgttgctcaggagtctggtctcaaactcctgggctcaagcaatccatctgcttcagcctctcaaagtgctgggattaaaagtgtgagccacggtgcctggccctaaccaggttttttgacccctagcccaatattctcttaaactcttaagcaatgttttcttattttcaaaactgaactaattatatcttggatgagaatactttaaagacattctaaaaatacaaagtagctttaaaaataacaaagtgattcttgcattcttatcctgtctatctaagagctcaagtgtcaaatgatatcttcctttctattggtatcccaaaatagtaaattataaaaaaaattgggaacaacttgcaaacccgctaatatcccaaagctttcatgagtaaaaagatgttaggattaaggagaagctacagaggaaaagtgctatcagaaaacatcaccttagctgtgtcttaacaatcacacaaagacaactagcatcagccgtatatgtgtcctcaaccatctgtgttctcaacccttgcttttttgccttgtagcaaactttgctaatttcacagtactgtacgatacttcttggtattatgtgaagtactctatttagacatgttgacttcactaattagtctataaatacttgacttttagccactgctttggtaagtgagataattgctgaggaaaggccaaagcatttacggtcaatcagatgaggaaaaggggaatatggtctttgagctgagtaaaatgtaaaacattatgtggcaaggcagaagctattagcaggatcaatatctctcctagtaccttaataaatcatcacatcaaagccccgacagaggatggagaaaacctcagtctacctacatggaagcttccaaattggaaaataaaattccatttaaattacaaagacccaattcatgtacaatggaaatggcaagctacaaaactagtctccaaatcctggatgtgctaagagtttagaatcattagtgaagggagaaaagcagaaagacaaagaacactgctactctctgggttgcacattcataattcgcaagttgtaaatatgtatgaatctgcccactgcagctagggatgacatactgctttttagagatagcacagagcagagaaatcaaagtagaggaaggtttggccattataacttacctcctcccacatttaacagttctcaatcttctcaaatctccccttacttaaattgctgtcttttggggatggcttcctaaaatgaaaagaacttcgataccaatgaatgttcaatgtatagcaaaaagcatcccatggtgagctctcactgtaacatgggacgtaaataattgtattttttctaaatctttaatcgctcccattctctttgatgcttccaggaaaacaagcaagcaactaaaagaagttactaggctaacttgcccagtttttttttttttaactctagaactaattatttctcttttctaatatgtagtaaaagacaaaagaaacattttgcagagattcatattatagaacattaggctttcccttaaggatacgtatttcctcacttacagagatgatagtgaatactgacactattttgactccaccacagcttttgctttgcagtcatactgtttaattaaaaataggtttttttcttataagctcaaattactctactgtagatctctcaaacttcgtagtaagttgaagctgagaactaagaggtcacatcaggaaatttatttagataggtcataactggcaaatcagcaacaaaagaaagcagggcttctcaacatcttgaaacattcattcatgattaattatttctttcattccacaattatctattagacacttgagtatcatgcttgggcttgatgataattatatcaaagaaagttcccagaaggttctattctcaaaaaaaaaaaaaaagtctgaccatctaagtgggtacataagtcacccaatacttaaaatgttagctaacattagaagatgtaaattatataaaagctgattgtcacaagtgccatatatggctacgtgccaaagaagggctacagtaaacttttataaagaaacctctattggcagggattaccagggaagggactaggggagagggtaaaagacctgagctacatagaatttgaataagtgaaaaagaaaaggacacatgcttcaatcagtaggaaaagcctgggcaagccagtgcaggcacacagtgcagtgcgaagcaggagagagttcacagtgcagatcagtggtaggtcaggacattagagtcccaccccaacacgcaggaaagacagtggctggactgcatatcttaaggtaggaaagtttttacttcagatgggagaaaaatagagagtcaggagaattctgataccatgtccaagtccaagaccatttggggagtcaaaactgtacagaaagaaatatcttctctagaagcagcagatttcatgtatggccagaaggtggtaggggtttccataaagcggtctgaggctatcaggaagcctgtttcttatagaaaaggggtttcagaagacccagggacaagacacaatttcaggaaaggggcactgggaggatggttcttttagcagaaacctcctcacaggaacagggatgagtgcctaagggaggagctcctgcctgggagaggcaagaaaggcagaaatgagaagcagggtggctctgacttatcttcctggtctaaatggaacctagtgtcttgctggttcaggagcctcattctggcctagaaatagcaccccacttccacctcaccagccaggttccaaccgtataagtagttgagctgaaaacaggagattcattttgtgtggtgcatacccatagttccagctactcaggaggctgaggcaggaggatcatttgagcccaggcattcgaggttgcagtgagctatgatcatgccactgcccttcagactgggtgacacagtgagatcttgtctctaacagaagttttaaatttttaaaaaattcattttgtggttgtaagtacaaaaaaaacctcaataatgatgagaaaaaagatatacgaagatttgttggttaggagatcatagctgatagggtgtgtactacttactacaactgctattctcccacactcacactatctcctgtcttaagaagtttaagcaaatctaggcccagtgtcccactgagggaaatcacaagaggacttagaggggtcccatccatgagagctgcaccatgagtacatgctacttggaaggctgcttctgtggtcattctgagagctgggaaaccaacctggtgctgagctgtccagaaggcagcatctgctgattctggtaccactgggaagaacaggacacatctttactagggaaccagctgctagtcaacagctgccccttctgctccccaataagcacctttctgattactgtcagtttttcagcagaaaggccatcagctgttgtgttaatgatggggcttcactggttggaagaattttgcagtctccagtctgaactattcctctgggtgtccttattcaagcagcagttaatttgaaaacaattagctggttgttcacttccttaaggcaaagcaatactggatgggctaccaggttggactaagattccagcagaacactctgaaggagccaggatatttctaggatgggtctgctttgtgttggcttcaggaaaagtctagcatttctaaccctgatcattgggaattagtcactatttcccttagttgctctggcaggctttcatttatttttgcctgggtgacaaggagacacttctacatttcaacattaaacagactggacgattcatttgttttcttctttttttcactcttccaggtaaagggaaaatggatccttatggtgaattatagatgagaaatcaatgaaagatacagagactaaagagaagtagagttttataaaaagcaactggatttgttttataaagtagcagatttccttttacaggctggccaacataatctttgggactgaaatatctttctgataagagtatgtattttctgtcactgaatcctctacttatatcccctgccacacttcatcctgttaatgaggacaaaacaatatgaggaaagtttttctgttttcctcagtctcccaattcctcacctctcttctctgcaaaccactcggcttccataacaaaaaggatgacacaaacagagtaaaaatatgttaccagagactttctcagttcatggcaatattcagtcagctaaatctggcaaactcatacacatctggcctgctggcaagtctgactagaattcagctgtgcctgtacaaggaagcaggggaacagcatttagagttagacagccctatggcctgctgaatcctcaaatatgcaaggggcttattcacaaaatgcttcacaaaaaatggctcctccaaacacatgcatacttatttgatgtttttatacttttttcttttcagtgctaagccatcttctttagttagaactatttttatcctttgtcactttataaactgcaatggaattcagtattccatgtacaaccttaattttctgtatgacatggaaaacaatatgggaatcagagggacttaaaactaagtctatggagcccaattcccaaattgcagatttaggtcttactgtctctcaggcagattagatgacttctgaaaagaaatacttatttaaatatgcttattttattgttattgaggtatgcataaattatcccgttatagctatccaaaactgtgaacaacagaacaagaccccaaactgcagagaatatatcaactcagttgcaaaagataagacagtaggaaaggtgccatacagaacaatattgggagttagcatcatgaagaaggttagcaagatgtgtttataatacaactttcattccaacagaaattataacatgctaagagcatggacctcgaggaaaaaatatctattttggtgggctaagtaacttttggaaaagactaaaacacaaactcctttagtaaaatgctttaatatactctaggccttttctttaaaagtaaggtatgattaaactaaaactttcaagtagttcaatgaactaagcaagaactgttggcttccctccaaccatagtcccacttgctagagataataaccataaaagtttcatgtgcagcccacacataaacaagcatatacagctgcatatttacacacgtgtgtatttgctggtacaggcctaaaatatggaaacatttgctattttattaaaaagtgctcataccatatataatattcatgcaacattgttctgtatcattgacatagatgggtttgttctttttaatggctattttatgtactattgaacaggtatgctataatacctatattcctattggtatgcttttaggttacttctgagttttaacaattaaaaaatacgcaatatgtcttcttacaattataactttctaacttgtatagatagaactaaaacttctccaaaaattattattccaagctacactccttccaacagagtaacaatttctcaccaccactagatagcatcaactgtttaaattgtgtccaatggacaactgaaaaatactctcttattttaatttttgccatcattaatgaggccatctttgcttggctgttatatttttctttgaatagcccattcatattctctatttgttttcttccactgagttgttactttttactaattgagtcccttgtttcacagagaaattagcccatcatctgtcatgtgtactgcaaatataattcctaatttttcatttgtctattggctttggttttgttttggaatgaggagacagtcttctagaaaataagacatattaaataatatattggtaattgtaaagcacagattgtatggcgccagccatcatgtgctttgttcaggtgtcatgcttatcttaggtaacaaggtcaccaggattaattagtgaaaatcctgctgagtttcagatcatctcagtggccctctataaagtgttctcactcacctggcagcctcctttcttaatctcagttggaatctcaaccacaaagtggttgctccttgtatctagaagtcatttaaaagacagtaatcaaaatttctgttctcttttatttgttcctctgcttccctatcaataattctgggaggagtgggagagagaacagtgcgtaatcaaaaggcagacctagcaaattattattttattgataaaataattcagcaaattctcaatattcctgcttcacagtgattaccctagattttatattttagggttttgcacctacctcttatcatcaccccactaactagagtgtagtctgtgtaggacaccgattagactcacccctggtttggcaggcaaagaatgccaaggcaaaagcacagccgacaaagctccctgtacttgtgcagatagagaggcagagtataccccggagctgagctgcaaggtacaaatcctgaccctcctacttgataactgtgttactcggagtcagttaacctctcagagcctcagattcctaatacatatgatgcatataggaacagtgccatcagaataagaagagcagctacatcacaggactgctatagggtgaatggagttatgatgtaaagtagtgcctgggatacacatagcacattttaagtaaatgtggcatatcaatatagtaattacatatagcacaatagaaaagttagagtgtgatgaaatccaataggctttacaaaaatcaagtaagtattagtactacataaccacagaaaagggaggcccaaaggaacagtcaagaaatgcagcaagggccaggcacagtggctcatgcctgtaattccaacactttgagaggctgaggcgtgtgagcccaggagttcaagaccagcttgggctacatggtgaaatcccgtctctacaaaaatacaaaaattagccaggcgtgatggtgtacatctatagtaccaggtacttgggacactgaggtgaaaggatcactggctgaggctgcagtaagccataataacaccgctgcactccatcctggacaacagaatgagaccctgtcaaaaaaaaggaaggaaggaagagagagagggagggagggagggagggagggaaggatggagagagggaaatgcagcaaggagaagagatggggagcaacatggccaaatagaagcctccaccactcatcttcctcataggaacaccatatcttgagtagaaagatgaaaaaatgaaccaatgcaaaataatagttataacaacttttcaagatatagacagtacaataacatataaatagaaacaataaaaagttaaaaagttggggaatgaagtttaaagtgtagagttttttaatactcttctctttattagtttgtttatgcaattagtgtaagttgtcatcaatttaaaataatgggttataagatatttacaagccacatggtaacctcaaataaaaaaatacaatagatacataaaaattaaaaagcaagaaatcaaaatataccaccagaaaaaaatcgccttcattaaaaggaagacaggaaagaaggaagagaagaccacagaacaaccagaaaacaaataacaaaatggcagcagtaagtccttacttaccaataataacactgaatgtaaatgaactaacctctacaaccaaaaggcacagagtggctgaacagataaaacaaaactaaactaaacaaaaaacaagccccaatgatccactgcctgcaagaaacatgctccacctataaagacacacatagattgaaaataaagaactggaaagatactccatgcccatggaatccaaaaaaagaacaggagtggctatgctggtaccagacaaaacagatttcaagacaaaacctataaatggagacaaagaacttcattatataataatctatgggtcaattcagcaagaggatataacaattttaaatataacagtggagcacccaaatatagaaagcaaatgttactagagctaaagagagagacagaccacaatacaataatcactggagacttcaacaccccactttcagcattagacagatcatcaagacagaaaatcaacaaagaaacatcagatttaatctgcactatagactaaatggacctcatagataattccagaacgttttgtccaatggctgcaaaatatacactcttctcctcagcacatggatcattctcaaagacagaccatatggtaagccacaaaacaagtctggaaattttttaaaaaaaataaaatcacatcaagtatcttatctgaccacagtggaacaaaactagaaaccaaacaacaagaggaattttggaaagtatacaaacacatggaaattaaattatatgcttctgaataactagtgggtcaatgaaatgattaagaaggaaattgaacaatttcttgaaacaaatgataatagaaacacaacattccaaaacctatgggttacagagaaaacagttagaaaagggaagtttatagctacactataaaagaagaaaaacttcaaagaaacaacctagcaatgcatcttagttaactagaaaaggaagaacaaacctaacacaaaattagtagaagagaataaataatagagaccagagcagaagtaaatgaaattaaaatgaagacaatacaaatgactgatgaaatgaaaagttggtttttcgaaaagttaaacaaaattgacaaacctttacctagattaattgagaaaaacagggaaagacccagataaataaaaacagatgaaaaaggaggcaaaggactgttagaggctactatgagccactgtatgccaatacattgggaaacttaaaagaaatggataaagacacatacagtctaccaatattgaaccatgaagaaatccaaaacctcaaaagacaatcagcaagtaatgagaatggagccataataaaaggtctcgcagtaaagaaaagcccaggacctgagggcttcaccgctgaattctcccaaacatttaaagaagcatatcacttctatttaaattattctggaaaaaaaaaggaggaaggaatacttccaaactgaggaaggaatacttccaaactcattctacaatgccagtattaccctaataccaaaaccagacaaagactcattaaaaaataaaataaaaaactacagaccaatatccctgatgaatattgatgcaaaaacccttaacaaaatgccagcaaaatgaattcagaagtgaaagatctctacaatgaaaactataaatcattaatgaaattgaagaggtctcaaaaaatgaaaagatattccatgtttatggattagaagaattaatattgttaaaatatccatactacgcaaagcattctacagagtcaatacaatccctttcaaaatgccaattacattcttcacagaaatagaaaaaaaatcctaaaatttatatgtatcaaaatatctcatgtgccccataaatatatacactatgtacatacaaaaattcaaaataaaaaactataataaacagaaaagaaaaaagaaatgcaatgaggaatagacggaatttgaggaggaggcctaaaataaacaaaatcaagtattgtgtgtattctaaaagaggagaagagccttacaaaaacacttacctcagggacaatgaataaactagtgggagtgcagtgaaaggctgtgactggatagtaggagaggattactttaaaaatgcagattgccaacatctcaaactctgtttatttaaatgaaaatgtttacttattctttgctctcaattaataaactgaatcagctattatcagagtagtatttcaaatgtgaatctttagagcaaataattttaaaaaagaaacacctttcccacagaaatactgatgtccaggatggagggctttccaggctggtccctgcagcccctgactacaaatgggaaggcagagtaatgatattgtactatcatcagtcccattcattccttcactcagtaagcatctgctgaatgcctaccaccagtccatcactctcttaaaaaagaagtggtagtggtgaacaaagagaaacaaggtctctactctcgtgaggcttctactttagggtggggaaggggagaagcaatggatacagagcataaaaataaacagatgagtaagattaagattacttgagacagtggaaagagcaataaagcaaatcaaagcaggtgctgtcatggggtggaaggcccctctgaggaagtgatatctgagttgacagctgaatgatgaagcagaagataagtaccaggaagtccctggcagagggaacagcaagaacaaagacattatggctggaaagagcttgatgtgttcacagaacaaaagaaagggcagtgaggctggagtcaagtgccagagtcctaagcaaaaagtaattgtgaagtccaactttgaacgtcaagcacacatttctcccttcgttctgttgactgccagagctttagcagctcctcagctctggacacaaaatgcatggtgttgagctcctcagaagctccagtggcctggggttctctctcatggatccaggaggaagccttgggatcaagagcctgatgtgaggaaagggaaaggactaggggagggaaggataaccagggtggtcacagctccagtacccacaaagacgctctttagaaagtaggggatttcaatccatttgggagaatttcagttaagtttagttaattttttagataaggaaagattcttgccttttgtttccttagtttgtctgtgagcttccaaattagcagtttggacaaaatcaggaacagcaggaaatccaagggtgagctatgtataaatcaagaccaggaaaactaggacagttgctggtgcatcactaaccttttaagatttatgttaaaaaacaagcaagcaaaaaccccaccatgccatcctagtaaacatcccttaggatcattctgaaaaacaaaacagatccactgatggatagaaaatgaatctcactggttatggcagtttttaacgagatttttctatttgtttggcctaatttttaaattcttgatcctcgtaatcaccatgtgggttgcagtagcaaaataacttgtgactgatgataattaagaaaaggaaatttaagaaatgcatgttttcctgagccaagtttcaactaaatgtttttgctactaaaattatgctttcttacacaaatgttgaatataagtaagttgctctggggatgttagtgtttacattttttcccatttgttatttattagcatgaattaatatgccagtttgtatttgacacaagattttttttaattcttgcaataataagactacatttctctatgcagtcatattgctttcttgaaaaggatgattatctcacagtcaatgaacttggtgacaaattataggtattttgatattgcaggtatagtaattttaatgcaacccatcaatgcatagatcaatgaattttatatttattatatgatatatattctactgtactagtatttctaaggaagatgaacacccaggacaaataaatatattttatttctgagtttggaatatacaaattgttattttcagtggcaatagcatgtctatcttctgttggaatgttattttaaaaaatacttctatctgcagcaatacagaaggaacactggttatttgggagataattatttctgaaaaaaatagagcaaagactaaaagctaagaactttgagttatttgtactaaatgttatctagtatcatttgagagatgaatgattgtaagatattgtctccacgctcagaagagaaggtatagatcttcgaaaaatttaataatttactgaattatattctaaataagtttaaatgttcacacatgtgaaaatgctttgtgaattaaaagctaccacaaaatttaagggcatgccattattattttcggagttagtttatcatggcaattcttatagctaaagccccatcaattcttcttttttcagtgaccaggtccagatcatcaaaataagaatgagcagaacaatgagccctcccagaggaagagacagccaacagaaaatgttattccatccaagaaatcaatttgtttattcataatttgaacaaagtatttccatgccaattactgattggtctctccaaggtctttttgttttttaactcaccataacagatggaggaaaatatatatacaactaaaacctgatagcataattagtggactggaagttggggtaaaaaccacataaccaaatccttaacaggaaggtcaatatcaagacatattcattatactttgaatggttatcaaaatacatgtgttagtgcaaatcagtaccatgtgctttttccctgtcagtatttgttttttatctaatttacctatattattatttttaaaatgtgatcttcagcccagtgagttctatcactctcctctttatctagtcctcttataataattttcaatgtttaatatgctttaaaatgggacaaatcatatccaggaaataaactgtttaccaagaggaactttgttaaaaaaagataaactggctgaaatgattaactgtaaaagttcatttcatccctgtctacatgtggcttgataattaattaatcttatatttatgaaaaataggggaaagagaatcataaatgttcataatttagaggaaaggaaccgagacacagagaggtgagtaccttgcagatgagggatcagtgcttaatctacatgtctactctgttcccacagtctgcaaggaagagaaacagaatttataaagtagatttgtaaatcctgataacatgagtcaggatatgattatgtaacttcaaatatctttgcatttaacaagctagaaacccagagcttgatatttgttgaattgcatacatgccttttcctggtttcttgtttacaataaattttgtggcaggatatttagatttgtgaattctagccagactgctctctaatgagactacagcttgtttgggttttaaagctttatgacatttatagatgtttactttgcatctctaaaaaacacagaaatgctcccatactataaaaatactgatctctaaactttcaaagcataatgcaaaaaatccctaggtgacgaacctttgtgatagagtaatacttttttcaattctttgacaagtggcactattatttataaacttgagttacacaggatagtatataactacagcaacaatattttgataaaaggtgtcagataaatgctttgcctgaaaaggctaatccagaaaacttttttccccttcctcttgcatgaaacctcttaagcagttgacaggcacgagacacattgcccacagagagtggcacacactgagaacacacagtatctgacttaaaattccagcttttgccaaagaagagttgtcttcagcagccgtgtcagggtgccccgggaaaaaagacagagactcctctggtcttttctgtcattaagtgtgagaaaataatactttaaccaactagtgtggaggtgattacctcctccaagaaacattttgataaactggcccactccacttgagcttctaggggttaagccagatcacaagctgagaggagggagagcaatgcaaataagaaataacccaaaatgaggcatccctagcacagttaccaattctagcttcagcctttcttttatctagagcgggtcctacaactccagagtttttttttttttctgggtctgccaaaattcaagttcctacactaatttgttgatttgggtctattagtataattattattttcatccccacatttgaaactcattctatgagactaaacagaagaaggcaaatggatttcatttcaaaagccaatttttatctattactagtggctgtctttggggtctgatttgagcagaattctgaggctgagcatggtgagaaagtacaacttaatgatttcatgatatctgctagctacggggatagggtcagatccccagggcttgcagcatgtgtaggtaatcaaaaaaatgtttgttgaatctttggttttatgcaaaatggctgaggtctctttggaaaagaagctttaaaaacaaaagtaatagaaaatcaatggctgtatacccttagatagaaatgcagccatccgctcacttaccttttatctgaaatacttcaatagcccttcctcacctctttccaagctatactgatataaaaatgacctttctaaattggatcatggttgctttttccatccctggttccttattctcataaggctctcttaggaagcatatcacataagcatataaagatcacctagggcagacagatagatagataaattagacagagaggtgaatggatggtaggtaggtaggtaagtagagatagatagatagaactagggcactttcattaatcaatttgctggttattctctgcattctgttcccttgcatcaatacctcagactctttgctatggctcagagacctatgttctcttcttgaaacctttgacttcattgtagctcacagattaagataaaagagactcccagtgacactctcagaagaggaagggtcccctggcattactgcatgaagaggcagattgagacgacaactcatcctttattagaatcttttccttagaatataaagggcaagctccttagtggtttaaaaaaaaaactgtatttctccatctggtccctgctgttttgctcagcttcatacaaccaatcatcattctccaacaatgagccttttaaagctccttaactacaccacgatgtttctaaagttctgcttctcttcactggtgtttttgcttttttgtctgcttgacaaactctgacttggttttgaaaacccagttcataatcatcccacaccacaccctggaaaaagttaatcattcccttctctgggttagctctgcactgttcccataaatatttctatagttgcacgaatcaggtgctttgttagtttaaattagtatctgtgaactggttgagagcaggaactttgtcttaattttctgttttcttagcacccagcatagtttaggacacattcaatataactgaggatacctttaagattttccattagggagaaaaagggaatagtgataatattatccaagaaaggaaaatgaaaaacaggagcagactgcattgtgagatgccatttgtttcatttggagatagtcacgtttcaaagtcccagttagatgtaccacagaagaaattagagggtttgggaaatctgggcttagagttaggaaaggggtttggagctgaagatggtcatctgagagtcagcaacacataggcagtagcggaagccatagatgcacatagaaatgaaaaactagaaaaagtggcaagaaccctgtagttcactaaaaatttggccccaaatttaggagccaatgaagaacatgtggatagatgaagactgggaagaatgataaggaagaacctggaggacctcagaggccaaggacattaaaatttcaaataagaaggggtatcgatcatgttagcatctcataatggttaagtgggatgaaagctaaacagatgagatgaattttctaatatgaagaaaggggtgtgcagggcaaagcacgacatcgagagcaatttcagtggaggcaaaagcccgggatagaacaaactgcagtcagtcagagtgaatgagtgcctttcatccagactcattacagaaactgtggcttaagcaagaagccctcagtggccatctgggtgagaagtggaggggaagagggatggaaaggtgtggtgagaaggaatcagctaatgggcaaagcaggaaggattctactgtttgcacgacaacattttacatattgtatattttaggcaagatgtccctaggcaaatggttccataatcccttttgttgataaatgcctattccctcatttctcatgtttctataaaggggaaagaacatcaactccaccagaagatacagtctctggcttctcattcacttcttcttgggaaggaataatttatctgatttttgagtttgggagaagaaattgaacatgactagctcattatcttcctcccttaaattcataaaaggcacagaatctcctattctgttatgctttaagcagcctgccacagcagaggaggatgacggctgtctaccaatgcctgtaactgggggctcagtttacatagaagggagttgtattaagtccaagtggtcacagatgtaagtcacattctccaattcggtcatgctggtaataaagcttatggtatacactccatctgtctcactctcatgtttgcttctcaactagatgtgaactcaaggtgggaatcgggtgcttaattattattgccttaaaaccttaaaagtaggccgggcgcggtggcttacgcctgtaatcccagcactttgggaggccgaggtgggtggatcacctgaggtcaggagtttgagaccagcctgccaacatggagaaaccccacctctactaaaaaagaaaaaaaaaaatacaaaattagccgggcgtggtagtgcatgcctgtaatcccagctacttgggaggctgaggcaggagaatcgcttgaaccctggaggcagaggttgaagtgagctgagattgtgccagtgcactccagcctgggcaacaagaatgaaactctgtctcaaaaaacaaacaaacaaacaaacaaaaatcaaaccttaaaattacacttcaaggaggttgtttaaaaatagagaaatataagacctccaattcctcatctgtgaggtgaaggggctgaagtggataatctttaagtccttcccagcaatctctacacgtctgtttgctattgtgtgtgtgtatatatcagacaagcggtggggcggtgggggtggtgcatgcgcaaggagtcagacaatcttaggtaaaaggaagggaggattcaaagcaggagcaggcagtcaccggggtagtgagcagaaaggtctcctaggctgaagaaaaattaagagattagagggcaacttacttatgaagagcattttctgagacaaaaatgaaggttgctatatataaacaaaaatatatatatacacatacatatacattataatacatagagataaacaaaaagcaaaatactgaatcaggctggaaaaaaattctccccaattcaccagcccttccatgctcacataaaccccttccctcattagattataagattttgtacctttgcacctaaattttccaagagaaaaaatgaataggccacaaaatgcctaaaagcaaatgctaggaattgtttggctcaaataacaaaacagagacccttaactaagctgaggacagtggaatattattttgccttcttgcctgttggaagcactaagaagacatttccaattccaacgttccatagaccaaaaggcttaggtgaagagggtttccaggctcacagctcaatgaaaacaatgatgatccaggggagtcatggcactcatgtcttcaacactaatggatttcagctgattcatcagtgaacatttctcagaccaaagtggaaaaagcaatttttgtcttctgttaaacagaaatctcagtcagtcttgcactgaattctttcacagaaaatctctgctcttctgccttttcagacacacaaggtctccagcgggtgctctccagagatggaaggaaggtgtgttctgtgcagtgcatcagttgctatgtgttccattgtggcaattgtgattcacaagggcatagctgagccaccacagctttcagctgtaatcctcctggcatctatccctgctgttagagggataattatctggttatccctgaggccagttcttgccattttcacataaaaatcacctcttgcataagacatggaatttaaaatcatctcctcatacatatcattgagtcacttcattacctctgggacatatataaattatgcattcttcgattctctttaaatttttagaggctcatagggacagtgaaggatctcattggtactgaaaatataaggcattccagaaagaaacaataacttgtgtgacattaactgctactagtgttccaaaggctccctgcttggtcaaggaaatcacataaagcatggagaactaatagcaggcttgcatgctaatgactgccggtctgctagtgactgaatgtcactgcctcacatcctcatgctattcatttttcttatctcagtgacttctcccttcacaggactgatttacttctttaaattggcaccattctgagtgtctgcaaccaagaaggcactgaaaaattagaacccacatgcccttattcccatttatttctccaatcccatgcctcaatattaagagagttatttgtctgtaccatggaaatagtgttttatgaattctctggagcttgtttgattttacctttagatgcgtccaagactcactaccatacgtgcattctttaaattctttaaagagagggcgtgacattagcatgaataaaatgcagtggctgtcacggcaagaatgaagaaatgtgtgtgttctcatgccctgccattaagatgaattcacagatgtaagctggcaacacaacacagcacaacacaacactggcaacacagacatccatggagggctacacatttcattccatagttcccattcaatataaatatggctaacattccttaaagattcaaacccatagtatattgttcacctccaaactggaaaaaaacctagtcctgtcacagaagtgaattcagttgcttgatctttacagctgctgataaaagtttgaggagttcacagacttatgggaaaagtgagataaacttcagtatccagcattaaaggctttccaaggcaaaatacattgtgcaatattaatttttcaagttaaaaattggaggtatttgaaaaccattgcttccccaaacaggaaggaaaaccactgtttgggtggtaaaatgtgctaattctgtacaaaatgcctttaagcccttgacctaatgaggttagtgacagggatatggatgactagaacagaaaatgaaactcagaaagaattttgttcatgaactgccatatttctcctgtcatttagccaattttccctctcaaaattacaacatggactgcaaatcttcaaggctaatgctgcatatgacagactaagtgctatttaaaatgtaataatatatctgtcaatctgataggaaaaaacaagaggccacgcgaaggacttttcaggtagacatgggtcctaaaaggttataaagacggtaatcaggaaagcaagccaccacacagcttttcccgtccaattagtaaaagtgcagtattgtcagcgagttctacaaatgaaagaatcctttcagcctgagcactcaatggcgtatacccactctattaagtgaccttcattgtacaatacattaatttctactaaaattaatgttttgggttaaaatcaatgcttagaggacattaatggaaatgatttaatatgtgtgtcatgcatactgtttcaaaagtttttaatctttgtaatttgctacaaaccaaaattatatgagaggtggaagaacactcagaattctaaaactcccactgctgactaaaacataccacttttgttttccactttcatctcagtcagggcatctgtgctattttaatctgccatgcctgaattatcaggaaagagaaaccactggtttcctacaaacatactttatcttagtaggacactttccctctagactctctgtgtggatattttcaaggattcacagcgagacactgggtgtgtacgattgaggttatttaagattttcccacaatgactggcatccatgtggagagacaccaaatgtcatgcctcttcttaaccagttctgaggcggggaaggtagggaaggaaaagcagtgcgcctggggagatggcatgacaaaagagagagccacattctgcttaggagcttattgctttaaaagttcacctaagattgaatttaaaatttgctttaagcacctataatgaaagaacattttagatcttgggagaaaaggtacaagtgtccagcatggagtgaatcgcttggccctttaatatttaacttcactgaaaaagaaacctcgtgaagtcctcttaaaagaacgcaggggactgcacaggactttctcaattgatggcataatgagaaccattaggaagcttgactccattttacatcttaaatctccaagtcctccttgcaaaaggaagcaaacagtacctgcttcccaagtgagacttgagtggaaagtcggccaaaatgagacagttttcagaaaacaaatttcagttaagtctcaggaagctacactactactactttctctattctccatgccctgctcctgacagatgggaaatacatcaactacactctgggcagaggtaagtgacacagaagatttccataggtagtgttcaggtcacaccttcctgaacaacttgttttattaaactgttcctaagaagaacctctgccttcctgttgaccttaaaatcttctcaagaggattataacacaagatgcttttatattgtggttattaacagctaccatttatcccagaggctcaaaacaataggatgaggattgttaccagaagaataagacatagattcctcggtaatttagcaaatttccagctgtagtactccttgcccagtaaaatgcttggctagccctttggtattttactccaggttcctcttctgtaaagtcaaccaacacaagtggcctgacagtcatgatggtgacaagggatgatgttcactttgattgtattttggaggtaaatgcctgggcaaagaatataagaaaccacatcctagcaatatgttgtaatacataagtttctaaaaactaaaaaacaactaaaagaatgtacattccattgaaatgtactggcccttgtagtctaatgagaaacgtaatagaagacaatgaaacaaaaagtattttcttcaattaataacacaactcaggaagaaatgttaagaattaaggaaaaggactcataaaaagcaaccagagttaattgtttaagaagtgcatatctaaccccatcacttgcctacttagattggcaccaaatccttaacacagactgttgtaataggacaacagaagctattaaagggtttcaaactgggaggggagggaagcatgcaatcttcctacttctgtcttcctacttctaagactcaatccacttgccgctattttctgctttctctaggaaagcttcccacagctgacgaggaaattagattccctatagtataatcttgtaggactgtatactttttcttgacacttatcacacttagaattactttttcaatgtttctctttctcctcagacctgtgatgagcaatatggcagccacatgtagctattgagcatttaaaatgtgcctagttcacattaagatgtgctgtagtgtaaaacacatgccagatttgacaaacttagtacatactgctactgaaaaaaaaaatgtggccctgcagaaaccttgattttagcccatgagaccaattttagtcttcttagctttagtaacagaagagaataaatttaggttgtcttaagacactagtctatcgtaattgtaacagtagcaatagaaaactaataaatgtggcttccagaaagattaaattacatatatagatcacatagtatttctatggaacagcactaggttagattataaactccatgagggcaggaaaatgtctgttttctcagctgctccatgttctgcacccagcatgcttcctgacacatatagtcagtccaaaatactgtggattaaagaaagaaatttaaagaaggttttaccccctttataattcgtaattcaatcactattccaataaaaaattattaagcgtttactatgaaccacacattgtgtaaggcactgaagatacaagtataataagaagtggttgccagagaatgggagagaagggaataagtagtaactgcttaatgggtatggatgttccttttagagtgataaaaatatttttttttttctttttttttgagacagagtctcgctcagtcgcccaggctggagtgcaatggtgcgatgtcggctcactgcaacctctgcctcctgggttcaagtgattctcctgcctcactctcctgagtagctgggatcacaggcatgctccaccacacccgactaatttttgtatttttagtagagatggagtttcgccatgttggccaggctgatctcaaactcctgacctcaggtgatctgcctgccttagcctcccaaagtgctaggattacaggcatgagccaccatgcccggcctcaatattttcaaactagatagcaggaccagtgtctggagagggctgtctccacttccaagatggcaccttatggctgtattcccctaaggggaagaacactgtgtcctcatgtggcggaaaagacaaaagggcaaaagaaagaaaagaggaattccctccatcaagccattttataacagcactaacccattcatgagaatgaagccctcacaacccaaaatcctcccaaaggaccccacttcacaatactactgctctggggactcggtttccaacacatgaattttggaggagtcctccagaccacagcattaaccatgcagattgtagaaggaggaatattgcagacagaaagctcatttatagcatccctagatggctcttcaaactcttggccttctctattaactgacaactttctgcttccttgcccctatcctgattgacagttcttagagagtaaagcctgaatctttgaagtcatagtcaccataattacccagagtcacagagcccaaggagcaaaaagctgttcaaaatgggaaactatataaaaaaaaggagaatgggatccagaggcttgatcaactctatgggcaatcccacaaaatatgcatgtaatatataatcagagagaagaaaggaagaaaaaaactaggtttgcttagactttacctgacgacacacgacagccatttgaaacgatctggcttctaataaaaataagacatagagccctaaacacaatttgggaagaaaaccaagaggtcatcaaaatcacaggatatacatgacagtggatagggccacttggcttctcctgtggctgagaaagatttaaaaacaacctgggaatatcagtgaaatttatttcaactaagaattgatgcaaacaactgtacactagataaaaaagaagtggtaatttgaggaaaatgtattatatttgtgctctagaataattttgtttataaaattttttgacacatttgaaaacttttatctctaattcttaataatgaaatgctaataattcatacttaatatacttaatgacaaaatttacctaatacttaatataatgaaatttatcctcagttcatgtgttatcttctcagaaaggccttcccttcataagtagcgtcactcaagaggtacaatcaaatccccttgctttatttcctgcagattattatctgacacttttttgttcacaatgcatccacttttctgcttacatttgcctcctctctctagaatgtaagctctgttagagcacagctgatatggtcttattcactgctttgtctgcaaccacccttagcagagtgccaacccttagtaggtatctttgtagaatgaatcaatgaacacaaaatcaaaatattattgcttgacttaattccacctttgatctcctcccccaatgatatataaaactttataactggaaaatttgttaattttatttctattctagaagtcttactagatttaataggtattatagagttaattaagcaagtgggaccagaaatcatattcctagataggaattcttgttccttcattttttttttccttctgcttgtgtggccttgggtaagctacttaaccttcttatgacttagtctcatcattaaaatcaagggattaatattaatattagctatgtcatagggttgcttgaagactcaaagtgtagagaatagtgtctgggacctactaagcacacattaaatgtaaattccataatgggttgaagtagtaaatgaggaagaatggtggcttaacaaaatgtgggattttctatcctctcaaagaaacagatggttttaggagtaagttatctgtacccagaggtgttcaaacagaaataattatccacttgatggagatattagaaagaagatttatgtatcagaaatccaattacattagataacttttaacagctccctttctactcttgcagtgctaagctcccattgtgaactgaagctgagaagtacacagtacacttcccagatgcaaagacaatgagcatttcagtctccaatatccagcagatgcatttctactattttcacaagggattcagtgtcttctccatacttgcagaacttcctgtttatctttcactatccatgtctatgttattgatctccccatgagaccacaaggaatcagggtggaggaacatgggaaatggagcacaggcattctgggagacagaacactgagagctatgcttgctcagaaggctcatggtaaagaaaattgaaggcaaacctgaaggggaggaattgcaaagactttgagatcttcaaataagtcaaaaacaaaacaaaacaaaaacactacaattcttaattagaaaggaagaacttaaatttatccaaactcaaagcagcccatattctactgtaagtggagggatatgacactggaaaccaactgacatttcccaaagtggtcctacagtaggaaagagttcaaggtgttcttccagatgcccaccaatacagccagcaaggagggtaggggtagggtggtgagggctgtggaaaggggtgcacccacatgcaagcagatagtaatcatgcctttttaaaaaagaagagagacctgaaaaatctaaatccaggtgcagacttgagaatgagaatgagtcaatgggcttctacatgtacatcatcagaacattatctgggatattcatgtccttgacctgtacaaaaaattccaaaacacctgctataccagaaaagatcagttaaatgacattctactttaatatttatgttaactgggttttatcatattcacattgtctaaaaattagcaatttatgtgtacaaagttagttgacactcagccatttggggtttttttgtaaacagtggacacttttgtcgccaacaagtaatgttacgtagcattcacagacatagtatgacttaattctcaccagtcgtaaatttggagcagcttctctgtgaggtattttcaagtgccgaccagaatagctgcactaagaacagttcttgtatgctcaggtgaatacctaaaaatacacacttattcttctttctacagcagtgaaagccattttcacctcccctacaaaagactttgatgtcagtgtgtgtcagcctcagttaagctgttgcaaatcctatatacacatttggggcagttctttcaaattctgatgagctagccaaaaattgcttcaaaaatgttacagtccttcctcactgtttgcacgcaattattggtaagctcattctgagttcaaagaacttcaaagtttatttttataggtaaggttacagcctctcttaatagaattctcattttgtactgtatgtacagaaatttgcttgagtctttagaagtttattttagaaacttgagaagttttaaatttacacatatgttatttagtaagtcatatttaaattcaagaacttgtcaatttaatatagtttgtcctttaggagattaattgaagcaggtggtaatgaaagttaggaccttgtgttgaaatatgatagatgaatttattttaaggctattggaagagctagtttatttgctataccttgtattctcttatacctaaacatagagcaaaatggagagatactcaggtatctgacctaagttattttagcactacctgattctttttttttttttttttttttttttgagacggagtctcactctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcagcctcccaaagtgctgggattacaggcgtgagccaccgcgcccggcccactacctgattcttaatggcttcctctggcatcaatatttcatcagttttattccatccccaaggaggaaaagtccatttcttacatatacaattaaaaatcattttctaaaaagcttaagtcttagcacaagacaaagaattatcatacaagtgacacaaaaaagttttaaaaacattttccaaacatcagcggttattgattacgagtgatactttccctactctcctagtgggtatttttgattgtcaaaatgagctggaagactctgttggcctttactgtgcagaggagccagggatgcaaaacctcctgtaatgcacatggcagccatgaacaataaaggactgtgccaaccaaaatgtcaacatggggatacaagagaaaaatacagaaaccaattaatagcaggaattatttacctctttccatttgtgatcaatcaagtagatttaaaaaaaggaactatacagagtatccaaataacctaactaaaatggtaaatcatatatagtatgttctacatgcatgtatatatcatatctgcaccctggaaacacagaacacaccttcttttccaatatctacaaaacaggcacaaaatttgaaaatctattatgccacaaataaaacatcaataaattccccaaaaaagaaaagtatagaaaacattcttgtatcatgatacaataaaactatcaatatctaacaaaactagaaaaaatatgtcttatcttctgaaaattttaaacttccctcataattttgaggtcaaggaagaaaaaaattaataacatgcagaaaataacttttaaaaaaaatccacaggatagctaaagtcatgctgaaaggaaaattcatagatttaaacagttgattaataaacatgaaataataaaaactaaattaaacattccatccagggagttaaaggaaacaaaactacagaaagcagaaaaagtaataaatatacagaaatataaattaactgaaagtgtcttatttattttcaataaataaattgagaagctggtacctaattagttcaccaaatcaagggggataatgaaggaggctaaaacaattacacaaaataaaaataataagagccagataataccaacatggaagacattttatttctttttctttttttttggagacagggtctcactctgtcacccaggctggagtgcagtggtgccatcatggctcactgcacactcaacctcccaggctcatgggttgctcccacctcagcctcctaagcagctggaactacaggcgcacaccaccacacccagctaatttttaaattttcttggaagagacggggtcttgctatgttgcctaggctaaagacctttttaaaaattataattgattcctttgctcaactctgtgcaaataatttcaaaacatggataaaggagataattttctagaaattattgtatgtcaacctacttccagaagagagagaaatattacactaattatcacacaaataaagaagattgttagagttatcccccaaactggacacacatgcacagacagacagacagacagacacacacacacgcacgcacacacacagcctagatggtttcatagcacaacttgccaaacctttcaaataacaaaaaattccaatgccatttaaactccttcaaagcataagggaagaaaagactaggacagtttccaagttctttttacaaagcaatagtaacattgataccaaaacttgacagattgtaccaaaaagaaaattatggagcaaactcatcttggaatagcaatgctaaaattctaaattaaatattgacaaatagaatccaacagcaattaaagtaatacatcatgactgagtgaaatttattttattcaggaatgtaaaataaattttttaaaaagaccaaaaacttagaaataaatctatcaacaccaaattactcattatggcattcaaagccttttatagatgacacagttttctcttccacattaatcccactatttcaatgacagtcaaacactattactcactttttcttgtacttatgctatttcctatcccttaacctccgctaattttgtatctatgtttggaatgccatctgtctaaacttcctcccagttctaaatatcctatctacccataaaacccaatctaaatattaactcaaaaaagcttatttgattctccctacagacacctttcttctgctgaacaaccaaaatgctatctttcttgcagcactcattatatattttttaaaaacatcaggtcttctattgtcatcaagtaaacacttgttattttcagccatgtattacagatatttgtgtaaaggctctacatctcctatcagatataaacttttcttttttttttttttagggtaagggccatgtcttatgtacctttgtattctaatcactccaagcacaaatctttccatacttaaacattttgacgcacgagcacaaaaaaacccagattgtaaaagcaaactgaagacttgcgaagaatagtttccccttaaaatgtaactgcatgtgcacaggatgaagagttagaatctgaaaatcagctgggcactagccatgcctgccctgctacctttccatagccagaatcacagcagcatgaactgcactcaagctccagaccaagaaactctaattaccttcagcgagcaagtaaactgacagtaacagctattgcaggaggcaaaagcagctacaaccttcaattccaggcacggaggtgggaataaggaaagaagtcgggatggaactgttggtttcattaggttgttggtttggaagcaagtatttcacaaacacacccatccccccactatacacatccatccgcttcatattttcatttctcataatgccaaaatattaacttgtgttctaatatttcagggaagatgtataagctagtgagagtcataatgtcgagtttcaaaatgcatgtataatttgttatgcgtggcagggtgaacagtcctatcagaaatgcacctgaaggtttgctaggaacagaatattaaacagagcagagactatgggatctaacgtgataaactgacattaggttagaacagtacaaaaatgccacattccaaccactgttgatacacttctggagaagtggactttcaatataaagcagttattctaggtgcaattttaatagcaatgaaatacaatgaaatgacaaatctctggttcattctgaatacaagagttcctgcttattttgagaccatgtgaatcaaagaagtcgacatcaccagcactttgcttgtaggctaatctagtagtgacttttgatttcctgctccccctgttgatccatccatccacagctttaagaccagcctgactacaatcattcttcatgtcaccaaaatctccatccgcaggcaagaaggagatacccagctgtcccagtttgttaccccatcgcaagcacaaactgggatcactttctccaccccaactgtggtaggctgaataaaggcctcccaaagatgtgaacgtcctaatccccataatctttgaatatgctatctcataaggcaaaaaggattatgcagatgtgattaggttacagatcttgagatggggagattatcctggatgatcctatggactctatgtaatcacaagggtcctataaagagggaggcagaaaaatcagtgttacagtggcttaatgtgagaaagacttgactggcaattgcaagttttgaagatggaagggggccatgaagcaaagaatgtgaacagcctttaggagctagaagaggaaagaaaaggttctgccctagaagattgggaggcagggcagccctgctgacaccttaattcagcccattgaaaccggtttcagacttctgacttccagaattgtaagataacatatttatattgctttaaggcactatattggtggcaatttgttacagcagtaataggaaatttagacagacaattctgttcttggtctatagcaccacctcaaagcatccttattcattgatcgctcacagttaaccaccctgccacttgacttgccaagacctattgattctgtctcctaaattcttttaagttttgtttttctgtttttgttttttgagacggagtctcacactgtggcctgggctggagtgcaatggcgcgatctcagctcactgcaacctccgtctcctgggttcaagtgattctcctgcctcagcctcccaagtagctgggattacaggctcctgccaccacgccccattaattttttgtatttttagtagagacagggtttcactatgttggccaggctggtctcgaactcctgacctcatgatccgcccacgttggcctcccaaagtgctgggattacaggcgtgagccactgcacctggccaagttttgttttatttttattaacaaactaataacaattgtttatatttatgggttacaatgtgatgttttgatacatgtatacattgtgaaatgatcaaatcaggctaattagaatatgtatcatctgaaatatttatcatttctttacggtgagaatgtgtaaaagcctatcttttcctaaagcgtctatgttccatccatctttccttgtctccacagctactctctgagagaaaacttcagcctgtggctccttactgttctccctacgtctgctcaggccactcccttcgccaaccccaagctgggcaggccattcaccaaactgccccagagggtctttctaagacataaatctgaaatatctcaagacaaatggcttgccattgacagcagaatgaaaatcacctttctttacctgataaaatatctttcacagtttgacacctacctaggcatccaactgtaatgtctgcttcctggtcaaacttgctgcttgaccagcatgacattcatacctggtgcttcaacatgactctgtgcctttgtctgctgttctctcactgctcctctaactgacaaacccctaaatatctttcagtactaaaccaactgtgttggcgggctcttgacagtgagctccttgagggctgggacctctcttcatctctttgtctgcagtggctagctgaggcctccctctgaatgaagaggagggggcaagacttcctttctcataaccgctagcctaccttctttcctgccacattagcttacttttactttcagctcatatttggctttggaattactttcagaattagcagttgatacccgcccagtcagacaccatgtcctcacactcctgtgttttcagtgagcaggtgcaagatttaagaaatagtaaaagaggcggtggctcacgcctgtaatcccagcactttgggaggctgaggcaggtggatcacgagatcaggagatcgagaccctcctggacaacatggtgaaaccctgtctctactaaaaatacaaaaaaaaaaaaaaatttagctgggcgtggtggcacgtgcctgtaattccagctactcaggaggctgaggcaggagaatcacttgaaccagggagttggaggttgcagcaagccaagattgtgccactgcactccagtctggcgacagagcgagactatctcagaaaaaaaaaaaaaaaagaaatagtaaaagaacaatcagctctgatatcctggccacttcatctaatgctaagaccttcattttaaaagatagatttagggtaagaagcacttgtcagtctcaattttgctccagatgaggacccacgcaaaactacttctatgctttcctttcttggttataaagaattccactttctttcaattttcagcatagataagttttttactttcaaatcatccattacttttctctggcccatctccaatttcctaatattgtgtttaaaatatggagctcaaaattaggctctaacatagaccttatcaatggtgaacacagtgagtaaatttcatggttcttgtgtactacatacattctggttaatgcaatcccagatcatgttcaccttcttgataacagccctatattgctgacacatatccctgacaggtgagaatggctttttacctatagagtacttacatgtcaattccaatctttatgatggctaggatagtctatcagtatattttttctggaataataaaaacatcacctattgcaaagagctgtctaatgcactgacagtatagctcatcttgacttgatgttccacttcataattggaaccattagactgaaatcagagcttctgaaaattctctgagttttatttttaaacatgttatatatttatgtgggtacataacaatttcattcaaagtaaaaataaatacagttattcttcaactattagttgatacaacttcactttagaagccataaatatcagaaacaatgatttagataaaccatgtggaaatagttttaggaggtatcctccaattccatttatggaattctctttgcattttccaaaaaaaaaaatctataacaggaaagacagttgaaggcagagactgcattttaagttatctgcctttctaacaaagcaatggaaagggagacccaaattatgcttctgaagtgaaacgggataagcttagcaaaaaatttcatctctaattaactccttaaaaaatttcagtccagattaagtatatttctgttaattaacatatatagttaatttcattttctcatattgacctagtaaaattaaagcatacaaatacatctaaaattttttgacatactttcatgacagattgaacattatcttattaaagcaaaatgtatagataagtgctttggagtgaaaacatctggatcatagtcttagtgcattcaatcactataagatcaaaaaagtcacattactctttaagatctccatttcttttacatgataatgacaatcagtaatcgtcataacgcttacaacaatctactttttccctctgatgtgagtgtggctgagaaatccatataacccttaaaaaaataatgaataagattaaaatacaaccctgtaatgtggaccagtatgatctctaaaatacaatctgacacttcaatatagggaagttgaggttggaatttgaagttgaaagtcctactggagcctcattcccatacctcctagacatatggcctctgagccgtggtttcctcattactgtgtcagatagactacactagtttcaagtttttgttcttggaggtgaaattctgctcagatcctcaataaacaaatgatgaaaacagggctgctctggtgatgccaatgtggcagatgtggggcacttcgcatcctaacccttcattctatggccccagcaaaagttgcatggaacaaaattttaaaaccaatggaagcgatttagatatgattgttttcaattatcaagtcttggtgtctcttaaccatatgcacttgccagaggtggggtgagggagaagtggtattttaatggcaaagagcactggtacagatttggacttctaatccttggtaggctaaatattcaggaaagctctcctttcataaaacatttgcatgatggataaacagctaacttacagataaacacattgctgagctctccagaaaacaagggaagctaacaaaagatgaaacctacaaactaaaacaagaatgctaagcaaaccctgaagttgggccttccatgcaggaaaaaaatgaccaaaccaggaacccagagctttggacattaatggaaaaaaaaaaaaaaaaaaaaaaagcaaagggtctgcagaaagtagtgctgttaagtctgagaccctaaattcaacgggtactagaaacaacctcaccctcagtgaaagagagcaccaaaagccaatagcctgttgcagaggaaacagataggaagcctacctgtccctgcctactctcaggataaatatagcaagaaaataattgtctcccctcagaatctacaacagaagaccagatctcagatggtgtgaagtttatattacttggggtgtcaggaaaactctaggccaaataataactattatcaagatagggtgtcactctgtcacccaggctaaattgcaatgacacaatcatagctcactcagccttgaaaccctgggctcaagcaattctcccacctcgacctccaagtagccagactataggcgaatgccactatgcccaactaattttttatttttcatttttttggagagatgcagtctcactatgttgcccagtttagtcttgaactccaggcctcaagcaatcatcccatcttgtccccagtgcactgggatcacaggcatgagccaccatgcctggcccaggccaaataattaaataaaagctgcccttagttggctacttattgaagccctggtaccccaatgaagcacaggcaagtctattctgcaaaaaaaaaaaaaaaaaaaatccttaatatacatccctcataattcccacagattaagttcagccaagtatgagctcacaagcaaacattaatatatgtaggtgaggaactaagccaacagcaagctacaaatttgcttgatggcctcaggtattagcattaattgacatagaacagaaaatcgttatgctctaagtggctgaataaatgagaggaaaaattttttaatgatcagaaaatatccaatcagacaaaaaaataacaaaacagatgattttataaataaaaaagaaagcttttgaaacaaaaaactgaatgatgggttacaccacaaattagaactcacttgaaaaaaagattcagtgaactagaacaaagacttgaaggagcaaccccagattgcagcatagagtgacaaagaaaacagaaaatgtaaattagaggttatgaggcatgaatgatcgaaaatgagaaggaacacattacaattaaaattgtctttatccaaagacaccataaagaaaatgaagagttaatccacaaacatggtgaacataaaacccaaaaggatgttacatagaatacattgaaaaatgggccgggtgtggtggctcacgcctgtaacctcagcactttgggaggccaaggtgggcagatcaggaggtcaggagatcgagaccattgtggctaacatggtgaaaccttgtttctactaaaaaaacaaaaaaaattagctgggcacagtggcacgcgcctgtagtcccaactactcggaaggctgaggcaggagaatcacttgaacctgggaggtggaggttgcagtgagccgggatcacaccactgtgctctagcctgggcgaaaaagtgaaacttcatctcaaaaaaaaaaaaaaacattgaaaatgcctatgtatcaaaagataaagacaacccaacagagaaatgcgcaaatgtcagaaataggtatttcaaagaagaggaaacataagtggtcaaaaaaaagtatgagaaaatgttccaatagtaaccaggaaaacataaatttaaaccaggaggtatcatttgatactcaagattgggggaaattagaaaagttgtggtttccaaatgttgacaagagcacagagtattgaatacaggtgggaatttaaacttaacaaccactttacacagtaatttagcactgtatttgaagatacacatacccattggctaattatttcaatgactagatgtattatttcccagaaaaccatctgcacctatgtcttacagatatataaggtcttagcagcattatttgtagtagcaaaataaaaataaaaaacccaactatgaacaattcaaatgaatcaagagatcattaaaaacttctgaatagtcatacaatggaatatttcacagcagtgaaaattaattaagtgtagctacacaaattaatacagataaatctcagggataaaatgttgaataaaagaaaagccaaacagagtatgagtccctctatataaactcaaaaacacataaaacaatatattgtctacagatcacacatgtagaatacaaccataagacaacataaaaggcacagaaaggaggtttggtgggagagagatgaggggcagcaaactggagaaaagtacgtaggagacactccatttattggcaatggtctttagctgggcagtgcacacacaggtgttttgtctttctagtcttataatgtaagtacctgttacatgctttcttttatatgtatgtaatgttttgttaaaagtattaaaattctaaaaagagcattggagttgggaacgagcagcaaaccccagggaaaactggagctttggccagatttgtctcagacccctcccacctgcattttgtctcagccaattacagctcccatccacgaatactgccaaaggagtatgtgataatcctggtgttggcaaatagaagttggaggtaacttttcccatggaaactttgaaggcaaaagaccagcctggctttgacaccctccccaaaacagccctgtgccaggggacaccttctcacagcagcccacacacgactcagctccacaatgggggtgactggagggccagcctgtggaccacttacaagagcatcccagagcccctctagagggccagttacccctaatgatcacaatgctttctctatatttttcaccgtgtgtgctcaacaagctcctagtcattcaccttagttgaaaagacaaataatttgaccaactttttgactagatataaaatgtgaaaggagtccaacaatgcatacaagtcacacttcttatattactatttaaatgttagtgacttctgaatttaagaattgtgttactatttgtcaactaatcaatatgtttactgaaacactcagtccttataagcataacttagtgcatactgcaataaaaaatttaaaatcttgagcatctgggacatgtaaaatatgtgattaagtaatttatgggaacattcatgcagctttatttatagataatttaaaataccatcattgcattttttttaagtaaaaacaagtacacaaagaatagaacaaagaacagcttgatttattcttgtcagtaatagaatatcagtatctattagaatgtgatttaagttaattcctcaaaattagtttggttggattttcaatgtttttacatcagaatgcaaaacttattggtatagatttttctatgctgtaaatgctatcttaatgaaatatagaaggaagggaaggaaggaagaagaaattaagctttttctaaagacaggctatatgattcaactaagccaatttaacttaactgcattgatatttgccagattgctatcctcctctgcagaggaaggccctgaaaacactaatgttcatcacaaattctcctaaagtcacattaggatctgataaaatcaataattctttggcacattaaaaattgatctcaaggagatattgccttataattattcctttgccagatacccatacaaaaacactttcataaattgttaaggttttacttaatattctgcatccttgaagttctcaaaaatatcagtaactatcacgttagttattcagcagcaacgctgtgctagtatttcatatagtaacagaatacatgccaactaattccaagaactgcttgtataactggattaaaaatttcactaataattattgtagagaagaccagcagcctagagtctgacaaagattgttgtctggagtgacttctcatctgtttaccttcctacaggctttggagaccatttcactggcaatgaaggaattctactgattttgcccaaaatgcatcctcaggcctacctcctttcagggagaaggaaccaaacgaataaatgatcccatagcctacatcagagatcagaaataaaatggtttggaattgagggtgagtggggagagagtgaccttgagaagccactgcaggagggcccttctaggtctctgaggcaaccacaactcctccagctttgttttcttggttattctgtctgcagcgaaacccttaaaacaaaacaaaacaaaacaaagaagcccttcgaagctcacctgagaagtgactagaattaaggagaggttatggagtgttcgtactcagcaggaattcgaaaccatggaggtagccaacaagggcgccctcacccctgagggtccatttggatttgcaattctattcccccacccccaccctgccacccaatctctgtacacacacacacacacacacacacacacacacacacacacacacacacacacacaggcactccctttgaagcaatttatcaggctttcttctggggaaagtcttggagtaaatattagttttcttaacttatccttcttctattgacaatgacctgttttgtaccaaagaagctactgagtaatggagttatgaagcacgctaaaactgggagttcatccaggtaaagctatctgggattttgtgccagagtctaatcctcttgccctctaggtctggaggtatctctacaaggtcagggagatgtgctcctacctaagtgattgtctcttactgcgcccaacaacgccaggccccattgtgctcggaggagtgaagggattacaagagggcaaaataaactcttccaagatgcacagatacttcccttctaatatctctgcaccatccagagatactagcaaggaaggagaagttccctttacaatttggaatgcagtatccaggaatgtggtataattctttgatttgggtgataggtataaatagcagtggtaaaaacagcaagttacttctgtctacaaaccgaggtcaagtcatcccttcttaaaaaactgttagctggactgttcctgtctggtgtaatagtgtgaataaagattagtctgtacacatacatacaattcctcaaaatagtatcttcatataaggagagttatatttgtataaaagaacgtgtttgaaaattacaggcaatgtagcaacaattcctgaattattcttttgtttacttagcacttcagttcaaaaggctaattagttattttgtttaagctgaggaagaggggctgaggctgacatggaacccaaagtaactatctttggtttatatataggtggttaggatatatcaggcgctgtgtagccctccctttattatctcactgaattttcacaacaaccctgggaaagaggtattattatctccattttgtaagtgaaagaaacaaagagggagagaacttacttaatgtctcatgggctcatagctaactattagcaaagccaacattcaaacccaggcctaactccaaacctcacgaccgaagttgaaccaatacttattgggagatggtgcatgaggcagcagggagattcctggctcccattttccttcaagagactctgctgcaaggagcatgggtgatgaacagcctccagttgccatacctttgcatcaccacagctttcactccaagaccaagattttccagggcttctctcagcccatgtctaagcatgcgctaagaaggttgtcagaagtgaaaggctcaggcagtttatcagagaggcgggtggagatctggaaggacagtgctgtggatctcagatgcctcagagacaccagggctcccttggggtgaacccacagctagggagagatggtgccttagggagggaaagcggcatacctagatcagaaggagcttaatgtaccagattttaagaggctgttaagtgagaagggaaaccgggacccaaatgaggtatagatattgaatgaatagaagtttgtagagtaatagcaggtagaacgaattatttacattttctttttctttggtgtctcctgttttcttcttcctccttgattatctaactctaatctccttataaaaaacatactcttgtcctttttctttcatcctccagtcagcagaaaaacataccaatgaacattttatttcttttttttattatactttaagttctagggtacatgtgcacaacgtgcaggtctcttatgtattagactttatgttcgttgttctccatacagattaattgaacattaaaatttttctttctcaagaagagttaactgctcttttaacatgtatcatggccctcaattaacattctttcatagggtcatagggtcaatggtaagaagagggtacacttttcactttcatcagaggtattttcataggaaaatactggctaacaagatttatcctataaaattaaaacactagtgaaaatcaaattcacttagaaaatatctatatacaatttcacttactaaaagagctaaaataaaggctaaggtttttcttaaagcaatcaacttcaggagctacttgcaaattagtgtctgttcttttctttaccagtcattagcctgaattggtacccaagtcatgttacgagaaaataaagacttacacagaccattttaaattctgtagtctcaattaccatatatgctcttattaattgtttctaagaattcctcttcaaaatgtgtgcaagtaacgcatcatatggaaaggcaactgagttttcatatacggcttaaaaatacaaacttcagaaacacagatgttataccaaattctcacttgcttactcccagctaaactcaatctctgagctttaaaaagattttctaaactgctaaagattaaaaaaatgacattatacattcacatctggctctgtcaccatttagggcatgttaacatagattttaaacatctggggacaggggaaaagatctatcgggagcttttcactaccatgacaactgaagtgtactgttgctcaaatagttcagtctctgctcatctacatttaacaccaccacaggccttccatttttcaccacttaaaaacaacaattatcataggaaataatactcatatgtagaaagttcctagggagagtgtttctttcatttccatcctgctttaatcctgtgggtaggacagatccttcctctttgcagcaatgcagttaaaccagtttatattttctggcttttagacatggaagtccttcctatatttttgagtcactcaagagatggctcttaatgacaaagtcttaatggaaatggtgaaaataacctagcattatttttttctataaagcagcatcctttctgtgtgttcaaaatttaaccaacattctaaagagcatagaatatgggcaataaaaattataggtttcatgtgttaatgttttctgaatggcagatgtacaacatactttagacatactatttttcatttattcttcaaaactacctgtagttagtattattactttggaaaattaaactatggagagaggtacaacattcacacaaccatgtattaagtgcctatgcttgggcaagtgctgtgctaggcaacaggaatgtaatggtaaaaattacagcatgccccaccctcatggagtgtatcagtctgttctcacacggctctaaagaactacctgagactgagtaatttatgaagaaaagaagtttaattgcctcacagttccacacgcttaacaggaagcatggctgggagacctcaggaaacttacaatcacgtcagaaggcgaaggggaagaaagcatgtcttaccatggcagaacaggagacagagagagagagtgggggaagagctatacacttatcagataaccagatcttgtgagaactcactcactattatgagaagagcaaaggggaagtctgcccccatgagccaatcacctcccaccagggccctcctccgatacgtggggattacaattcaagatgggatttgggtggggacgcagagccaaatgatatcatggagcctaccatccatggccaagaaagggaaacaaagggccactgacaggtgggaatggaatctaaatctgacttcaaagcaaaaaccaaaacatcaggtctgactgacttctaaaccaaaagccttgaagtcacctttgactcacctcttcctgtcacacacaatacatccaatccatcagcaaatcaggctagctctggcacaaaatcaatccagattacaaccacatctaaccacccaggtcaaaatcacaaccatctctcacctggattattacctccattcctaactaatctctccatctctagccctttctctatttattctgttctcaagagacagccatctgggtcttgctaaaatgttttgtcagacatgtcactcttctgctcaaaaccctgcaaagtctcccatctcactcagagaaaaagctgagtccttacatcagcctgcagggccctatacaatgtactgggtcactgtatctcccactgctcactttcttgctcactcttttctggcccacagtcttctctattgttcctcaaacatatctggcctcttctcatatcaggagtctgtacttgctgttccctctgcctagaactctcatcccttccgaatggtaccagcttagcaaggcctatcctgcccatatttatgacagcaagcctcctccagcatgccctattctcccttccctgcctcatcactctctgcagtacaaatcaccatctgacatacactttacatgttgaaattgttcactggctgcctcttgtgtctcccggctctacagagctgactgtgctcatctcttcccagctcccatccattgataccatattgctagcctgaaatcagctgtgatcagcaaacactacaaaataggcctttaaagaaaaaaaaaaaagacagccaaattagtgtatagcactctcctcctaagaacacatagccccctccaacaagaaaatatgctgcatgaagcagagtttttgtccattttgctccatgctttctccacagaaccttagtgcttggcacatcataggaacaagataaatgtttgttaaatgagtgaacatttctcctatcctcaagcagattgaaagtactagtatcagaactccaaaccttcattttcagaactgctctaagcatgttctgtggtttagaaagcgtggccattttcctgaacctactccatctgttcctaacgggggctcctctccacttgcatggtctatgggcagaagacacaaggattgccagtgccctccagtctctgcacatgcctctaactcacagacggcaaagcagtaaattgggaaaagcctgacaaaactgttttttcatttttattgtaacttgttaaaacaaatattaaactacagatgatacagtgtgctatgttcaaaactgtagaaaaatgtgtgttaaaactatgggtcatgtttaagaagacccctttaaaaacacgttgtttagaaagtaaaaattttttttaggatccaaggagcagtttaacagaggctctaaaggaaagagcaaactgataaggatctgcagaggaaacatgttattctgtcacatacatggaggataactctttggtaagtaaaagagaaagaatgtcactgacccacgtaaatgtgttaacagtgccttaattcaattgaagtgggaattctagaatgttcgtgagcttggtgaacatgatggagggaagaggtctgaattctgtggtgcaggtgggagagtctgtgattaagataacaatcaaagtattgaactaggagaaaagagggaagaggtttaatagaaccctccaccaatcatgcttccttcaggaacacaaaattggacaactattcacacccaaaaagcacctttaaaagaaccaaaaatcacagtacctggttttaaatttatatcactgaaagaggcactgaagaggatataaaagacaatattgaattcctgatgccaccccttcctcattccatggcagtacatcccaccatcgctgcactctccctcccctaaacacacttgggaaagggagagtgcagtgatagtgggactttgcattgaaactcagtgctgccctgtcacagaggaaagcaacactaggcagaactcaactggcacctacagagggagcatttagaccagccctaaccagagaaaaatcattcaccccagtggtcagaacttgagttccagcaagcctcatcactgcagactaaagtgctctacagatctcaataaacttgaaggcagtctaggctaaaaggactacaattcctgggcaagttctggtgctttgttgggccaaaagtcagtggacttgagatgcatatgacctagtaagacaccagccagggcagccaaaggagtgcgagtaccgcccctccaccaaccccaggcagcacagctcacagctctgggaaagactccttacttctgcttgagatgagaataaggaagagtaaagactttgcaagtccaagttcaggacttgcaacttggatactagctcagccacagtagacaagggcaccaggcaaagtcctgaggcccccattccaggccctagcacctgaatgacatttctagacacattctgggccagaagaaaaggacccaatcttgggtaattcatcacatgctgactaaagagcactttgaccctgaataatcagcagtaggacccaggcactactcactgtgagctttgggtaagactcagagacatgctggcttcaggtgtgacccagcatattgccagctgaagtggctatggggaaggaccccttacgcttgagaaaaggaaagggaagagtaaaggagactttgtcttacagtttaggaaccagctccgtcacagtggcacagtgggatagagcatcatgctggctcttgtggttctcaattccaggtgttgactcttgcacggcatttctggaccagcactggccagagagaagttcactgccctgaagggagagttctaggctggctgtatccaccacaagttgaacgaagagcccttgggtcttgaaggaacaatggtggtagccaggcagtactcactgcagacttggggcagtggtaaccatgaggagagactcctctgctggtggaaaggagagggaagattcaggaggactttcccttgtggcttgggtgccagcttagctacagtagaatagagaatcaggtagattattaaggtttccaactctaggccctggctccaggacagcatctctaacctgggggggatctttctgccctaacaggaagaacacaaacttggctggctttaccacctgctgattgtagagccctaaggccttgagtgaacacaagtggtatccaggcactggttaccgcaggccttcggcaagacccagtgctgtgctggcttcaggtctcacacagcacaatcccaataatggtggccacagggatgcttatgtcacccctcttccagctccaggcagctcagcattgagagagagactctgtttgtctgggagaaagtaagggaagagaagaagagtctctgcctggtaatccagagaattcttccagatcttatccaagaccaacaaggtgatagctctctgagtctgcaagcgtcacagcttgggcttgggttaccctctaatgcagatatggctgcaaggaccaaaaacttataacactaacatcttttcaaatacctggaaaaccttcccaagaaagacgggtacaaacaagcccagactatgaggactacaataaacacctaactcttcaatgacaagactggacgaatacccacaagcattaagaccatccagaaaaacatgacctcaccaaatgaattaaataaggcaccagggttatatccaggggagagagagctatgtgactattcagacaaagaattcaaaacatctgatttaaggaaagtcaatgaaattcaagatagcacagagaaggaatttagaatactgtctaattaatttaacaaagagactgaaataattaaaaagaatcaagaagaaattctggagctgaaaaatgcagttgacacactgaagaatacattatagtctcttaacagcagcattgatcaagcagaagaaagaattagtgaccttggagacagacttattgggaaatacacaaaggagacaaaagaaaaaagaatcgaaaagaatgaagcatgcctacaaggtctggaaaatagcctcaaaagccaaaagcacaaacctaagagtcattggccttaaagaagaggtagagagaaagagagataggggtagcaagtttatccaaagggataataacacagaactttccaaacctaaagaaagatatcaatattcaagtacaagaaggttacagaacaccaagcagatgtaaccaagataaggtgaccaagacatttactaatcaaactcccaaacgtcagggataaggaaaggattctaaaagcatcaagaggaaagaaataacatataatggagctccaatacgtctgctggcaaacttctcagtggaaactttataggccagaagagtgtgaaatgacatatttaaagtgcttacagaaaaaaacttcttatcctagaatagtatatccagtgaaaatatccttcaaataggaaggagaaataaaggagaaataaactatacaaacacatggaaattagacaataagctcctaaatgactagtgggccaatgaagaattatgaaggaaatttaaaaatttattgaaacaaataatatttttagaggaataattttattgtagaagagtcttatgtaagcataagagcaaagaaagatcccaccaaataaataagcattatatatgattacataaaacataacatttcaaaatacatgcacacacacacatcacaatatacatgacagagaaaagactaatatctttactatatgaggatattttataaataataaaaaaggtaaatacatcaatagatcaatagaaaacctggcaaaagatataaacaggcaactcactgaagaagagctagaaataatatatggtaaaatggatggcaaatatatgaaataattttaaaaccttatttgtgatcaaatgaaaatttcaataattccaacacatttatcatatgatatatatacacacaatttccacatttatcttataaaactggccaacatttttatttttaatgaatatgcccagcacttaataaaaatgtaggaaaatgaacattcatgccagctcatggaaatataaattggactaaccattctaatccacaatttgacaataaatataaaagccttaaaatgtattctgtatgaagtaggatatacgttaggatatcagattctcctagggataataccaagggtttgaggagatgatattcactacagcatcatatgtaactgaaaaaaaaggatagggcaatctaagtatccagtagccaaaatgtccaaaccaatcatgaaatatgtgcacaggattggaataatatgaagatgacacaaattaagtagtagacaaacacagtgaactatggaaacaattgacagtgtatttctaagggaaaaagtatcaaaaagtacatgctatcattcatttagccaacacatcgagtgctgaacttaattatataaataataacagcttatgtgtatatgtaaagaaaatacagaacagacataaggataataatattacctttaagtgttgaatattataatgaagatgatggaaatcatccatcatctcactattgttcactgtaataaacgtgtaagactttggaaatcagaaagtaacaagttataaggaagttataaggtgtcatgctttaccatatcttacttttttaaacatgccatgctctttcaatatgtcatgctatattgtcatgcttttccccataagttataatatgtcatgctttttattttgcaaaatcccttctcctaagagtttaataataatgataccaatgggatggcaaaatggttccagctgcttttttttccttttatttattttatttatttatttattttattattattatactttaagttttaggatacatgtacacaatgtgcaggttagttacatatgtatagatgtgccatgctggtgtgctgcacccattaactcgtcattcagcattaggtatatctcctaatgctatccctcccccctccccccaccccacaacaggccctggtgtgtgatgttccccttcttgtgtccatgtgttctcattgttcaattcccacctatgagtgagaatatgcggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacattcgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaatagtgtaaaagtgttcctatttctccacatcctctccagcacctgttgtttcctgacttcttaatgatcgccattctaactggtgtgagatggtatctcattgtggttttgatttgcacttctctgatggccagtgatggcgagcattttttcatgtgttttttggctgcataaatgtcttcttttgagaagtgtctgttcacgtcctttgcccaccttttgatggggttgtttttttcttgtaaatttgtttgagttcattgtagattctggatattagccctttgtcagatgagtaggttgcgaaaattttctcccattttgtgggttgcctgttcactctgatggtagtattgaaacaaataataaaagaaaaacaatacaccaaaacctcttggatacagcaaaagcagtactaaaaaatttttccccattcagtgcaatactagctgttggttggttatgacttttattgtattgaggtatattccttaatacctagatttttgagggtttttaacatgaagtgatgttgaactttatcaaatgcttattcagcatcaattgaaatgatcatatagtttttatccttcattctgttcatacgatgtgtcacattgattcatttgcctatgttgaactatctttacatcctggggataaatcccacttggtcatgatgaatgatcaagtttataagatctggaacatgacatcaatgcccactttcaccactgttattcaacacaactggaagtcctagccaaagcaatcagacaagaaaaagaaataaagggaatccaaattaggggggaataagtcaaattttttggttgcagatgatctgatatttggaaaaacctcaagactttaccaaaacactattagaaatgataaatttcagtaaagttgaagaatacaaaattaacattcaatgatcagtagtgtttctatatgccaacagcaaacaatctgaaaaagaaatctagaaagtaatcccatttacaacagctacagataaaatgaaatccacagaaattgtgtatttcacaaaaatgtgaaagatatctacaatgaaataaaatacataaaaatatgtattttacaaaaatatctacaatgaaaataataaaatactgatggaagaaattgaagagaacacaaaaaatggaaagatatttcatgtgcatgggctggaagaatcaatatggttaaaatgtccatactacacaaagcaatctacagattcaatgtaatccctgtcaaaataccaatgacattcttcacaaaaataggaaaaacaatcctaaaatttatatggaaccacaaaagatccaaaatagccaaagctataccaagcaaaaagaacaaaagtaaaagaatcacattatctgacttcaaattatactatagagttataataaccaaacagcatggtactggtataaaaacagacacatacaccaacagaacagaatagagaacccagaaacaaatccatacatctacagtaaacttttgacaaagatgtcaagaacataccttaggggaaagtacagtctcttcaataaatggtgctggaacaactggatatccatatacagaagaatgaaactagacccctattgctcatcatatacaaaaatcaaataacaatggattaaagactaaaatctaagagctcaaactgtgaaactactacaagaaaacactggggaaattcttcaggacattggactgggcaaagacttcttgagtaataccctataagcacaggcaaccaaagcaaaaatgaagaaataggatcacatcaagttaaaaagcttctgcacagcaaaggaaacaatcaacaaagtgaagagataacccaaagaatgggagaaaatatttgcaaactatctatctgacaagggattaataaccagaatacagaaggagctcaaacaactctctaggaagaaatctaataatccaattaaaaaatgggcaaaagatctgaatagacacttctcaaaagaagacatgccaatggcaaacatgtatatgaaaaagattctcaatatcattgaccatcagagaaatgcaaatcaaaagtactatgagatatcatgtcaccccagttaaaatgtcttttagccaaaagtcaggcaatagtagatgtttgcaaggatgtgaaaaaaagggaacacttgcacactgtttttaggaatgtaaattagtataaccactagggagaacaatttgggggctcctcaaaaaactaaaaatagaactaccatacgatttagcaatgccactgtgagttatatacccaaaagaaaggaaatcagtatttcaaagagatatctgcactctcatgtttattgcagcactattcgcaatagccatggtttggaagccctcaacagacaaatggataaagaaaatggggtacatctacacaaggagatactattcagccataagaaatgagatcctgtcatctgcaacaaaaatggatgcaaaggaggtcgttatattaggtgaaataagccaggaatggaaagacaaacttctcatgttcttacttatttgtgggagctaaaaattaaaacaattgtactaattgatatagagagtagaacaatgatcaccagagactgggaagaatagtaggagcagggggaaggggagtagttaatgggtacaaaaatataattagatagaatgaataagatctagtatttgatggcagggcatggtggctcaggcctgtagtcccagaactttgggaggctgaagtgggcgaatcattgagcacaggagttcgagaccagcctgggccacatgggaaaaccccatctctactaaaaaaaatagaaaaattagccgggtatggtggcatgtgcctgtagtcccagctacttagggggagtaccgcttgagcccaggaggcagaggttgcagtgagctgagatagtgccactgtgctccagcctgggtgacagagcgagaccctgtctcaaaaaatacatatatatccagtatttgacagcacaatagagtgactacagtcaacaataatttattatacattaaaaaataactaagaggataattggattgttcgtaacaaagaaatgataaatgcttgaagagatggataccccatttaccctgatgtgattattatgcattgtatgcatgtatcaaaatatttcatgtaccccttaaatgtgtacacttgctacgtaaccacaaaaattaaaaattaaaaaaaaaatcacagagtattggattaggccaaaagtgtgcatacagagtttgtgcttattgtgcatagagtttccttctttattaatgaagctttctgtttttcctttctttagagttatcaatataccctaagtaatttatttgtaaccgcatagtttgttggtaaaaagttccctacaattttccttattttcaaatattaccaatggcagtaagttaacacattcatgggagcaaagctacaaaaatgttaagtctggccatatagaaaaccctggcttgatgtgtgtttagtgcttaaaaatccccaaatatatgagatacattattacatatcatctgaccaacaattttgtagagcaaatattgcaaatcctgaatattataatactcattatatgcatgtagataagtataaaaactgaagctcacagaggttactgctcaccaattagggcaagtacagttgctgaagtcccagcctgcagactcaagaccctactgctctttctaatgcatgatgctgattctcttgaaggtaagtttggaatcttcagaggtatgtgttaggcatgggtagatataaggattctctgataaaacctctggtagagacatcctgtgaaatgtctgtggtctttgtctctgggtaatatctgtctaatcctctcttgagctcagggagttgcaatggcttaaggctggaagcaccaagtcactgagcagagaaacatccaggaacaggcatgcatgtatgatgcagaatggctgggaatcattccatcatgtgacaccactttacgatatcttcctttgttatgtgttcctgaaaaatactttagaaacatatcctcttcactaaagacatttcagtaattgactccttaattcaataaatgaaagcatcattattttgaggtctaagaatgggtacgagcatggggagggcaaagtgtcatttctggttgaatttcctgagaataagaacaccggactttaaacaatatgatatgactttttccccgaaactgaagttatttctatcctatttaatgtcacatatattttaactattatgtaaaaaacattgtgttagatgtcaaaggatataaagatgactgagatcatttcttccctcaaggaatcgccaatccaatgaaaagatgaaactcatctttctagaatacattttcccgtgtttatctttgaaagagtacactgaatattatacaacttcttcttgatgactgagggacatcattccaagccagctgatgttctgggccacaacaataagcacagctgcagctagaaatgagtgtgacaggagctcagggctactggtcataggagttaaccaagaactgccttctgccatctcaaattgggtggatgaggggctggatagataacagatataaataccctgatgtcatgattgctttttggtcttttccctttttcctcccatcctatatatgaaccaaagacctgcttcatgactaatgtgctttgaaccagcacaaaaccgccattagccatcagtgaggtatacaggtagcaacagctgaagacctttcctgtcgggcaccctgcagagtgtccaggtctgacctaaatgttactccttattgctgggcctcctctaacgtcagtgtcagctacccacctcctttcatcacttgaatttctaaaccaactggcatcaccccttctaagctctgccagttattctgctattcagaactctccgttctcaaattacaatgtgtataaaatgtccagcacagtgcctgacacagagcaggcactcagtaagtgctagagcccctttccttgtattttatagtctaatctttgatctgacatttttcctgtctctgtgtctttttacgatcaggtggatatacataggtacttctttatggttagcaaaccaaaaaatcacaatccattactttctatttgtatgtatctgtgaatgaagctttttttccttttacccctgcataagatacttcttaggttatctacaccttaataactcatttgcaactgtatagatagcttaaaggttcttttttattttcataaattttctccacccagtggttataatttaataaagtagtcactgtggctgtatttatattttgtaagtaatttatgttttggtacaatgaataattctggatgtgagttatgtgactgtgaatatacagtttgagctttctagaatctcttcactaccattctgatgctgcctcctctcatctaatgacaacaacctcatagaagagataaaagtctaagattcaaatctaaaaggcaaagcaattataaagtatagcacatgtagcatctaattatttttccacatataatgtcacacatgcaattggaaaaatgttcttttgttatttgtaacataaaccatgtcattttattttattttcacttccttgcagactctcattaaagcttgcacacatattattattccattgaaaagtaataacttcattattatggcataacaattaatgtaaggtgtatcaacacaaatatttaaaaggaccattacaaaagtaagaaaaacattaatctactactagggacttacttcattcatgtaagaaatttttccatcttctgtccatctggagaagagcaagataaattaatctttggttccaaacatttttagagttgttttatcaggaaataacttcctattttcccaagttttgaaattttgcaccttctcataagtataaaagaatctcagcatttcactttgacccatttcaaatttatatggcagatttccaaatgctgggaattgcaaagtgcctgttcttagcacatgatatctaccatctgccctggccatcaggatagggtccagatagttctccaacataatattgtaaagtcaaagtgctcttggcatttatgtaatatttttgcaacattttgcaggtgataaataaattgtaactttttcaaactgggactcatctaattacatgcatgggagcacttttcttgtgctgtgtattcaactgtgtatgcttgtacctgctcattcatcctccacacccaccccacacaatctgtccaactgagatttgatcatgtgaatgctgagaaaggctaaaggtttggtacccattcaaaatgatatttttaaagtacttattcaacatttattagatggagttggggaaaacttattttccattaagaaaagtatgtctctctttatgcttagttaacgaacaggattagttcacgcactaaatgaacatatcacttttatttgggtcagtctttcatttcacaattttgtggtttctcattaagggacagcattagttattcatattcaggagggcagaggtaactctcacagatatggttacaaagttacaaaatagatttcaaagttcttttatttactttcatgttgttaaaacatttcccatagttttttttttttttcagttcagttttatgacttaccgatccaggaaaatgcttggaaagcacagtaacaacttttaaacttaatattaaaaacaaataaaattgctcattgccaataaatatacctatgtaaaatactactcagtgtaagaatttcaactgacagtgacctgtcaaattcaggcaattctaaaataggatggtggtggttacactgtgcaaaatattcaatagagagagttcaggaatgccaataattttttgttattattatcaaaacattcaataaagatagttcaataatggcagcaactcttactgttatctccctcctatcccaccttgggggccttgtaataaattttgcttgcaaattgcctaagtgttatatgtggaaagctaagttaacaggtgtcatgtttcccatttataccactgatgttccaatgcaaggtgcccggggaaactgccatcccttaatccagctctgctcacccagacatacacatatacccatcaatccatctgttaggcattaagaattacaatagtataaagaacaatcctttggtgtacatatttaaatgttaaatatatactgaagggtttgaagcaaggatctggcaaacacgactgcatcacacatttggttcagccctgtctggatgtcagaatgcatccgtcattttggatttatgtataatgacagaaatcaagtcacgacccatgtagtctcaaaaggctacttagatgatgatgaagatccacaatactccctgaagtactgctgattcttcaactccattaagaatatacatctctgacattttaaatatcttaagtcagtgattttggccatctaggaaaaacaatgttgcagcatgtaatttaggtaatttcaacagagccagttcaatcttaaatcattatttctaatgcattctggcaatactttttttgtaaagtgaaattatacaacacttccagaaaccacagaatgtgacttaacaaccaattacttgtacagtttgcaaaacaagtaaacctcccagcagctgggagcttggctgagaggcctaggcttgcccttggcatggtaccttgctcttttctatgagttcacattgctttctagcctgctaatgcactggccttatgaacacagattccctaaatgctctccaagagtctgatatcacattcagggttaacacattttttcccttgttgcaattcagcagttttttacagtcattcatatccaaccaattgctgtcaacaggcatcttcacatatgaatgttaatagcatattattaaagagttcctggtaatttgttttgtgggtagagttgatgaggggtgactataggaagggaagccaaaggaaaaacatttcaactactctggaagctgacctctggaaagcagtcagagagaacagatgaaggagccaggcaagctctttttgaataagatggtgtgtattacagctaggaagagccaacagagtagatctcacagtgaccagcccagctaacagcagttgaaattgttagtcatgaaaatacagatgccccctgtatggattaccctcatattttctcagtcactagtttgagagtatcatatttgagagacagagtttttcttgataattgagaaagatcaaaaagggaactgaattttcattggcaaaaagactacataaatagaagcaacatctttgttggtgcctacttgtcatcagctagaaaggtccgattttttttgcaaaaaccttaggaacaggattcagggtaccttccaaaagcgaaaagtaaaggcagacttcagggctcctagaaagtttacatccaagaattccctataatgtaaacttgaaaattaatgctttttcctccacaagaacttgtttcaaaaagttagtctggtaactcattctcataaattgttcttagtatttttcttgcagattttcatgatatggttcccaaaataaatcagtagcaagcattatgatctgtgccttccacttcagcatagtactttgctccataaacataatataatgaacatttatgtatcactacctttcttacttttctttactcacttcatcatatcaacaaaatgtatttgatacacagttgcaaataaatattaagctttacattttgtaataaatatttctgagtaataaaaatgttccaactgatcaaaaaatttgatatttgatgatggcatttgaagagatgcatgtttattagctcaatttagccatttcacattgtatacatttttttaaaacgttgtacatgataaacacatacaatttttatcaattataaaaaattttgagtgttatatttgagtgataacaaatttagatgagttaacagaatacatacatacctccttaataaattttattgtttactagtccatcttcaaaagttcatcatattaactacagtcagaaattggttcccaaagttcattatatttattacagtcaaaaacagtttctaggaagtctattgtatttatacaattaaaaatgactcaactattgggtacaaggtttcttttaggatggtgaaaatgttctaaaatgatggttgtacaacctgaacgtaaatgaaaaaattatgtactgctgaactgtacactttaaatgagtgaattttatggtatgtaaattatatcccaataaagctatttttaaaatgggtcaatcaaggacactaagagttgtttatttgaaaagttcaaaaaaattgacaaaccattagctagatcaagaaaaaactcaaatcaaatcagaaatgaaagaggagggattataactgatgccacagaaattaaaaggataagaggctactatgaaaaattatatgccaacaaattagataatccaaaagaaatggattaattcctagaaacatacaacctaccaagactgaaccataaatagaaggtcttaacagacctataagtagtaagaagattaaatctactaaaataccaaaaattagccgggcatggtggtaggtgcctgtagtcccagctactcgggaggctgaggcacaataatcgcttgagccccggaggcggaggttgcagtgagccgccgagatcatgccactgcattccagcttgggctacaaaataagactctctcaaaaaaaaaataaataaataaataaaggaggtatatctcattttacccatttcattccacaataatgaaaaataaaagtgtcagctgtcctaggaatgcagaatataaaaggtggggcaacagggcatgtggtgctttccttagtttactttgacaataaaaactcctatctctgttgctgctggaatagcatttattggaaatcagcctctcaacagtcctcacccatcaggaacaggaatctgccattagcttgacagcatacagagcaccatatcagggttactatgggaagactctattgtggcatcagaaacacaaaaaacactggatacagttagtttctgttgacagtttcagaagaaaatcccacagattggacaggctgcctgctgaaagggttgtcactacacacagcatgccctgaaccctggaatgaagttacccctatctgtgtgatcaggaactgaacaactctgaggctctttttctaagctcttagattcctgcaagaacctcacacttacctcctcacctggctttggacctcaagctaaaagtgcaaacagtctgcctactttccccataaacatttccccaaaataaagggcttttttttttttttttagcacttgcttacttgtgttctcactttctctgtcttcctctccctccctccttctctccctgctcactgtcatcagctgggtcccaatccagtttctacacctacattcatgactaatgacccaccagcagcccctaagagccactaggctgtaatgaacattttcctaccagttacatgtggtaggtctgggaggagccccccatttccaatgagggtatgttaaatacagttagaatgatgcgggatgtggactctggagccttgctacatacaaaatgtggtctgaggaccagcaacaaggcatcatgtgagaacttgctaagtatgcagaaccttagaccccaccccagaactactgaatcagaacatgcattttaacaagatctcttggtgatctgaatgtacattaaagtttgaggagccttggtataaaatttgaatatattttgagagaagactgtggaatttggtgggggatggggaagtggtaggattcttatgtacagggctatttacagagaaaacaaataacattcattaaatactgaataatttactttctttaaaataagaggaataaataaatccaattactatatgtatagggccttgagacatcagtgagcttaaggaatcttcagcagtaaggcttaaatacctattcttattctttgtattttaataaatctgtttgcataagagctttaaattgtatcagtgacaagtaggtatgttttcataatggaataatagtgagcaataacgccccccaaaagaggcggagcaaggcataagtaaacaaaatgtatgtgtgtcgcatacatttcaacaggtgaatccagcatggcatgatggaaacttaagttccggggcccacacaggccccttccaaggaccaggaactaactttgcattcaaaattttgttctctcttcttacagacagcctcaaaaattacataatcttaaaacttcacaaaacctggaaccatgcctgatctaattaatcatgaaaactcttcttaagtttattattattattataatactttaagttctgggatacatgtgcatagaacgtgcagttttgttacataggtatacacgtgctatggtggtttgctgcacccatcaatccgtcatatgcatcaggcatttctcctaatgctatccctcccctagcccctcaccccccgacaggccctggtgtgtgatgttcccctccctgtgtccatgtgttctctttgttcaactcccacttatgagtgaggacatgcggtgttcagttttctgttcctgtgttagtttgctgagaatgatggtttccagctacatccatgtccctgcaaagtacatgaactcgtcctttttttgtggctgcatagtattccagggtgtatatgtgccacattttctttatccagtctatcactgataggcatttgggttggttccaagcctttgctattgtgaacagtgctgcaataaacatacgtgtgcttgtgtctttaagtttgacattatatatatatatctatatagatagatatctatagatctatagatatctatctatctagatatctatatagatagatatctatctatctatctatctatctatctatatatatatatatatattttttttttttttttaggacggagtcttactctgttgcccaggctggagtgcagtggtgtgatctcggctcactggaacctctaactcctgggttcaagcaatcctcccacctcagcctcccaagtagctgggagtacaggtgccgccaccacacctggttaatttttgtatttttagtagagatggggtttcgccatgttggccaggctggtctaaaactcctgatctcaggtgatcctcccgcctcagcctcccaaagtgctggggttacagacacgagccaccatacccagccgacatataatatttttaaatcctttcaatacactgggaaacatttagaattatatcactatcattcaaactacaaatgaaaataacaatttaattgacacatgacctaggaataattctgctcatgtgtaagaaaaactgtttgtaatgatatggttcatatcttactcttctttccatgttatcatttaacatgattaaatttaacaaatatatcgtttgttgacatttctctctcttcccttcttcttttcctcctattttaacttaaaaacctaactactgcagaggtggggaggtactagaggaaatatccaaaaatgttcctcaggaatttttgtttaattttgttttattattttcctcaggtttgaaactcatatctacttacattttttaaagaatgcaaaaggtaaaacaagtaaacacacacacacacatatacatacatacacatattaaaaagataaattctggtgacattttagtgactagtatttcaaactatttaggtaagatgttaacagtgtggttttgagagttacatgtgagtgtatgtatgaacatatacataactgtatgagagagagatctagaaattgctgtcctgcccaccaaaccactgatacacctttttcatacagttaaagtagctgtgcctcatcatgagctagaatgtattccgtatgtatggttatcaatataaacaatctgccaatgctgggcattccgtgtgtttctgattttcattttataaatgaagctgctatggatatccttatgcacgctccctcttgctctttccttattttgtcctgaggacaaatccctgttatgaaaattgcgggataaaactttggaacacaataccagtgtgccttctgaagagtttcatcaatttacagtacaatcaaaagacaatttcacttttaaaacatcatttgctaatttgagagacaaaaaagtctgtttttgtttatatgcttactttttaaacttttaaagtaaaatacacatacagaatagcacacagcttgatgagttgctgttaatttattcctttttatggctgcatagtattccatggtttatatataccacggtttctttatccacttgttgactgacaggtatttgggctggttccacaatttcgcaattgtgaattgtgccactataaacatgcatgtgcaagtgtctttttcaaataatgacttcttttcctctgggtagatacccagtagtgggattgctggatcaaatggtagttctacttctagttctttaaggaatctccacactgttttccatagcagctatgctagtttacattcccacaagaagtgtagaagtgttccctgttcactgcatccacgtcaacatctactggtttgttgttgttgttgttgttgttgttatggccattcttgcaggaatgagctggtatcccattgtggttttgatttacattcccctgctcattagtgatgttaggcattttttcatgtttcttggccatttgtatatcttcttttgagaattgtctattcatgtccttagcccactttttgatgggactgattttttcttattgttgagttcgttgtagattctggacatttgtcagaatgtatagactgtgaagtcctttgtcagatgtatagactgtgaagattttctcccactctgtggtttgtgtgtttactttgctaactgttccttttgtcatgcaaaagctcttcagtttaattaggtcccagctatttatctttgtttttattgatttgcttttgagttttggtcatgaaatccttgcctaaaccaatgtctagaagggtttttccaatgttatcttgtagaatttttatagtttcaggtatcaggtttaagtccttagtccatcttgagttttgtataaggtgagagatgaggaaccagtttcattctcctacatgtggctagccaattatcccagcaccatttgttgaaaagggtgtcctttccccactttatgtttttgtttgccttgtcaaagatcagttggctgttaagtatttgggtttatttctgggttctctattctgtttcattggtctatgtgcctatttttgtaccagtacaacactgttttggtgactatggccttatagtttgaaatcagatagtgtgatgcctccagatttgttctttttgcttagtcttgatttggttatgagggctctttttttggttccatatgaattctagaattgttttttctaattctgtgaagaatgatggtggtattttgatgggaattgcattgaatttgtagattgcttttggcagtatggtcattattcacaacattgattctactcatccatgaacatggaatgtgtttccatttgttcgtgtcatctattatttctttcagccatgttttgtagttttccttgtagaagtctttcaactccttggttaggtatagtcctaaattttttttttttttttttttgcagctattgtaaaagtggttgagttcttgatttgattttctagccactgttggtgtatggaagaactactgatttgtgtatattaatcttgtatctggaaacttcgctggattcttttatcagttctagaacctttctggaggagtccttagggttttcaaggtaaacaatcatatcatcagcaaacagtgacagtttgacttcttctttactgatttggatgccctttatttctttctcttgtctgattgctctggctaggacttccagtactatgttgaagagtggtggtgagagtgggcatccttgtcttgttctcatcttgtcagattctcagagagaatgctttcaagttttccccattcagtgttatgttggctgtgggtacgtcttagatggcttttattacattaaggtatgccccttgtatgctgattttgctgagaattctaatcataaaggggtgctggatttttttcaaatgcttttttttgcatctatttaaatgatcatgtaatttttgtcttaaattatgtttatgtggtgtatcacatttattgacttgtgtatgttaaaccatccctgcatccctggtatgaaacccacttgatgatggtggattatcttttcgatatgttgttggattcagttagctggtattttgttaaggattttggcatctatgttcatcaaggatatcggtctgtagttttcttttttggctatattctttcttggttttggtattagggtgatgctggcttcacagaatgaattagggagggttccttctttctctatcttgtgaaatagtgtcaaaaggattgggtatcaattcttctttgaatgcctggtagaattctgctgtgaatcgctctggtcctgggcttttttgttgttggtaatcttttaattacaatttgaatctcactgcttgctattggtctgttcagggtatctaactcttcctgatttaagctaggagggttgtatttttccaggaatttatccatctcttctaattttctagtttatgtgtgtaaaggtgttcacagtagccttgaatgatcttttgtatttctgtggtgtcagttgtaatatctcctgtttcctttcttagtgaggttatttggattttctctcttttcttgattaatcttgccaatggtctatcaactttatttatcttttcaaagaaccggcttttttttcctttatcttttatatttttttggtttctatttcatttaattctgctctgatcttggttatttcctttcttctgctgggtttgagcttggtttgttcttgtttctctagttccttaaagtatgaccttagaatgtcagtttgtgctctttcagtctttttgatgtaggggttttgggttatgctttccttttagcactgcttttgctgtatcccaaaggttttgataggttgtgtcattactgtcgttcagtttgaagaatttttaaatttccatcttgattttgtttctgacccaatgctcattcaggagctggttatttaatttccatgtatttgcatggttttgaaggttccttttggagttgatttccagttttattccactgtggtctgacagagtgcttgatataatttcgattttcttaaatttattaaggctcattttatggcctatcatatggtttaccttgaagaaagttccatgcactgttgaatagaatgtgtattctgcggttgtcggatgaacttttctgtatatatctgttaagtccatttattccaaggtatagtttaaatccattgtttctttgttgactttctgtcttgatgacctgcctagtgctgtcagtggagtattgaagtcccacactattattgtgttgttgtctatctcatttcttaggtctattagtcatagttttataaacttgggagctccagtgttaggtgcatgtatgtttaggattgtgatattttcctgttgaacaaggacttttaccattatataacatctctgtctcttttaactgttgttgctttaaagtttgttttgtcttatgtaagaattgctaccccagctcgtttttggtgtccatttgcatgaaatgcctttttccactcctttacttaagtttatgtgagtccttatgtgcgaggtgagtctcctgaaggcagcagatggttggtgagttcttatccattctgtggttctttcaagtggagcatttaggccatttatattcaatgttagtattgagatgtgaggtaccattgaattcatcatgctatctgttgcctgtgtactttgtttcgttttgtttttttgctttttaacttgtatttttgttttataggtcctgtgtgatttatgctttaaagaggtcctgttttgatgtgtttccagaatttgtttcaagatttagaggtccttttagcagttcctgtagtggtggtttggtaatggcaaattatttcagcatttgtttgtctgaaaaagactgtatctttccttcatatataatgcttagtttcactggatataaaattcttggctgataattgttttgtttgagaaggctgaagatagggtcccaatcccgtctagcttgtaaggtttctgctgagaaatctgctgttaatctgataggttttcctttataggttacctggtgctcctgtctcacagctcttaagattcgttccttcatcttaactttggataacctgatgacaatgtgcctagatgaatatctgtttgcaataaatttcctgggtgttctttgtgcttcttgtttttggatgtgtaggtctctagcaaggccagggaagtcttcttcaattattcccccgaatatgttttccaagatcttagaattctcttcttcctcaggaagaccaattattctcaggtttggtcatttaacataaccccagacttcttggatgctctgttcctattttcttattcttttttctttgtctttgttggattgggttaattcgaagaccctgtcttcgagctgtgagtttctttcttctacttgttcaattctattgctgagactttccagagcaaaaatgtgtccaaagcttcctgaatctttgattttgttttcctttaagctatctagttccttgaatattcctcccttcacttcttctatcatgttttggatttccttgcattgggcttcacctttctctggtccctccctaattagctttataactaacctcctgaattctttttcaggtaagtcagggatttctttttggtttggatccattgctggtgaactggtgtgatatttttggggggtgtcgaagagccttgttttgtcatattaccagggttgtttttctggttccttctcatttgggtaggctctgtcagagggaaggtctagggctgaaggccattgttcagattcttttgtctcatgtggtgttcccttgatgtagtactctcccccttttcctatggatgtggcttcctgtgagccaaactgcagtaactgttgtctgtcttctgagtctagccacccagcaagtctacctggctccaggctggtaatgggggttgtctgcacagagtcctgtgatgtgaaccatctatgggtctctcagctgggataccagtgcctgttctggtggaggtggcagggatggggatcagggatgcaatggactccatgagggtccttagctttggtggtttaatggtctatttttgtgctggttagcctcctgccaggaggtagcactttccagagagcgtcagctgtggtagtatgggaaggaatgggtggtggggtggggtcctagaattcctaagattatatgccctttatcttccgctactagggtgggtagggaaggaccattaggtcggggcagggctaggcatgtctgagctcagactttccttgggagggtcttgctgaggctactttcagggatgggggtgagactcccaggtcactggagttgtctacctagaaggattatggctgcctctgctgagtcattgcaggttgtcacggaagtggggaaagtcagtagtcacaggccttacccagctcccacacaaaccgaagggccagtctcactgccaccatgcccccctcaacagccccacgtctgtttccaggcagagagcaatacgagtctgaaaacctgccccaggatacctgcctccaactacgaaagaaaagggtttggttttttgcctgcctgtggagtctgcacaccggatttgcgccctcctttgaattctggccaggaggcttctcatcccgttcaaattgttacaaagttcagctagagatgtccttctccctgtgtggttttaccccctgctcctctcctgttggatccccatggtgccaggcaggaatggcctgctaggggacccagtgagttcccagggcccttctcactgtttcctctactcctgtattttgctcagctctccaaactgactcagctccaggtaaactcggaaacttcttccacgaacagaccttcagcttctccagtgggagtgtgtgttcgggagaggatggtctcactttcacggttggggcactcaacagttttgcggggtggtatcccgggtccacttccttcagagggtgtgtgggtcctcttgggatggctggtttgctcttgcggtcgatctggagctaaaattcacagtgtgagtccccgcacactgctctgtccagagatgcaatctagtcctgcctcccatctgccatgatgatcccgctcctccttttcattgttgaacactattctatgatatgtgtatatcataatttgtttaaccatttgcccattgaaagacatcagggttttttccaatttttgagtattgtaaataaagctgctatgaatatttgtgtacaaatttttgtgtaaatgtaagtattcatttctccaagataaatgcccaggaatgccattattggtctgtatgatagttgcgtgtttagttctttatgaaactgtcaaatcatttttcagggtggctgtaccattttacattcccaccagcaatgtagggatttagttcctctgcatcttgctagcatttgatgttgtcagtagtttttattttacttattctgattcatatatagtgatactcattgtgattttaacttgcattcttgtaatgactaatgatgttcagcatctcttaataggcttattggccatctctatatactcttcagtaaaatatttctttgtgtctttttcctattttttaactgaattgttttttactgttgacttttgagagttctttatatattctagggtactagtcctttctcagatatctgctttgcaaatattttctccgaatccatagcttatattttcatctactcaccaaggtcttttgcagagcaaaatttttaattttaatgaagtgaaatttttccttgctttgatatgaagtctaagaactttttctatttttagataccaaagattttttcgtatttttccaatagttttatagttttgtgattcacattaagtccataatccatttcgaatttttacataaggtgtgctactgagaatgaagttcatttttttgcccatggatatcaaattgctccagaaccatttatttaaagagcatcttgtctctagtgaattgaatttgcacctctgtcaaaaatcatgcaaatatgcacttctgttcatatttgtgtgggtctttacctgtgttctctattttcttacagtgatatatctctatccatcaccaaccacagtcttgattactgtatctacataatctcataaaattgcctagactaagtccttccactttttaaaaattgttcaaaatattccagttcctttgccaatccacaaaggacttagaataattttgttgacatcctcaaaaaatattcttgggattttgataggaattgctaccaatatctacatatcagcttggggagaagtgacatcttccactccataaacatggtatgtctctttgtttacttaaatcctttttatttctttcatcagtattgtatagtattcagcatgcatttcttatacatgttttgttatatttatgcctaagtaactctttttagagcaattgtaaatggtatcatatttttcaatttctgtgtcaatgtgttcattgccagtatatcaaaatacaactggcttttatatgttcagcttgtatcttgcaaccttgctgagctaactccaggatttttttatagattctttgatatattctatatacacaatcatgccatctgcagataaaaactttttttcttctttctcagtctattgctttttgctccttttcttgccttttggcactctgttgaataagagtagtgagattgaatatccttgccttgttctcaatcttgaagagaaagcattcagcctttcacctttaactaaaatgttatttctaggatttttgtttttgtagactgtcatatatcgagtttaagaaatcccactattccttctttttttccaagaattttcatcataaataagtgttgaatttaatcaaatgatttttctgcatcaatcgatatgatcacgtggcttctttcctctaacctgttaatgtggtggattgcatagattgattttcaaatattgaaccagcattgcatctacaaaataaataccactaggttatggtaaacaattcttttatatactgctgaattctatttgctaatatttgctaagtatttttacttctctatttatgattgatactggtagacagttttcttttttgtactgtttttgtctggttctagtatcaaggaaatactagcttaataaaataaattggaaagcgttgcttcctttcctattttctggaagagactctgtagaattagtattaattattcttcaaacatgtgatagaattctccagtaaaacaaatagggcctggatatttctttggggggagttttaaaattataaatcatatttccttagtaattacagtactattcaaattacaaacataatattgggtgagttgtggtagcctgtgtttttcaaggaattggcccatttcttctaagttgtcaaattcatgtcagtgaattgctcacagtattatcttaatttccttttgatgtctgcagggtcttcagtgacatatacaatatatttggtgatacagtaatttatgtatcctcccttttttgtcagtcttgctagaagctaattgatctttcaaataaagagcactttattccactgattttctctactatttttctgttttcaatttctttgacttctgctcttatctttatctccctttttctgcttcaagtttaacttgttttgttttagttttttggggtgataaattattaattcaagattatttcctcatttttaatgtatgaatttagtcctataaatttccctctcatcactgctttatctacctacaaattttatgttgtgtttccattttcatttagttcaatatatttttatgtccccgatactctgacccacgcattgactaaaagtatattatttagtttcaaagtgttggaaattgtcctcttatatttctgttatctctagcttgatttatttggatcagagaacatactctatacggtttcaatggccttatattaagggtttttaaaatcactcaagctattatcttttttgggatatagtccacaggcatttgaaaaaatatatatattctgctgttattgggtggactgttttataaatgtaaatttgatcctattagttgatggttttgtgagatattctatatccttactgattttctgtataactgtcctatcaacttttgagaaaggggtgttgaactctccacatataattgtagatttgcctgtttctcctttctattctatcagttttcacttcacgtattttgtagctgttgtctcgtgcattaacatttagaattgcaatatcttcctagtagattgacctttgcatcattatattatgtccagctctgtctctgacaattttctttgttctaaagtctactttatctgatattaacatagccactcttgaattccattgattaatgtttgtatatcttttctgcccttttattttcaatgtgcatatgtcattatatctgatgtttcttgtagatagcatacagttggttcatgtttttaatcaccctgacagcctccgtcttgatcgttttagactatctgcatttaatgcaattattgatatgttagggcttcagtctgttatcttttgtttttttgttctgcttttcatctctgttttttcttgtgttccaagtaagttaatcattttagaattccattttgattcacctatagtgttttaaatgtatttcttatattttaatggttgctctggttattacatatatatgtataattcagacagtctattagtatcattttatcagtttgagtgaactatagaaaccctatctactttgaagtctctttgccttcccccacttaaaatatagttgtcttaaatatttcctctgcatttatttacaacctacatcagacagggttataatttttacttcaactaccaaatatatttattaaattcaaaaggagaaggaaagcttaatgtttacccatgtttacacatgcttttgtttactgtgttctttcttcctttctaatttcccagagtcccttcttttattgtttcttttctatttagagaactttttcaaatcgcatttctagggcaggtttaaggtgactaaatcccttcgtcttccttatcctgagatggtctttatttctccttcattcctgaaggataattccactgggtttagaattatgagttgataatttttctttcagcacttgaaaaatattgtgccactttattctgggtttcattgtttctcaggagaaacacgctgtccttctaattgatttttcctgtgtcattttttttctcactttcaagaatttttcttgaatatagttttcagaagtttaattataatgcatcttagtgtaaacttttttgtgtttattctgtttggggtttcctcagcttcttgaatctgtaggtttatatcttttccaaatttgagaaattttcagccattatatcttcaggtacttttccagcactgctctctttctccttccttctgggacttcgatgccgtgaatgttagatgttttgttataatcccacaggtctgtgaggtgctgttcattatttgcttatcattattctctttactctcatcattgagattggaatttctattgttatgtcttccagttattgatgccttcctttctccccttcactatgctgttgagtctatctgctgagcatcttatttcagtttctgtattctcagttgtaaaatgttcatttagttcctcttcatatttccttggtgagactttctatttctttgctgagctttctatttttgcatttatttcaagtgtaattgctagtttaagcatttctaccatagctgctttcaaatccttttcagataattctgacagtcatcccaatgttggcagctattgactgtctcttttcatacaatttgaggtcctcctggttctttgtataaagagagattttcaattgaaagctgaacatttttatattatgctctgagaccttgaaccttatttaaaccttctgttttcactggcttttcctgaccttgctcccataggggaaggaagaatgccatctcatattgccaggtataaaggtccaggttccccacttggccttcgctgacacccaagtgggaatttattttaactgctggatatggttggggtttctagatctctctgtggcctcctcagacactgatgtgagggtagcaccatgaccactaggcaatggtaaaagtcccaagtctccattaggtctccaatatcacagccccagcaagaaggggcaggggtacataatttttgttaggtagaagtggaaatctaccatctgatactgcagcatgaatgaggagaggggacaagtcgttaccaaccagcagggatgaaagtcctcgctccctactttgtctctgatattaccccacaggagaatagttatagcctctggaaagtgaaagaaagtctagcttctgcactcaggcttccctggcacgggtaagagtggggccacaattatttctgttgtttggcaaagagattagtgtctaaaagtgttctgtcttgctgcaatgtccctttttctacatttctggctagagagagtaggcttcactgggggctttttgtctgtgcccattggtattcccagcttgctagcttcttcagtgtcaagtcttggatatgtaagataagaagacaacacagggaacttaccaccaggttattcctctgggtctcatgtccttaaccagtctacttcctcctctctgcctttcagaatcttgtgtttgttctatatggaatgtccaggagttttcattgtatttagtgggaggaataggaaaatcacatccactccaattactcgaaagtggaattctgtatttttaattcacatagctgttacctaattgccttccatacatgtatcaatttacatttacatttcagttgaaccaattacatttctgcagagttaacactggtttacaccactggttttcattccagaaattgctcttggccatctgtttttgccctcacatctgccattttagagtcaacttaagaactttttttatagaaaattcttcttacagggtagaaaagaagtaatggtattcaggagtgagcttctagtagatgccttcctttcacttgcctgcctcccacctagccctagttcatctaatttgaaggtgattagtggagcttttctaagcctcctccacttaacaaaagtgaacactacgcagagttctgagaagggaatttttattccagttcctggtgtcttctattttattctaaatcagattatattaaacaaaacttccctgaagtttgaggtattttattgggactattccctaatcccaccattctcaccatgtatgcttatttttgtatgttttagtcagtattttgggagaatgtggtggactgctatcattcaaataagcattaagtggacaccctttataggcagcttcttttcaggggcggaaataagccattgcatgtgtaagaactaaggttgagcaacagcaattttgccagatgagtatccactttcgctgtttagtccctcacacttgattacaccacatctttattttctgggcttgtttgtatggtagtccttaaaccctactttcaacactggtgtgaaaagagtattccaagaataagacagcagtaactaggaatccctatcatttaagatagaaatacaattaaaacactctcccctcaattaaagcttattgccattaatacacagtccccagaagggtttttgttggttttacttcaaaagctgaagctcctgccctttactacaaagaaacatatacacatgaagtaaaaggattaccttgtgagcctcaatgtagaatagagggtgtgtgtacagatatactgcaacttctcaaactaaaaaaaaaaaagatatgtaaatacttctgataaaatatttacttatactagaatatttcatacaaaaaatacataaaaatggaactccacataatactatctagctataaattactgtaaaatgttttttggaatattttattctagtctcttcctaggcatttatatatacatacaaccacacacacacatatatatatatatacacacacacacacatatatatacacatatatatacacgcatacatacgtgtgcgtatatgtgtgtgtgtgtttgtgtgtgtgtgtgtgtatgtaatacatataattagatgggctcataccgtaaataccactttgaactctgctttattcacttaacataatgtattttcccatttggttaagtggtctttaaaaacatgagtctttaatgactgcaataataatattctgccttctgaaggtgccataacttaaacattcttctatttgtgggtatttaagtttttacatttttgccacttttaataacactgcaatgcatgtccttttccataaatctttgagtttattttcctcagggtagactgctagaatttggattactgaattgcagctactagctgcactaggctccctcccacagcaggaaacctggttctgggttagggccaaattcactcttggcctcagcactgaaaagagattgcagattctgcacccctctggcaagacactgttgaggttctctttagaattcttatttcctgtcagtggtgcggccaggtaagcctggggctctttcagcttgcacaaagtgtatttgctgcttctgctccgagaagaactgctaggaatcgggaaactgagtcagatttgtatgtttcctctggtttgtactctgccagtttgagtcagtagaaaggtaagaaatttttttttgcaagaacccctgtctgctaattaattttagaacaaatataatagtttccataccacgaggaaacagtatctttaaaacaaaatcgggaacacaatatctacacgcaagtaggcttttattattttttcttttattcttttttctttggctaaaatttaggcactatattgttttaccacattatctgatcgtgatgcttcatctctgatcacatgttgctgtcattaaggcatttctgaggcttttctttcttaatctggaaagttattaaattgtaaaaacgtggcttgttgtatactaccttctaaaattattaaagaacacttttctttaaaacaagagtgttctccattgccgtcaagacaaacagcagtaactttacacaaaagaagcattcatctgtcaccctactttaaaacacccaatattcatcagctgtttgcccttcttggagcagcctgagcaggaaaggattaatgttttatccattcatgccctttgatcaattttctattgagatgttaggtttttttcttctgaatttgagaaagccctttaagtactgattatattaaccctatgtctatgtctgtcatatttgtttaaaataatttttcccacttttcattgccatctgatctcatagatggtgaatttttttttaccattcagaaatatttaaatttagtacattatataatgttgtctactttagcatttgttttaatttcaaaattaggacatcatctcaacctgaaaatcatatatattcatcaattatattttctttttttaatgtatttctttttctagtgtattatatatatagccttataagattataataatgtatttctattataatcttaattttttttttaaatggagttttgctcttgttgcccaggctggagtgcagtggtgtgatctcagctcactgcaacctctgccttccgtgttcaagcgattctcctgcctcagcctcccaattagctgggattacaggcgcctgccaccatgtccagctaattttttgtatttttagtagagatggagtttcaccatgttgggtaggttggtctcgaactcttgacctcaggtgatccacctgcctcggcttcccaaagtgctgggattacaggcgtgaaccacagtgcccggcctgatttttataattttaattgttttattataattttaaacagtaataaaataccatttttgagagatttgagttttcattggttttgattcaacttttatcatatactaaattatttcatacattaggtttttataccctgctagctgtaccactgtgatgtctgttgcttcttagactgttcactggaggtgtatcatatatttaatatcttgtaaaacaagtattttcttctgctatcatttactttttcttttcctcaaaattttaagtagctcaccctatttgttcttctaaatgactttcgatttgacaattcaagtttcaaaatttctaaatgaacttcagagtcaacaatttgagctagattccaatttcatgacaaatataatgtttatagcagtaaagatgtaaaaaggcattcaaactcactactaaccatggaattataaattatttgccatcaaataagtaaaacattttaaaggttgataatgttcaatgttgatataaatatgggtaaaataggcattttcatagaccattgatgagaaaataaattggtagagttattttagaggaaatttgccagtatctatcataatgcaaaatatgagtatcatttgatccaataattccccatctaggaatctgtctcatagatattcttacacatgtacacaaagatacaaggtagttcaccacagcactgtttgtaaaaatcccgcattgggatccacaaataagtccacgtgtaggggaatgataaaagtaaattattaagtatccataccaaggaatgttgtagagctattaaaaataatgaagtagatatatgtataataatatggggaaaatcttttaagatatattattatataaaaaaacaagtttcagagtaatgtgaccaacataatgctatttacattttaaaatgtgtgtatgtgtgtgtgtgtgtgtgtgtgtgtggataggtgggttgatagtgtatatatgtatacatatatttagaaggataagaacaaaaaggatagtagtatttacttttggggaggtgaggttagagagtaaaaagagcttataacttttaaatctaagtatttctatagtattgagtactatgtaggtatttctcttaaaagttttaatttcaaatatacaaattgcacataaatgtaatcttataatgagtaagtgaaaatttaaaatatatttgtatattttaaatttaaaaacttaaaagcaacacctacttactattaatatcacctttacctggatcaccactttgtgtgtctgtatgtttatttactgttgaactggcagaaagttattcatatttgaaccggccaacagataatatgtgtactctcctgctggcaaaaccccttgggtggtagcttctgaatctctttctgggttccatcctatagtgcaagttggtctgcacacttttaatgtttagcaagttttcatcctggactaacctaagcaactgggctgaggtgtattatttcctattgttgcatatttatttactccaaactcccatcaaagagtacaaggaaagccacaatacatgcacccagtgctagacaagctcttcctgcttccagttacatacttggatggtgtgttacagaggagagggagatttaccacctacgatggatttcattcttcttctccagcacgacctactaaacaaggatagtaaatttctgggagatgctgtctatgtagatattttaaaagggtgttgtagagaaggagctctgcaacaatatatggaacaggtcaaaaagcagtacccacaggagacggctgcccaggctttctaactgctacagaaatccagtgttggctaatgatagttattctcaattcagctccatccatcttgtaatcagcagaaattcctctagaaatcctgcaaaaggccatcagtcttattttctaccaatatgtttttatctttttatgtcatcatgggtatgtaagtggaaaggtgggagaggctgcctcagggtctatcagccaggtgatattataaacatgttcttttgtaattaaaagttcaaacataaaataacaatgttaatgggcaaaagaggtcataaacacagaagttgtaggtgggcacacaccactcttagaacatgtttctacatcatggtggctgtatctgctgcttactaatcaggcatggtggctctccagggtattaattcccccaaggaccaagaacccatttattgtgtatgtgtgcagggaacaggggaacgtttctatggcagctgcctggaagatcagaagcaaggggagagaaaggaatgaaggaaagcattaacgaacacagaaagcctgaaatctgggtagaaataaaggtagacagtaggggataaaaaggggattaatacctgtgaagtgataaaagagaacagactccaaaagggggtataagagaaaaactctgtaagtaatcagtgggaaatggaagctccactggaaaagtcattcagcttagttttattcagacttaaaaccgggatttggtgccaccagaagagagtaggtaagcatgaaagctgaagcaatttatcaaaattatcctttctactgatgagcatttctttcaacaaatgtccgttacaaaaagcaaagccacaattgtattaattactcagcacccggtgctgtttcctatgaagaaactaaggaaaaaaatataatataaaaagaataaatgtatgacttttttggtctttgacagagataaacgtgctagaaggaaatcttccactctatttgaaatgtaaaaatacatgttcagctcatatatttcctgtaatttccacatgtgagaagtgagaatgtctaaaattatccaatataaaatatgatgtatatcaggattttgttggatcttgtcagctactcataggcagataaggcaggaaaggaagggccacaacttgcattagacttgcagttaaagagacagagagataaaggagagggagagagagagagcgagcgagcacacacatgcactgaaatgggcaaaacataatgctcactctgacctcaatccaggggcaaaagaacagctagtttcaggaactagggcaagatgcagaaagggggccagcagttctcataagccctctcgcaccagtcagcacacaactatcaatcaatggggaagaagcagggccctatcatgggactgaccttctggggaaacgcagccccaacacagccagaattgctgtcagcacagctaggtagggcttcattcctagagtggggaccaaataactaagagagttctgtcctacaccacctcaggctgcctgaggttggagaactcgggcacagaagttttgctgtaactaagagacaacaagtgggcagagctgatgatgggtcaagagcactgggtcccatgctcatggtcacgcaaataatagtgacatacagcaaatactataaaagggcctcctgttattggtagtagcaggacatcacatccaatttcaaacgataacatcttcttgaaggtgaagtttttgcatttaaagtctggttaataactgtttcatggaaccatgggaagataactctggaagagccagcagattatctagtgtctgcccaggttccagtgtaacttgctgtttgtctttgagcattatcattaaaccttacagggtcttgattttctcatcccaatagtctccctggcctccctggaaaactctgtggcccacgaacttttgtcaggaagctcttcttacaaatattctcttagcaaaaattatcctatatttgacactttcaattattcaacaaatctagaggaaataatcacattacaaaatagatgtccagaacattccaccttgtttcacagaaatcctgtggaaagtagacatggcaacagcataaccaacggcacgggtggcagagatccaggaagacaagtcaggaaggaacagtgctaaggagaggaggaaatcagccactgaagaaattctgggacacagcaatcaatcactagcaaagaaggtgcagctttgagaatacactaaggaaaagggagggagggaagaagagacggtaggcaggcaagcgcatattctatgttccatagtgcactagggaaaacaggaccatgaatgaaaggtttggaacataagtcctgtcatagctcaccttgagatttcaatcaagttacaactctttgggctttgggttcttttctgtaaaatgagaaatcaggattggtgagatgacagttaaggataagtggacttcgtacacaatgagacaaatggagtagaaccacattctatgtggacctaattttatggagaaaactgtacctttcaaatggttctgactgggagtgctgctatgaaaagcccagcgtgttcagcccagagctccctactttttatggaattccaactctgacacaacactcatagcttagatttagtcagaatcaacttaccaagcctcaaaatgttccacagaagcttttgtttttattaatctattaagactttacaaagtttccttctctttggttagaaatgaaaaaagtgggttaatctcatgtcttgtttcaaccgggaagccatgacttaaggagagcagcctatctgccacagatgataccaaaaattaaggatactcaaaaacactggtcccaaatcaatggcatgtccacagcctttgttccctgaagatctgcagctcataaacatccaggggaggccaggtctcctctctgtccttcctagttgcagatactgatacagcagaaggcaaagttagaacatgtatggattagattgttctgatctcaggacaatctagttgccagaaagaattcaagacttaaagaatagcactctaacaaattctgattatctctgctttatccactgagattttcaaactaccttttcattgcccatgcctcccccactattaaaaacagctgtcccaaaattttacagtataagtctctaattgttccctaacaaataatttgaaaatgacagacacatttcaccttcaccctgccaggatttcacaaagttgagaatatgggtttaatttgaaatccatcattacaaaaccatcctcatccggcaataggaaagactcccattataattttctgctgggagtcattagaaaaagccaaagcaatagaagggaaaagggtccgagagcacctctaacttacaaaagtacaacccactttgttcaacaaataaaagcagagcctgctttgttcaactcgtcctctaagaggatatggactagaaaatctttattgctgcagcctcattctataaaataggactgtatttacccatctttctggatggccaagaaataatgatacatcttgtaaatataggttggttacttcaggaagggataggaattaatttcaaatctatcacatagtatcaagctatttcccatgagatttcataccaggccacagcactggaagccataatttccatatttattgaaaacagcatctcagccaaagtggtacattgtgtcctcatagtgaaacctcacccaaggaaatggaattaacttgcactatcatcataagtgtctagggtttttttttttccgaaaactgtaatatttgaccccctaattcagagaaagtttccttaactgcactgagctctagcaaagactgtaatttaagaaactgattcctaacctagtaaactttcttgccagcaaaccaaaaagtttaaatctgtgcagtgcatagtaaaaggtaacagaaccaaacagctggatttttaaaatatccatgtgtctcccagcagcattgcagggtcttcatttatttatggttacgtattttattctccaaggctgtttcacaatctgtttatataaattgtgtgtgttaatgcatgtgtttgagtggtggggggcagtgcacagattcatctaactttagactgtgatgaaataactgatgataaaggatgctatgcatgtgtaatatatctaaatattggattttaaaaccacttttgatggatggcattacatgattaatttttgagacttctggctcagattaaaacttcctacaaatctaaatattttgtttttgttttcctttcttctaggaatattaatacaattttgggaatgacagcacagaattggcatgaatattagtactttcaccacaaaacaaatgtgacatatacaggccgggcgtggtggctcacacctgtaatctcagcactttgggaagccaaggcgggcagatcacctgaggtcaggagttcgagaccagcctggccaacagggcaaaaccctgtctctactaaaaacacaaaaaattagctggccatggtgggcgcctgtaatcccagctactcaggaggctgaggcaggagaattgcttgaacccgggaggcggaggttgcagtgagctgagacggcgccactgcactccaacctgggcggcagagtgagaatccacctcaaaaataaaaaataaaaactgtgacatatacaaaccttttcactaagagaaaaaaattgggaaattaggcaaaattgattaatgagaacaaactgtttattgtacaaaactcttaagaacctagtattttcttaaaaagttttgccctgaagatacattgacggtctaagatcaccagtacctgattcaattcctatttatcaatagacctggattgaaataaaaggcactgatgcagatagcctcagttaggagcaggcacttaattattggagttgacaattatgccctcccataatgcatttttggtgtcactgaagagaccaccagcattcatgactctaagccaacatggtttttatgttttaaaaaacacatacttcacatgtatatgtgattcacttagaatttttttcaatgctattttaacaataaataaaaatcttggccgggcacagtggctcatgcctgtaatccagcagtttgggaggccgaggctggtggatcacttgaggccaggagttcgagattatcctggccaacatggcaaaacgctgtctctactaaaaatatgaacattagccaggcatggtggtgtgtgcctgtagtcccaactcctcagaaggctgaggcatgagaatcacttgaacccaggaggtagatgttgcaatgagctgagatcgcatcactgcactccagcctgggcaacagagcaagactctgtctcaaaactaaaaataaaaatatttacctattgttctcttgatattattatataagaaatacatattctggccaacttacaaaattagtcttacaatattttccctaaattattatggtaaaagtagattatatactccctaacaagggcatctgtttttaatctttgagtagttgaaaccatgtaataagtttatgcctattgaaaaatgtaatctttctaaggaaaaaattaaatttcagggtgttcattatcatctctaattccactgctcctcaattccaggatgcatgcttttttcacatttgaacatttttgaaaacaagatacatcttaaaatagtatctacattaaatgtggctctgttcttttttatcttctaaaatgctgttattgcatccagcaatccatggtgtatcagacatgagaaaatatgctattttctgcatgcctacaactcaccaggttcttctagatgctcggtacacagaaacctataaggagcaggctcacaacaataggccaatgtattttacagcactaaagtagttacttgagtaatatgcaccaatcaactcaaattttgttatataatcctttataactctcattctcaataggaaaagactgtgtcccctccacctccacccacctacacaaagagtacctacccagcatcacctgtctatctctgaataactcactaatactgtgtattaaaactgtaaaatcaaataagcatggctggtgctcactgactgaagaaagtgagatattttaattgttaagatttaaattatttaatatgcctcccaattacttgttttagaacacatacacacatgcacacacacacgcgcacacacacacgtacacacacacgcacgcacacatacacacacacacacacacgtaacctacagcaaaatcaaccttaagtaaaacatagaacaatctttcactatttttcctccagaacattgatcctgccttggaaagagaaagcaaatgatttagtgcatctattactatactacatttttattaactaaaaattgtttcccccacgcctccattaaataaatatacatcaaatatttaagtaatatagatttggaggggcatcaaggtatatctgatcaggaaaccccacataacttggaacagccctcagcaaagctggaacccaaacatcaggctttttggtttccaaacctggctttaggacctcaaaatcctgggttcagagaggtgacccaagaaagcccaaagcaggtaagaaacaagaaccaaatccaggcctctcaattccatgccccagagttttgtccacatttgttaagaacctaatctgaaacagtgctatccctatcttgagatacatacaagagtaaggtatgatcctgcccccaaggcccttgagtctctataaggaattgtgtgatttaaatcaatacaactgaaatcagagacacaaaagtaacagagtaacattaatttttaattttttttttttttttttttttttgagacagagtctcactctgtcgcccaggctggagtgcagtggcgccatcttggctaactgcaagctccgcctcccagtttgacaccattctccttcagcctcccgagtagctgggactacaggcacccgccaccatgtccggctaattttttgtgttttttagtagagatggggtttcaccgtgttagccaggatggtttgcatctcctgacctcgtgatccaactgcctcagcctcccaaagtgctgggattacaggcatgagccaccaagctgggccactttttaaatttttttaaaagaagtctcatgcgtctatcaagatatttcaaaacaaaaggaagttttcagtttgacaaagctataaaatacaaataatcaagatagaaacaacatgatgataatagtcatgttaacatttattgactacttactacgtaacactcactttgtaaggtgcttttcatcatttaatctacaacaagatcattagatattattatcatcctaattttacagaagagaaaacaaaaacactttgaaagttgcttaataacttacccaaatttacatatgctaataatcaattcagcctgcaatttcaaaggtcctgccaccatcctataagtagttctttaaaaagggataataaccctccaacacacaatcacacatacacatatgaacacccaggtccagttttatctgtctctctttatggtctgcttgctttgagtatctcaaaattcagccatatcaagaaagaaagctgggagctggaagctgagaaaaatactacccacactgagttggtcattggtaataaataaattaaccaataaggtgaagaataggaagagtttaaacaagaaagtttccaacatgttatgctttaactaactgtgagttgaagtaattattgggaaaaaaggacagtatttttagaaaagcaattaaatttagctgataggtgtcactgacactaaggtcatttcaacaaaaaggattttcaaagtaacagaagcagaacttagggcagaagcacccaagagatggcttcaacagaatcaaagaccaatttgccccaatgttcaaggagaggaaagtatagacttcatttccctcaagatcccactgggattggattcctttacttaattaactactcatccatgatactatctaaaaaatgctgatcctacagctttgtgtagacaacgtgctatagcctcaactactctatttaatggaatatcaattttcctgcctaatagagctcagaatttgaacttccttcacgtaagctgatattctctttcctcatttatactacagctatgtttgtactgaaaggcatgaaatattaatatttgtgtccatgatcatacagtccaatgtaaggaaaaatacaagtggaaaactaagaggaagaaacagtcatttcactgtctttcaaagtaaaacaattacaattatgtaggaaaaatattacttgtaaaaattaactcaaaacattttttatttataaagaaaaattgttattgatttacatgtttacaactgtcctgtcgcacaaatgtgcaagctcccctactgtatcataaggttcttgagggcaggggttagattcagaaacttcacctcttacattggatgccaaggaccgagggtaggtacatagtgtttgtgttcccccaccgtctacctcctggctgtgaatgaactaagaagacagactaatgatcgtgatcagtttagtcatgacagatccagcacagcaccctggccattcatgacagatgcctatttagtatgagctggacaacagggaagtaacatcagtgttatccagttatctctatgaaccaccaattgaaactagatttgatatatcttcccaattgtttagtttgatttcttcctttggaatagctactattttaaaagtttaggcatatggcaatacttagcaagaagtaaatatttaacccaatctccactaagtaaagcccttaacattttatatataatctgaagacatcctgtatgtatgtgcatgtatatgtatgtatgtgtgtgtgtatatatatatatatacacacacatatatatatacatgcacatacatataaatatccatatatacataaatatatatcaatataagctggcactgtgatatagtgctattttctacatagtagcagcaaatcaagattacataccaagagaaggcatttatcttccatcatgtgttaatgctgaaacacattaactttcctctcctcatctccctacctcttcagtcatgtctacctttacatgcaaaatacagtagctgcttattttaaggagtacataatttcactaaatattattctgctcattgtgctttctcattccattcctatcgcaaagcttttaagttgtttgtcaagtctaaaatctctcctacttttcactggagagattaatttggtaaaaatagaatcccaaactgccattgctcttttagtcatcttaattaattgtaattagttttaaaatattcagttcccgatttcccataaaactgagggcatcacacacacatgtgagttatcattatttcttagtaccagcacttgtgatagaaaggtaaccatccattctttcctgtggtctttcatactttcaaccctgattagtatgtgagtggctggtaaataattaattttatagtgagtgacatattttgaaatctgcaaagtattttattctgggaatttaaggcaacccttgcatttccctagatagctctgtgtacgcctacaattataagttgaagcagattcttgactttcccattagcatctaacaatttatgagcttttgatatccatgggatgatttttaaatgacgactttaattccccaatgcatctagataactagaaaaataatagacaataagtgaatgctttagcgaaggaatttaactaagaatttaaagcttcacccaagctgaaagtaatcaaataaactttataatggtcctgcactgacttcaatattctctttacatttttaaaggaaggtagcagcttcaaataacttatttcatgtggactgcataactatcctattatgtagtaatcattatatacaatttacagataagaaagctgaggctcatctattttagttaaattgcagaattaggaattggcagagttggagttcaatccagatccagctgcctttaaagccatattcacagtactacaccaacccaggcagaacatggatccttgctcttccaacatttacagtacctttcaggtcttataccaagtttaagcctaaaaaacatatctgggttttggttatctcatagattatacgagttacttgggttcaatttgtcactgaccacacactgggtaggcagtgataggtctgtaatattaaccataactaaagataacatattttggaaattaattaatttaaaaatcaaatataaagaaacatgtatcaaataatagttttcccattaagaatttggctaaaaaatcatgatggaaatcaaagaaaaatgtgtgtttttcttagccaaaatatttatttatttatatctttagagaagggtttcactctgtgcccaggctagactagcacggtggcataatcatcgctcatggcagtctctaatacctgaggctcaagtgatcctcccatctcaaactccttctgagtagctagaactacaggtgcatgccacgatgtccagttaattttttttttaagagaggtaagttctcactatattgcccagcacagcctagaattcttggcctcaactgatcctgccaccagagcctaccaaagtgctgggattacaggcatgagccactgtgctcggccacagaagtctttaataagattcaattggcatcatccattgtcaaagtacaaaatgtatactttcatttactactgtaactaaaggtgattaaagagacaaccaatcatatgccctttgcacattctatgtaaacaatctttcattacaatatcaattaatcaccaattcattggaagttctgaactccatggaaattgagtatttaagcaacaagtttggttgaatccctattccaaattatttagtagaactcagtaagtgaaaagaattagaaaatagttcttctcagaattcagattatataaattcacttgtaaaattttacatatttaaaaaacaccttttatggtcattattttagctaattatgcactagtttctattgggtgacaattctctaccctgtggtaccttttgtctcagactactattcaaggatgtctgtaaagcaaacagcctgggaggataaagattatgtcttcctcctccaggacagaggataattttgtttcctggcaagagtcaaagataatgccttcctccagggcaaaggctgggcaagtgtgccagaaacagtttataagactggttatttcctaaactctgtgttcctcagttgtgacacagatccaacaggtatgaagtaaccacctggccccctctgcattgccctcaagggaggttcccctcaagctctacaagatgagagcttgtagcccatgctgcctgctgtgcattgagcagtaacatcctttatgtctgatccaggagtttcgtgtcttctgcgagcatgtatgaatcaggcaggctaacttgttacttcacaggcaggttaaaatctcagactcctcactgctcttgacagctctatatgattgattaaataagtgtttgcagatgttggctaactccaaggtaaatttttactcctccctctaaagcccagaactcacagctgtcacttgtgctcacgcagttagggcaaaactaaggaataccatcttcatacatgaaattcttgggactgcctgacgactctgcagctactgaaatgaaggaagtgaagacaagcgcaggagtcttttccttctggtggccactgttgggttattagaatcgtcatctgtacaccaaagacaagctatccttctcatgcgctgattgattacatgctgtcacaggctaacctgtaaatccctgtcatcaatcaccctctctcacagaggatatgggaagatttcatgtctcaatcatgctctccagtttaccccagggtgacaaaagccagatagagtcttggggcactgaggtgatcatactcactttcccttctcgcctcatcatttagatggatacaacactagatagtaacgggcaacgtttacagagcacgtctcaataatcgttttatccttctcccacactagagatgcagacaagcaaaatttctattttctcttcacagaggctcaatgaattgaagtggcttgatccaggcccagatctggtaaccaaggaagcagaagcttcttaccattccatgttctctctacttcacaaaaccaaggaggccaatagatggtctcagcacccattctggccctctcagaggcgtctttggctactctctaatggaccttgtaaggggcagggaagtgcagtggttagggaacacagtcaagagctagattgcctgagattttaaatcctgtctcattcactcattagccagtcactcctggctcagtcacttaggcaatttatttaacctttgtgtgccttagtgtcatcatgtgtaaaatggggataataatagtgcttctattgtaggattattataaagattgaataaaataaataaactactgtatctgacaccaccattgctaccactacaactgctttgagtcccttttagacacactgatccctttctggttagaagcccaatttctgattgtcaggcttggttaggaattcaggtgaacttccccagggtctccatatccaaccctgcaaaacagcaatctaggctcactctgccatcaggaaccaaattatcaagaagaatgtgacaagttccacaaatatttcttgtggaatgaataaatgacttaggaagactctctgttctgcaatatacattctggaagagaaatgaggctttgggcttgactatccctataccccctttgtgaataaatccatgtgacaggcagaatgatgactaccaccaaacccccaaagatgtccagcgtctatttcctggaacccatgaatatgttaccttatatggcaaaatagattttgcagatgtgattatgattaatggcctggagatgggagattatcctgtattttccaagtaaactcaatctaatcacatcagtccttaaaaacgaagaacctttttcagctgtagagaaccagacagatggcagaatgagaaggtctcgacccaccattgctggctttgaagacagaaaggcatcacaaccaaggaatgtgtgtgacctgtagaaaatggaaaaggcaagagcatggatctcccccaaagtcttcagccatgctgacactttgatttgagcccagtgagaactgtgttggacttccgacctgcagaactgttaagactatacatctgtgttgttcaagccactgggtttgtggtaatttattagggcaacaatagaatctctggattcttccactagggaaagatcataacccagtactgggactattctgtagggttaagcaacaggaaagcatgtatttactcaccaattcattcattgattcatcttttttattcatattgagcacctaccacagcccagacactgttctttgggctacagaaaacaacagtgaaccagagagccatggtcagcttctgcaaccacgcagcttacaactcaaagctgacagatagagattaagcagccaattaataaattagataactgcaaacagtagaaagtgctgtgaagaaaataaaataagatgatgagatagagaacacagagggcagagctggggaaacagaaaccccagatttgggtggatggaaggctaagaaatgacatttgccagctaagcaaaggtccaagagagttcataagccactaactcgtggctgacctagccttcttatggatgctgtaagaggtgaaatacctgtttttgagaaattgatatgacttctcactccaaggaaaagtgtgctgtgtgaattgctactctaattttcctgtctccactcttcacaagcatgacttttaaggctttatttttaccatattttatgaacagtgtaaaggcagcattatcccagagtccctgcatatcattttcagtgagagtactcagcgttctccttatctgaatatggatgtggttagactccctgtgacggctacattgctgttactgtgatagatttccctgtgctggctgcaacctgtatcagcgacactggctctgaaaccaaatgcattgctcagggttagacccagacacagtgctagagcctacgcagaccacagctgtctctactgcacatttagttatgacaaaaatgtcaaagcgtgaaggtggcaaataaagtgtcatatcatgtaggaatgatggtctctgatatccaaatcatacacacacaaaacaggccactcaattcatttattgtaatgtcttgctctaatatctatgggaaaatagtacaaacaacttcaatttttattcaggttgtcatagtgtcaataattacatctcataattacccctttcataggttgtctataaaagtaaaactagaacatccaagtaatctgtctcaacccagagttcccagacacacgcaaacaatgcagggcaacgcaaattaccttcacaccctggttagtttgttctacagatgccttactgtgtgagaaggggctaagctgaggcataaaatgaatccaattctgaagctactctaaccatttctagtgttgtatatgttaatataatgaacttacaaataaacaatatctagtaagatggcttttgtgttgggggtgagaggtgcagagttcacactttgataattcactgattccaagaatggtgctcaggttttagagccagagtatctagatttgatttccaacttcatcatataataactctatgaccttgaagaagacatttccctgacatagcatcaatccattttttctctatgaattgaggtcaaaagtagcacacacactgcctggttcagagggttctcacaaaatgagaaagactttgtaaactatagaacacaagtgcaaaccaaaagtcccttggcctcctagcgctacagatatgttgtatttaaggcaacagcctaagtcccaatcctctgagctccaagcatggactaacaagtctgagcttttcctgggatcccctcctcagttactccctccaggattccctgacagtcagacttatggcctgctacctgacaaccctcctctcctactctcttgaacttttcctctgctccacatgccttcatcactctgccatccaccagtcaccatcaacacctctgacaacgttctcacggaagacaacttcttctacagcacaaagaatggggtgaagagggaagggaaggaacctcaaggcctcaccatcagggaagccatttccactcttgagccttgctttttcaaaacagggctgccaaagtaacaccgttaggtatcactgaccagttcttggcaggggctggcaaattttaccaataaagggccagatagtaaatattttagcttttgaagaccacatctgtctctgtagcatattcttctttgcttttttttctttttatgaccctttaaaaatgcataaacaatccagcaggccacaggctggattttcctcaagggccatagttcactgatccctgcgttatgacacagctatcgttcatgccatagtatacttgttttttgtgtgagcaggagtctgttgccagtagggggaattgaggggaggctcattaggtcaggggaggtacctagaaccactgcccctgggactttcaaacccaggagcttggccgcgcatggtggcctcactcctgtaatcccagcactttgggaggccaaggcgggtggatcatctgaggtcaggagttcgagaccatcctgggcaacatggtgaaacccgtctctactaaaaacacaaaaatcaaccaggcacggtggtgggcacctgtaattccagttaattgggaggctgaggcaggagaattgcttgaacgtgggaggcagaggttgcagtgagctgagatcacaccactgtactccagcctgggcgacaagcgcaagactccgtctcaaaagcaaaacaaaaccaaactcctataggtcggtctggtccacgttaacagacttcttcactcatggcttttgttcaggaacctcatcacgtccctcaatccaaccttttttggggaatcctaagctataagagagatcagtgcacgtctgaatgccaaaaatgagtcaagctccagttcttacactcagagcccctaagctctatgtaaatctagcatgtggcttccgtgtttctatgacagttagaaggctgctccacccacagcacatgggacctctgtggttagagtttccaatgatacaatcaagcctaggaaaaatgcatctcagccagtcagaatatgttatacatttattagctactatgattattatctaaaaaggaagaagaggaggaagaagaggaagaaaaaggaagagggggagggaaggaggagaagaggaacagggatgaagagggaagggaaggagaagaaactactgcagaaaattttgccaggatgcaataatggttacaaaattaaattatccttacctagtactttctccttgtgataaaagacttcactttgaggccgggcatgttggctcttgcctgtaatcccagcactttgggaggccaaggcaggcagatcacttgaggtcaggagttcaagatcagcctggccgacatggaaaaaccctgtctctactgaaaaatacaaaaattagctgagtgtggtggcaggaacctgtaatcccagctactcaggaggctatggcaggagaatcgcttggacccaggatgcggaggttgcagtgagctgagagcacaccacgacactccagcctgggcgacatagcgagactctgtctaaaaaaaaaaatcacacctataatcccagcactttgggaggccacggtgggcagatctcttgagaggtcaggagatcgagaccagcctgaccaacatagtaaaaccccatctctactaaaaatacaaaaattagccgggggtagtggcacatgcctgtaatcccagttacctgggaggctgaggcaggagaatcacttgaacccaggagtcggaggttgcggtgagatgagatcgtgccatcgcagcctgggcaacaagagtgaaacttcgtctcaaaaaaaaaaaaaaaaaaaaaaaacttcactttgaatctttttgattgttatatctattctgtaagtgaaggcctctataagcctataaagtacccagctgcaaattagtatataatgcctacttggcccaaaagtgaatcagaaaatgatgcctcttcaggtctataccttagcaccatttgactatctacaggtcacttttttggagggaacaggagtcaggggtggaggggtggaagtcaccggttaatcctggcagatccagccatctccaaggacataaatgaagagcagaaccaagatggattctcatccctacttgagcccttgaccaggcttcacaataacacagaggccctaacttaagttttgagtcaatgtccacaggcccattttctgtagctacttgtagtatgctaacatgctggcacagaagttagtgataatatttactgtcatggtggtggtgatggtgccaccaataaaacttgtcagctgagggcccttgctctggaccacttaaagagggctgatttttcacaagacgaaataacttagaaacatagaggataaagtggtccatagggttagtaaggtggaggagggtgactaagtcatgaaagatgtacagcacagacagaagagtttttaaaatgattccaaatagtgtgtgagagcagactactgaagttgaggatggatgtttgcaccctgcagagaatgctgcactctagagtttcacagtgcaagatgacctgactttcatagtgggcaggaaggtctgggaggccttgctttggactcaggaagaagtaagcaagctgagtagccggaatgccggtgatgagcattcattggtccaaaggagaaagacaaaaccaggaggtggcctggagatttccaagggagagaaaattcaaagctgcctgggagatgcatggcagaaccctaaacagattgtaaaggggaggagaaaaggtcatggcaaagtcaaggatgactggagctccctgcctggggaaaggatggatggctgtgttttagttgccaaggcaacaagcctcaatggcaggcagagaggctacagagtccctctctgggagtatcctgccctcagttgcgcagcacaggcaggtcttcttccacctggaagtacaatatgctgctctgctactggaggtgtgtttatcactgaaaagactcacccccaagtatactggactgcagtaggctgcaatcatgctacagaaacatgtatttctcagcattgttaatggaaacaaacatctgcaacacctaattgaaacccattcataggaaagatacataaaaacattctaacctttagcattatgcacaactttttaaatccagagaatgttacagcagagatctaccttcctggttgagagtgtactacatattttcctttggaaactaaagatactacaaacaaacttgaaaacatatatttcttcaaagtattaatttttaaagcggccaaaattgctaacaaccagggaaagtaccaatttataatttatgttcttggcacatagtatatattgtgaatttgcatgcatattacatgcaaataaccaaaagagcataacattaaggcttcaaatttgtatgtgcaaaagacagtaaattctaacattaaaattctttccagaaaatattaactccccatatcccctgtgactgtcacatagtcagctgagcaaactcactacagaacttgagtagtcaataaccttgttcaatgaaaatttgcatttcccatacctactcttcttagcaagcaaagaagacaagaccatttggcaccatgtgggacagggataaggtgctaacatggcccagcttttcaaacaaattatctaacaatttgacagaaaaaaaaagtgccagtaaaaatgccaccattgaaccactaacagaatctttactcccttataaagattacaacactggggaaatgaagcaaaatgcagctgactctgctctttccactatagtaaaaatatgagatttgtgatggcaaaatcatctgagtcaacctggctgggctagagtgctcagttcttaagtccaacactagtttagatgttactgtaaaagtatttgatagatgggattaacatctataatcagttgactttagctacaggaggttacccttgatcatgtggatgggcctcatctaatcaggtgaaggccttaagagcaaaaactgagtttccaagagaaggagctctccctcaagactgtaacatagacatcctgcctaagtttctagcctgctaacttgccctacgtatttcatactcaaggctataacatcaactcttgcctgagttttcagactgctgccctgccctgtgatttttggacttaccagcaccgcatttgcattagccaattccttaaaataaatctcttcataaatacatatttatgtatctaatgtatagatagacagattctgtctagtgaacactgatacaggattcaaagggattttcagtgtagaactaaaaaagtgctcagtattataatgcattctggtggatgggtaagtgctggttgatcttgattgcaatgtaaaaattaatgtattctttgtttaaataatgctactgctttgcagtgcagaatttactggaagatttccttcttgatatccatttaaagaatttccatagtcaaccctaagacaaataagggtgaattttatttgtaaaagaaaaggggctcatgataatctttctggtggctgagcccagaaggttttggggctcagcttgctgcatttatattctgaattctctgtggttcctaagtcttgagagatggaactatcccttcatttatgtatagtctgaaaacactaatcagactgtttaccccaatgaagcaagtatccacttaaatttagatcaaacaattccatgagtttaatgccactccaaccactctgtttctttttgttccttggccttttcatgaagtatctcacagtatttgctgccacacctctgctcctccctttcttcactctgtgacacagaatgctcatccatacactcagaccccactgctgtgttcactgatgatccccagacctatgcctccttccttgacctctaattcctaccgcgctccttatttattggtgtctggatgatcttctgggaatgggtggggcaaggactacagtcatagcacatccaaaagagaaatgattggtttagcaaagttctatgtttcgcaaactgttccatgtccaccattccatgatttttaagctgggaagagaaccgacctgttccacaaggcatttggacatttgctggataatcttctggtcactttgctttttgttttttttggactgttaaatatggaagttgttctccaaggcagcaatccagccttgacttacactgtctataacttacctttatcttctgtcttctctatcagtcctgtcatcaagtcaaattccttctccttctcactcttctgcagtcattcttagcatgcaccaactgtcttcctcctgtctgagctattttataacacagcaacaatcatctacccgaatgtcatgttgatcatgtcacttgttgccaaatgttccaaatgtttcttcttgaattaaatttcaaccccagttctacaagtccacagctgactcctttgattctcctcttcctggctgtggtctgcaacctgccccaccgctccccacactcccttgctctccaaggctcactgtaccctctctgttctccagatagcaggacaaactctttgctctcattacctctcctcttaatatgttcccgttctggaaaagttcaagagctggtgggtttccttgattccaccttccaaataactagttcaccatggttttccaccattcctgattcggggatcttaaggtttgggttcatatccagaatatcctggggcaaaacggtagtaacaatgtgagtaatcactgtcttgacctcatccaaaagacccctatttttgccttttctcataatgatgtctcaagtaagaaacctctcaaaaatttaaatttcttcttggcaaattagacatataaacttatccagcaagttttattatgcatgtgtatcagaatacatttcccattgtgatttatgcccatgttacatatagttatggatatatttttagaaaattgttttttaaatatttaatagccattaaaagggtaaaataattctctgctccttatggaacagttagatgccattctagtacttttgcaagtatttgcaattgtaatcagtaatgcaggcagaaagaatgccagtgtttttcaatcatcactggcaaaaatgtaaattttttaaaattaagactttaaagatcacctgcattaatcttctgctaatgcaagctgggactatttcctaggattctgagtggtttaacatcatcaagacatgtcacaggcttcatccaaattattcaattcctaccatacattacgctgagcctctcagaagatgaatcgggaagaggcaacctaagtgtttagagaacaaaagggaaaatgaagcacagagacctctggctaaaagtataaacctttgagagggttttaaggacatactataggactaaaaaatgagaacaaatcagcaggcccattagctgtgcagcaaattaaagcaccattgtttccagtttcagccttgaatctggagggcaccaaatagaccacgctgtcagtaccctctgtgaaagaagtgtgttctctgctatgtattctcaagcgcctttctattttttttcagctaatttatcagtttcccacctcttctcctaaatcattattataaacttccccaggaacatgttaaagggacaacaggaaaataatcaaagtttcaaaacacaatctatatttatcatgaatttcaacttatctttttccttgtattaaaaaatgaagcttgctatcttcagatttatattccttttatcttaatccttggggtaaaatatggcatgtggataatccacaaactaaatagcctctgcatttaagaagtagaccatagtccacagttgtatagtccacattttgtcatctcatctcataaaaacaaagttgaaagcggctctgtccaatcttttgagagggcaaaaggtctggaagatccaataagactacacaagagatttttaaacattagtatgtatttaaaccaatttattcataatatagtctcaactgttacataggactaggcccagagataactgctttcaattctttaagtaattattttagatttgtttccacatgtggaaatcagtaggtgttggctcactattgtgcaaagaattgattccaggtatgcaatgaggtatggatgtctctcagcctcagggaatcaggtggggttctgaggtagcaggtgcctctgggcagataacacctggccatcagcttcctcaaggtataaaggcatggtcctcatggctctgctgagaggcactagaaacatccatggacacccatgtcaacaggctgctgcagaaagcaccccttcactttgtgcagaagcagtccatgtagctgctggaggaggtttcattccaggtatagaaggcacagctggttgaaagtggagctctagaaaggtgtgggcagaagcgcctggtaggcaaagctacaagggacagccccaaaaattctgtctatacataccagacatttctttccagttgagtcaaatatcgtcttttactggcatccaggctacctatggagtgactgctctaacaataaacacacagtttataaattcgggcctcattattattttaattacttgataggaaaaaaattagttgaatttgaaatctgttggaattatcagaggattgcatttgtctagcaaagaaaaaagctaaaactattaatgtttttaaagataactttaacttttatagaatatgaaacggtggtgaaatggcttgtttttttaaaaatcactacttgtgtagtatctcactgacaatgactaaaaagaatttgaagagagaatcattaagatattgatcaagaattgtgttcagccatttcaggcatataagaaatataaaaagttatgtttatgaaagcaagctcaggtttttcattgaaaaaatctgaaaatatgttatttgaagttttatatctacttaatattctacaaatgaatgtctccagcttcctacattatttagtatcagtttctatgcttgtcatactaaagacaaaaatttatatgcactgatttaaataacatgtttctcttactacttcttagttttttgatttcaggtattattgattgacctcccaatgaggaagatgagggttaggttttttatcacacacacgcatgcctcatgttcccatcctctcagaataattctggttgtgttaaatatccatatttacatccttagaatcatgtagtgttctatgattatatctcattttctgcctttttgtcttccttggaattaatcattgttatatttaatttgcgttagtttcctatgtacttatcatgatgctatccccaaagcctccccaagatctgtaaatctcctctcagagcaaacacattaggtgtttaatcaattttaccatcttgaagaactctctcctgaatccctctacctactgcaatttagatcagttgatcactagtccagtgcacagctgttgagatctcttttaccatcacctgtgaattcttttcgcctcgctcttgtgttggtcctatctctgggataccaggtctttctttttattagtttaccatatcatttattggaccacattctagtgttgtaaagtttcatgatcatctgttgttattcccttttaatcaggaaacttctgtttttgagaaattttggtgaattattcctttgatggttttctgtcctccattttttatgttctctgaatctggtgtactatttttggatgtaagaaccaatcctctaagcttcttattttttctacgttattttctattctttctctttttactacactttcttgaaaatttccttaatttcacctcctaacccttataaattctgttgtgtttcatggttataatatcatgccttatctgtctggagatactgatgatttcttttttcagatttattcttctggccgggcactgtggctcacacctataatcccagcattttggggggcagaggcaggtggatcatttgaggcaaggagttcaagaccagcctggccaacatggtgaaaccccatctccactaaaaatataaaaattagccaggtggtagtggcacgcgcctgtaatcccagctactagggaggctgaggtgggagaatcgcttgagcctgggaggcagaggttgtggtgagccgagatcacgccactgtactccagcctggacgacagagtgaaaccctgtgtaaaaaaaaaaaaaattttcttcttcctattaaggttgtttcctccaagttgctttttttgtttgcatgctttagtttttttctctcatgatattagacatttccttaaatgtctcacgatccttggctgtctgagatatttaagggccgagcactagaaggtccacagaaaggttgggagtgtggttgttgatataggatttattttagaattgttctggctaggcccttccttgagggaatccctgatatcagtatccttgagttctatttttaggttagagtcccagggatgtttcctggagtttcctgcaggaaaggtatccttagctgcctgtaggctaaggagcagagaacagaaggtattgtcattcttgggatttggtaaatcagtgtaatccacaatctaccacatttcaggaccatattataccacttttaacctttcctgatacttctcaatccagaaaccttctgttttaccaactctatagaaaacataatcttcatccctctgttggagtggaggagcagtttccttcttgtataaagttaggaagcagatctgaactttcaaccaatacttctcaactgtatctccactctcccttccaggggttcttgttcctgagtttttgcagtgttcatcagtataatttggcttacctttttcctttctcctctgctagattaaaatttcactttctcaggtctgctaagtaagttagcagtcatccatctatatcccaaatcccaaagtgctgtaactgttgccctatttctttgctctcatcggtgtgtgccttttaaaataaaaatcccttaaacatcattttaatgaagtttcaagaagggtcaggaactaacacatgtatttatccttaatctgaaaatgatcagtcagtctttatccttttgcattgacattgaaatggggattactcttttttgttccctcaaaaacattaagccaaggcccaacattcaagaggaacaggaaatagagaaaatagcaatttttggatttagatgaaactaaatttaataatcgcatgctcttataaactagtatatcattgccctaacgatatattggacattgtgggaaataaaaatatgtctctatttcaaaacagtctctaaaacttctgaaaaagatgaacaattaaagaggtccttaaattgataattaacctaaaagagagtattcagagagaaaaatcaccaggcaaggaagaatggtaaaaggcaaactcactggagcaaaaaggaccttaaactccattttgaaaaataagtgttacagacatttcttctgcagagtttgcataatgtgtattaggtataaagtgatcaattgattggggaatacaatttattttatgcagactagggctcctggcataagggaaaaaaaagctcttctgcttacaacacagctgttttaaggtctttattctccatttctcacaatagtggatcattaagatgttgaaacaattttttaaaataccagcttagttcactaccatcttataaaaagagatacaataaaatgcattttttcgtgatgttcaggttttaaagttatacttttacagagatagaaaataccattattacttaaataacttcaggtaaaacaactttgtttattgtgcccctgcaactctcaagtctccaacactatttatgccactgaaataattgtctttatagcacaggttttgataatgtgcagttttaaggactatattgcctggagcagaactgactttaattggatggatatagatatgagaggatttgatgcagaatactgtgcgcgttgcaaaatgggatgacagaatgaagagacgaatctgtcttccccatagggtctgggtaggaggccggtggaagttaagtatagacgggtgtctggacaagtctgaacacagatgctttcaaacccaagtagtagggaatgaactctaaagtacaatgagcccacaattttgtagacaacaaagagacattgatgttttctgaataaagagtaatgttgttaaaatgatatttcaaaaaatgtaatctgccaatactgtatagggcaggaagtctggtcacagaaaacagttaagacactaaataatacagagatccaaagtcatgtgaagctggcctggattccttggcagtaaaaatgtgagagaactcacttcagagcaagaatcaataaaaatgagggatctacatttacagtactatagatacaggcagcccagtaaaagaaacgggactgaattaggactgataaaaggacttacagtgaagtagtttttaaactaaatctgtgatatcatttggttttcaattcaagaaacatttaccgagtatctactatatgcaaggcatgcagtcttttctcatcatttgtctcattatcttagaagccaaatgtaaaaaaatccagttaattaatttcacagactgattgatgttcttctgcaagaacaacagattgatttttttttatagacagcaatactaattcttccatcatgtccttctctttctgtgcacatagtcctatcgactttggggccaactcaatacaaaagcagaagaaaggcattaagagaacaaggtccattaggcccgatattgcctcaattactttaattccattattcctgttcatattacttctttaatcaataactcttttcagtttttcatgtttacccttttcaaaatcacaagtaataggattacggtcttttgagctcagtggcaacagagtttcataaatatatttctgaatttgtgattgtctccagatctgcaactgagaagtcttaaattgaatcaagttttccagaggccattttatttaataatgcagagcatctccatgcaatataggtgcttttccctgttattccatttgtcactcactgtcaaagacaatcacacatgctgaatggctttctaagtatcttcttcccatgtctaaacctttgggcagtttaactgattttcaaactgcatctcttttctgtacatatttctgacttttgtttaatgtaatccttctaccttcactgacaattattcttccctctaagagtttcatctggacattatgttaactactaccccttccagatgacaattaatcaatccctcagttctacctctgtagcagcctttcaaattaaaggaactctgttttcctctaccgttttaacaaacatccatgcaatgtctactattaataaatgcaagaagctgcacttccagcataaataggatacaagataggtatatggcccttcccttcaacatgtggatagtctaagaatgttataaaaataacttgtgatatatgagaagcatgcgaaaattgcaatatgcagcatctattcaaagttctggaattcacaagggataaaatcattcatgagtagagaaaagttttcataaaggatatgaatttcagtgaggtcttaaaggagggaaggattttgaaaatggaatctaagagagcaaagtaaccaattctgtgtgaaaagcaaagcaggcaaatctagtagagtaaatgattcaatggagtaaattaaagagagcttgacttccctttggaagcagtgagaccaggacaagggtgaagcagtgagaccaggacaaaggtcataaaggaagagtttggcaggatataagcactctttcacacagccattctccctgcaaggagcaggatgaactgaagacatacaaaagaagcttcaacaatgtgtcaaaggaccttcaagatttgatttctgccttcctatagagtctcatccagccctatatccctcttcacactttatgctccagcagtacctaaacagcatggaatacagaaacatgccctgccccctcataccactctgctaatctcccctctgtttcatttagaatgttctctctctaccactcatctcctaccaatttccattcaaatacaatcttctctataaagtatttcctaattgtcccaagccagtttagttgctctgtttcctatataaaaggtatacttagttttatagctccatcatagtcatgcaaaaatcattgctttctcccacataaattataatatacttgatactatgcccagaacaatttttggcacacgtccaaagggtactacatgaatgaatgaatgaacaaacgaatgaacaaacaaaacagagtggtcatatgaacaagcaagaaaaaggtaagaaatgcttggaaaggataatcgtagatttaaaaaaaggaaagtaaaaatatgaaagaattacagaaatttgacagagtttagtggtaactaaatgtagatgaaagagaattccaagcttctgagttccctgccaaaagccactgctcttcttcctcatttttatattaccagctcataagcacttaacataaactcatgatttaaatgaagcaaagatggacccatcagagggagaggcagaagatcctacagaaagcagacattaagattcctattttaactgatttgtgtacaaaaattttctgaaaaatgttgatagaattttgaagtataatttgtttaattaatatactttccataatataataattacattctaatgtcagagatctaagaaaaacttaccatgttaattattaactaaaaagacataagaatcatttttctcatttgcctttttttaaaatcagagtttaacaagttagcaaattattatcaagtccatgagaatcttatagctgagttttcagaaatgtgaaattagagaatgcaaaatggagtaaagacaaagcaacaacaataaaacttgttttccatgttcaaggcacctgaggttttatttctgggttattttctccttaataatagagaagtgttagatacacataagttaattattaaaataagacttattgggatgttataattgttgtagcacacactgtagagtacttcactggctattttgggacagctgaattactagaatataattgctcaccaggccctacctgcagccagcaagggctggcccaccatcactctgtttgatcactgtataaccaaaacaaattaactgtttcaattttaatgaaacctatagacatgcccacaagccacactaggagagttcatgtgaaaagttatgggagacctctaatcaagggtagtaagctcttgcataaaatggaaaagaaaagtaagcaatggagacacaggatgaagttatacatctatatttggtatttggtggaactctgcctgcatgcatcacacatgccataaatatttgctgtttgatttaccaattttcttaggactaatgtcagaaaaatgctaaaatgaatttctactttcattttcattttctactgcctgtcatcatcttataaatccactgctgtctaagccaatgctatcagttggccataggacagcctgcagccccacccccaggaacacaaaatctcctgcggggctggaaaagcttgtaagtaaatgattccaccttcctggaggcctgggcctgacccacacagtcaatctctagacactggtctgcctgcttacagcagctccacacagcactaatccaggggcttaagtgaatttgcagggctcctaaagatgcctacctcactcctaggaggagatctgaccctggactttcactcttctcagcaggaggctcccttttgctattaaaaaggtaatcctttcctggaagtaacagtagacatggctagaaagcactaccccaagaggaaataaagggtttcccaaataagcaactctaaagaacagatcatttaagtgctaccttgagaccagtatcctaataatttatcaacacccaaatctgaacactcaaaagataacttgtaataatgttgagttaaggatgcataaagaaggaagaagacgcgattagggcagatctatttcaggatagcatttagagattaaagccagagaagagaatgttaaatttaataagtgcaaagagatgcagctggaaagaaagaatagcctggctaagtatgatttaaacggtattgaattagctggaaagatatcttgatatactgatagaggcggcatgtaaattggcagttcaacctgcgatgccaacacagacagcagtaccggctcacacaaagggctatattttataaaaaccccatctgctactaattttaaaggaaaactcttatctcatttatgaggttgtttagcctggactaaactgaaggcaagagctccctgaggacaaatgccagcgtaatacctgcccacctctggtcactgcactttgctttgtcaaattaaatttggccatggcctttatagtccttgccattcgctaattcaacaaatattaagcagcaggcaccatactagatgctttagggttatctagaggaattcacttcaggcatgccttgaatatattacaggctcggttccacacaaactttttggtttgccagtgcgtataaagttatgtttacactatactatactctattaattgtgcaatagcattatatctaaaaatgaacacaccttaatttagaaatcctttattgctaaaacaatgttgatacaggaacacagtgtaagcatgtgctgttggaaaaatgatgctgatagacttgctggatgcagggttgccacaaaccttcaatttgtaaaaaaacatagtatctgcaaagctcaataaaaccaagtgaaataaattgaggtatgcctgtacccctatagtgctattggctgaattgtgtaccccaaaaagatgctgcaatccaaatctctcatacatatgaatgtgacatttttagaaatagagtccttgcagatgatcgagttaagataaggtcattagggtgaaccctaatccaatatgactggtgtccttacaaaaaggaaacctggacatagacacagacacacatgtagggaagacagtgtaaagacacagggagaatgccatctataagtcaaggaatgcctgaggctgccagaaggtagaagaaaggcctgcgacagattctccctcacggcctagaaggaagcaaccctgctgacacctggactttggacttctagaatccagaactgtgaaacaataaatttctattgtataaaccagccagtttgtggtgctttgttaaggcagtcagatgagactaatacagactgggtcacaaaataagcaagtccaataacaaaattaccatggtcatcagaactcctaatgtgggtctatctatggaagctttggctcagttaatgggtccaggtttggtcactggatgatatagatcactgtcatccacgtcagttctataaagggcatcaaagaaaaagatagctcatatcctaaggagagactaacccaatggggactgtttaatcctctaagaaggtgattagaaagaaacagaagcaataaaggttaatggaaaattaatctcaagtgacctgtttgggcaaatcaaagttgtgagacatgtacttatttctaaagaaaatgcaaaggaaatttagaaggataactttagataaggggacagagataagactttaattagaagtcttcaatattcatgtatttacataagtgttgaaaagataaaggcttcatgataaggtgataaagatgaacaatggtagtacctttatgaaaactctatagaagttggaaagagatttcaagtgaccagtcctatttccttgctggctgtttacagaggccctgtcacaggtactttgtaaatgctccccaaatgcatgttagttcagagatcttctgccacaggccctctgaaccccagatataactaagacacacattagagaatgatgccagaggtataattaaactacatcccttcccatatggtgacaaccaacctgcttgttatttgtggtgcacataccatccctttacctgagcatggtgagctctctctcctccacatattataaatacgacatcatgctggcagcaaaggacctgtaaaataaaggccatcttgttagaaaaaacttcaaacatcaatttcagagagctgactgaacatatatatgtaagcagatgcaaggtttcgcctgcaaagttcgagctgaacatagccctttccatttctggccactgcaattgaatgcccttggagaaggtctccgcatggtgctaacttggtaacaatcaataaatgtgaaggtctcatcataaacaaagcctccgaactgtcaatctttcaaagagtatttctgctttaaaagtagtctttgttgctaaagtagctacactaaagccagtgctagggccagggcctcccaaatctaagaaagcctaaataaataaagctgtgtgttaattaatggcagtacaatctaaaaatgtcattcagaagcagttttaggggttgactggtatcagacgtactgtttttaagtatgagaaattcttgcaagtttccaaattgaaataagagttacacacttataagctttctctcaggaaatttgttgttctgcaaactataaagtgcacctagatattttcataggataaatcccaactttattttctagaaagtattttaaagccttgttactcagagtgtggtccacaggcagcaaaatcagcctcaccagtgagcttgaagtgctgaatctgagaacccacctgagacctactgcaacagaatctgcattttaacaagatcctcagataatccctttgcacattaaagtctgagaagcatggttttaaagtgccttatacatcaggcctgtgagtgctagaatcataagaaataggttgccccgaacttcaagaccatcctctggtatctaaaacttaatggaatcacaattcctctattataattgcacgaatctggaaacaaatattctactaaactctccagaaacaccttacatctggctaaatctcttttctttccagaacatgtagactaattgtaaacagataactaaaagcatagccaaatttggaagtattttacactctaaagaccagcatctgtagacattgaagatagacattatttgttccataactaggtgctcagtaataactaatactgtgtaaagagccccaaagtggaaggataaaaattaccacatggcatgatagatctaatagggaaaggtcagcacaagaagccaggggcaggggaaggtactggtacacacttagaaagtacctgacccaggtgggaaacactgggaaggcttcctgagctgagtattgaaaaaggatgaggaaagatcttttaagaagcagtccgcctacaggtatagtgaatgagggcaggtcactagaccagcaaggagccaactaccttatttcaaaaaaatatccaaatgtgattttatcaagttttttcagcttctttaatatttgtatgcatgagctataaatgtgacagcccttaggaacacgtctcttccctttcaactatcctacaagacaaggaggaatggcaaacatcaaacacaagatgcactactcagaagtcggctgcaaactgcaagggggcaggaatagcagaactgtacctccacatttgctatttgatcacacagagtgtcaatgaaactgcaaccagcaatacggggaccataaagagaatcacattaaagttaatacaaaagtcaggaaaatgtcttcagcaagggacactggctatttggcagatgccctgctgggagtaattgaaggctctcagtgtgaccaaagtatgcactcccctctctgagcccttctcttcctcctgaatttaaacagttcttatcccatctccttccccctcacttattcttgtgatttctctgactcattttccttctccctcactacctccaagtgccctcctatctctaattcaactcccttcttttccctttcaatctgcccattttttcaccccttccttttgtgagaagaaggagctaaggcccttccttttgtgagaagaaggagctaagggagagaaggaaggacaaccaaacatctttttttcccttttttctttgctcctttcccttttcttcactaacgtccccacatttttatttccctcttctatcctctcttttctttcctggaatcaaatccctgttatcagtacataacctgtcttcccaagcatagagcttagaaatgataggaaaattgctcgactcctagactgttccgttgtaattcttgggagttctcggattctcctaacccactgccaggtcaatgattgagagaggaaagaaaaactttcaaaacctagcattttcttagcatttcctaaaatgtagaacaattctggagtacttggctgttgtactgaaaggggataaagatgtaaaacatactagaccaaaggtttcattctacccctggttctccctaagtgtatttcctccaacccaccatgaaaccaactcttctgttactcttattcctctttctgcatatcccccaaaccctcctggaatgactgaaacacgcttcattaccagtaagagccagataaatgacaaggcaggaattaacagagtgcttctttacaacgacacagagtagcacacaaagagcctcatttaatgccccattaggaagccttacaagttacagcttaataaatatatgaagattatcgtaatatagaaaacatctggtaccacttcccacatgaaatgcacttatggagaactctacagagtaggctgtgatatggcaatcttgcatatagtctttgaactgcagaaaagcaatttggcttcctttaggtatttcactctttattttcaacatatgaactatgaacgaaactttgtaggcaaatctgatttcccaatctttttattccagcccctagataccatatatgcccctgaaatagagtacatattcccaaaatatttgctgaatgaatgagttaactagtcaaacaatcactggccaatcaacataagccttaagacacaactgaattaagtatttgaaggaaaatagggctgggagcggtggctcatgcctgtaatcccagcactttgggaggctgaggcaggtggatcacttgaggtcaggagttcgagaccaacctagccaacatgatgaaaccccacttccactaaaaatacaaaaattagctggcatgcctgtaatcccagctactcaggaggctgaggcaggagaattgcttgagcccaggaagtggaggttgcagtgagccaagatcgcgacactgcactccagcctgggcaacagagtgagagtctatctcaaacaacaaaacaacaacaacaacaacaacaacaacaacaaaacaccagtatttgaaggaaaatatcacacaataatgcattttgaaaatttcccctagatttttggtattgacatctgatatgatctggctctgtgtccctacccaaatctcatctcaaattgtaatccccacatgttgagggagggaagtgactggattaagggggtggtttcccccatactcttctagtgatagtaagatctcatgagatctgatggttttataaggcagttttccctgctcttgcatgctctctctctcgcctgctgccatgtaagatatgtctgcttccccttccaccatgattctaagtttcctaaggcttccccagccatgcagaactgtcagtcaattaaacctcctttgtttataaattagccagtctcagttagtatctttatagcagtgtgagaacggactaacacatcatctaatcataaggtcaatatagggtgttggatgtaactcaactctcagaactagaatgaaaagaggtgctgctttgggcagagaccctgagcagtcagatgtgtcaacattctaacagcaaatgaataaatggaaaactctagaaagcaaacaaaagttctcaaaaactacagcagcctagaataaattagtcaatccctctatttgttcccatgatactctctacacataccccattattactgaaggtctcattacaccattacatttcttcaaaggtttctgactcaccctgggaagtgacgacctgatcacagcccactacgatttccgaggcaagccaaaaagaaacccctagaatagatctgctctacagatcaggaaagggactggaatcctattttgtggaaggggaagaggagacatgacaagttgagctgtgtctggatagagctcaaggatccctatctctctggattcacctctgaattcagggactaggctagcagttccccaagagcgagatagcaagtcactccatttcaatcaaccaagagtttagtggaaaagccagtagtggaaatttgttgtaacttgctctaaatgtcttaataatttaaaaaatatgttttattaaatatcatcaatagtgttccagatattggaatctactttgtattcaaaaactatgagaggtgctttttaccattcataccattgacatcattggactgagatcatcaccccttcagaaaagaactctttagaaacctacccaatctatcatagagagagcgagcttcctgttaaccttcaactccattgccccctcagacttgagccagttttaacaaacgccctgcacttacatctgaaaaggagttgaccctttgaaggaaaaaaatgtagacacttctaggatatatgtattttagtgtaactctaacccaaagtaaagtattttgtaaaaactttagttaagtacttactaaagtaaatttactaaagtaaagtaaagccttggtaaatctctcctactttattaccgttagataatattccctttaaccaatcctatttctccacaactatccactttttcatcacctagcataaaaataaacaagtttaaccatttcttcaggtctttatgtccatacgaaggcttctttgtcatgtacaatttatatgaaataaatttgtatgcttttctctttttaatgtcttctttaagaggggcatcagccacgaacttaggttgaatgaggaaaagatattttctccttctacaccattttaaagcaatccctagatactgctcatattatatctgcatatcgtgagacctagatttgttaccattcaacaaacaggggttctaataataaggaattagagaaaaggtaaaatgttctaaccttttcctcttaagtttcactttgagatctccaatataaatttcctaattatataaaaaccaccgctctatgatttcagtgctataagtctgatttcatccttatttccagaaagaaaaaaatagttgcatttgccatctgaattcactacctacagttctacagctatgtttttgtactggggcattgaaggacagcaaaaagtagggacaaaaaagtctcttacctcccaaagccatctgagtgccctctcaccctgcaaatcacatgccataccttttctagatcaattctttgtttagtttcaccagtacatcagcatcttcaatttcttctattcccatctcaataagcaatggcttacagaaaagataaacctatttttttaaaaaaagcaggtttttaaaaacctgcttccttccataaaatttgtttgcatgtgtgtatatatatatatatatacatgttcgattctcatatgatttccaaattagaactcaagttcaaatgatcaaatcatgcttacaaaacaagatctataaaattaaaacagattgatggaggaccccttaccaccacttctaccatatccctgacacatacgactcacccagaggatccacttttcagtccctaggtgcagccaagccctccactaaacaaagctcttcctgacagggactgggtgaatgcctctataagagatcaccacatattttcatagtttacaaggataaagcaattacagcttcagtcgttcatgaataaagcctctttaacattttaatgagaacattaactcagcttcacttggtttggcctctctagaaagtctgttagcctaagagaaagtttctttaaaacccagtaatgaaattgaggcctctctgtgccccacagggcataactgggctacaaacactggctggactatttctctcctgaagtagcctatattttttgataagactacagtttggtaaatgaaagaaggcatctgaagaaatacctttctctctgcagtatttgtgtgcttgtgtgtgctcactcattttatatctgacttgtctcctaatttgctttttatgttatacacagctttgagtacaatgtgtgactcaaaaaatgttaaatcatacttttctgcaattttcccttaatcattttctactgcctctgttctctcttgccgcgtgactgattcccaccaaggctaccaaactgccattcgcctggagacccattaaattcagcagaaaaccagcagagcttcagaagtcaaaggtgaacaagaaataattcccagactcagtgacttaacatgaatttctgcctcttctctggaccaaaccaggagcagagtgaatgaaagagtttgtcaccttaagagtaaagctaaaaagaacgaatgtccaagacacacatgcatttaactcttcaaacatctgctgagtatgtattatgcagcaggaattgttctaggtactgggagtacaagccaggaacaagacaagactctcactcccacagagctaaagttctaatgggaaagacaggtgataaaccaaaaagagaatgtcagagtgcaataggtgctatgaagaaaatgcaacagggtgatgagaggctagaaaaataaggtgaaaatttaaagccaaacagagcaaaaggctacagcaaaatcctcaaggtcataaaaagacatggaataaccttaaaagcacattgctaagtgaaagaagtcagtctgaaaaggccgcatactataccattccaactacatgacattgagggaaaactcaaactatggagacagtgaaaatatccatggctgccaggggttgtgggggagggaagggagggaggaataggcagagggcagaagattttaaggccagtgaaactattctgtatgatactacgagtggatacatgtcattatacgtttatccaaacccatagaatatacaacaccagaaacaaaccctaatgcaaatgatgaactttggatgacaatgatgtgtcatcacaggttcacggattataacaaatgtagcagtctgttgggggatgctgataatacagcaagctatgcatgtgggttgtggggagctatatgggaaatctctgtacattccactgaattttactgccaacctaaaactgcccctcaaaataaagtctttaaaatccttaaagtataaaagaatgtggtgagctgaagaaccgaaaggcccagcttggctaaagcacagtgaacaaggtaaccagcagagtggctagagtaagcctggcaggtcacgtttagaagcctgaatttcattctaaaagcaccaagaagccactgaatagtttcaagcagggcttgtcattatgtgttctacatttttgaaaggtcactctggctgctgtatggaaaatggatcacagagaggcaatcaacagaggctgatgatggtggtctagtctacagtagtagcaacagagcagcagaagtagatggatttaaagaggagctgacaggactggtgatggacagattggatgtaggggataaagaagaaagaggaatcaaagatgatttctgaatgagaggagagaccatgcactgagatggggaaaaccctagctacaaagaccacacaaagtgccatgtgccatggtacagatctctggaagcagtgggaatgttcagtcctccaagggaaatcaagttcagcttgcttgatctctgccttagcatgaatagcaaatgtgtgtgtgtacacatatacacacacatatatgcatatatacatggatatatgtaaacatatatgttttaatactgtttctgaaattcaaagcaagttttaaatcatgtcagcaatctttcgaagaacagagaggcagggttgttattgttgtcccaattaacatgcaaggaagctgatggcaaatgaggtgaaaggtcttttgaaggtcacacagcaagcagtcagcagcactgaaaggaggggcccggcttcctttcaggagtccctgccgtacatcacaccctctgcctatcatctggagcatgtggggcaccctgcaagcactgcgagagaacattctcggatgaggtaagggtggaggtgctgctccctcacccatgccattttctttttgctcatcccatcacaggtgctattttaataacccataaaatgtggctgataaaaccaaaagatcgttaacaccaaagcaaactttacagagagcaaatcaagtattaaggtatattgtggcatagatttttagacagacatttaaattatgaaccacaaggcatctactgcacaagctctccaaatccttctgagggctgcacaggtggagattcctcatgaatggaagaaacactcatgcccaggaatcacaggcctatcagtagcctcatctggaattcttcatccagtctttaggtttctcaaagaacatcaaaagcactgcacacattttaggaaaaaaagacaaaaacactagaaccaaagagttcacaggtctggtctttgtaacattatttaaaggaatacaatttatctagatgaaattaccactaaaataagtcagatcatatttaaagacacatgctaggggcaggactgggaagcctggacactttgtttagtctgtatactacctgtacaagttttaaaaatacactttcatttttcatctaccaggctctccctcagagctgtgaggactcccacctcaaatttagaagtctgaaagagaaacagtgaaggggtgtccgcctctatgtttgtccctgtgagtcatacattttctgttcctactaaatgtgggttggttgttttctagttgatttgcagacttcctctctgctgcttttctctaataatatttttccaaaggacccctaccttgcaagcacagtcccactaaggaacaacaggcaattatgcatgatcacagtgatcacagttactggggcctgaaataactggactgagaacacccacagaaaggggttcagggaaaagaagtttgagatagctggtccgttgcaccctgacctccagtctacagatttagaaaatcacttgtcagggctaaaatcatggtggtcatatgtgttgccttcttatgaagatggagtcatttccatttattactggttgtcttgccaatactttcacaaagatacacagtaatatgctctcagcacacacaaagtagagttgaaacttgccctgccattaaacactcaagtgggtcaccctctgaaactgcccaccgagtctcccaccaagacccttcaacaaggccttatctctctgtccaatctgccctacagaaccctttttacttctggacacatcactttcccattttctcatatcattaaaattttctttcctttctgggagtgtagtcaatgagattggcagagaatacaggaaaggcagatggcaagcatgaaggcaaactgggagtaatttggaggggcctgggttcagagagcctgctcccaggaaaagcccgagtcagtcagccatggagatggactgccaatgggaggcagggagagcaaagagcacatgagtgagagtggccaaaaggaagcaatgggtcaggaacaagcaaagattcaagatgagggcttttggtgccactatgagacatcgtacaggtggctctgaggctggaagcaggaggctgtagagtgccaatgccacctaaactggaaagggcaagaaactgagccctcaaaaataggacaaatactgacaattttctcccttcatactcaaaacaacctctctctagagcgctctttctcttctttccttcaaatcttgagcccaatgtttgacacttgataccttgaggtgccaattatcatagtgatgattctataaagtacacaatttcacactataactttctttgcaaagcatttttttacatgtatggtatcttttagttctcacaatgttgtgacataagcattattaaatgcacacatcctgactcaaagagatttagaatcatgcacaatgctacacaagtgaaagaatctgtatccaaatccaggtcttctgacttgcgatcctgtggtttctagaatatactattagtctatttcttgttatttttatttatttttaggtttcattttattttaaattgacaaacaataattacatatttatgttagtctgtcttgtcctctaattctctattctctacatttcactaatttagacttcactaattcggaattggtgaggcaataaaacatcatttgataccctatttacttggaaatctgggaggtgctatacaaatgtgcatacaatatatccaggaggctgaatggggaagctaccatcctgaaagtggagaaaaaaagaaagcttgccttcttttagtcaccagggccaacatcagcaatttaacatcaatatgaaatttttaaaatggatttgctaactataaatgacttaattttgaattcatgtctagttaatattctataaaactcaaaaaaattcctcaaatataaaaaatatgatcttaaactaatggtacttagtctacaggctaatttttaaaaactatcacatccttatgatttttgtcacgtctttattatgtaacatagtatcctgtagttcaatttttctgtgaattcagatctgcctgtccttgtagagtctggcataaagttggttttcaaatatttgttgactagatgatggatacatacatgaatgaatgcatgtgtctgtcaagttacactccatgtcagctggagagttaaatgccacttccatcaggcacaatggaccagtcctggactttagaattccacagatacagattccaatctagctgtttgtcagctacatcatcttaagcaagttatctcacctctggactccaagtttcctcatcagcaaaatggtaacaacactgagtagcactcagaactgctgtgaggctaaagtgaagtcacacactcgatacactgcctaggttgccgccattaatatagcttatttatcctctctcctctctctgtctcacatttagcatgacccctttcataagaccaaccttgataatggtgtttcagtatataaaaccctgttgtaaagttaatggccaaacatcaactttatttacaatgactcaatttcccctctactaacattaaacttatttattcatggtctagagataggttgttatgcatagcaggtgttcaataaattttgataattttagaaaaaaaatttccagggaattgaagctcactcttttaggcactaatactctcttcatttgaaagctttcaaaaatatactataccctcaaccactatgctgagcagcaggttgaaagaactctaacctcttcttgactcagttatcaacatgaacttagacttaacaccgtaatgaaaaataataattccttgagggttttttaagtcagtagatctgctcgtaccaaatgttcccagatttctatgccatgatcatttcttccatttcttcctgtggtcagcagcatgagacactggggaatgaacaagatcaagtccctgtcatctttgagggtttaccaggaacaattcccagctatttcttatctgtggcctcatgacacacacacacgttttggtaaaagcttcaaggagggaccctagtcaaaggaggactgctccatccctcatgttttacacataatacctactcaacaatatttaggaagtgaactgagtaaacagtatgtaacttttgtaattagtatttggagataaaaactatttgtagtttctatttggagatgtttttctaacccatggctaggccctttactcatttgtggctacatttcttcatctttaagataagacaattgggttaaattatccctaagatccttttcaacacttatattctatgatctaatactccaaagctccagatgatagaactgctggaaatatgaccactggataagtgaggtattagaggacataatgaataaacaatgcatcctttgccttcaaatgcaaaatcctatcaaaaagatattatctgcatatcatggaaacaaatgcccaaaagattagctttcttacttctttctctcacctgaataccatatacaagagtagacatattgaccttggagtgtaaacatactgacctttttattttccttgtgtcaaatgttcataataaatgaaaaacctaacatatctcaaaagaagtcaactgcattcaggcaaatacaaccctaaaggggtttttctcataactaaatgcagtaatgcaatgcttcactaccttttgttcatagttatttcctcaaacaccacttggttcatatactaatttattcacatatttgtttagtgttccagttttactctttatacagaaatgaaatccaactttcttaaagtatggtttaactgtattaaaactaaaacttctaaattaaaagaagtttcataagtgtacacagaaaagaagtagatgctttcaaataacaagtcaaatatttttcaacaagtaccttgggaaggcattctgagaacagctttgcccctagaggcccagggcaagagaagtcatggacaactctctattccagataggatggtgttccttcagttcaattcaaagtataccttcctcaagcactataccaattctaaaggggataaaaaatgaaaaaatacatcatctctgccttggagaagatgcagcaagactgagtgcatagggtaatgacattggaaaatgatgtcccaggatcagatcccaacttcaccataattaactgtaaaacttcggcaagttatttaacctctctgattcagtgtccttatctgcataatggtgatgataacagtacccacctcattgagttgttatgaggattaaacggagaattactcctaaagcattaagaatgattcccagcacacagcaagtactcaaggttagtatcatccctgtgaacatacaacccatgaactatttttttataagtaaaactgaagctataacagatgtcaggaaatgaaaagacaaaaacaatctggaaaattatttttccaaccttcatcattattcttgtgtcttcctgatgaatcctaactacaactattcctcagagagatatagagatagcagagaatggaggtgtgaagaaagaaaaaacagagaaacatgaaaggagagaaagagagagcaaacaggaggtgcatttctgtattatccaaagccattagaaaggcagacactgaactaaagttggagagaaggccacacttgctgcagccctgccctgcccctttcccttctcctctcagaaactccttcctcaagcattgagctaccacacttttgtcctaaccatttctttgcttttctttcccatttatacttttgttttatagaatatgaggagagactttatatgttttatagaatggaaaaggctttagaagtcaccacctaacacaatcctctcaatttatacatgagaaaaactaagggcctgtaagacaaagacatttgtcctgggttgtatagctctataatggcacaaacaaaatcaaaactggactccctaagtccacaccatttcccttaggacaacaaaatgtatacatttacccaaaagcaatatggctagcctttatcccatatggcagatatttaaatttttctcttgggaagaaaatcttgagaattttttttaaatgagttaacaagaatcttactgtttttaatttaataaatgtgttttattattgactttattgcttgctaagcctgaaattagatttctctatgtttgggtatgtcttgtctaaccaataacaggacaaccagactgcaattaaacagatattcccacttgggccataatgcataaacacacacacacacacacacacacacacacacacacacacacacactatcaggaggcacttaaagtttcagcacattctcgttgtcacttttctggcctgtttaggagaaggagatattaaatattaaaaggctcttctaatatacagacttcaaatcatttatcttccaaaggaggaacaagtttcttgtcatttcctcatatgctatttctaaccccactgcctgcccattgtactccataagttttcatatctgtgctcagaatgtccttactatgctttgcccagatcaggtatacggcctcctaaacgttcactgctccttactcccagccttcaactccataatgaacgactgaggctctgaaatcagagccttataataatatattttttaaatggagccaataactatacttttctgttgttgttatatgtcagatctttaagtataaggatctggataaagcaaacattttaaaacaaacaaagcctcctggtttgcttatactctccccatttctctagtattcaaggtagctatcttctcttccattcactatgtggggcttcataaaaggtatgaactcactgtgactaaaggaaaggttttggcagtcttctcacacttgtttagataataggaacatctgaatctgggccactaaaaccaactcagttccacggtctaaataggtgtttacttttagtaggctagacctgcagaaggccactttactagaaccatgcttggtaagtattatttacatggatctatactactactactatgtgttttgttttcctttttctgttaatttttctttcacagcaaatgcaggctggccaccatgggtggtggcagttgtagttaccattctcattcataagaaattcaataatagaaaaagtagaattcaacattacaaaaaaaattgcaaaaattaaacactcaaagctcagaaagagttgagccaagatttgaaagtttctaaggaaggggaaaaaaaaccacattgctgcatcctcctaccctgcatgccagctagcagtggcagttcagtctctccagatgcctctcagaaaaagaaatgccacaaatataacaggagttgagatcctgggggagccaattagatttaaggtgctttcaaaattctgtaaaagaaaaaaaggcattagaaaaaacctggcacttgaaatgacattttatgtgttccgcttagggcctttggaatactactcatataagggctggttgccatgcttataaaataaactttgggtttttaatataacagaacaaaatcattagctagtaaaacaaacttagcttcagagggagaatgtggcacgtcaaatctaaggtatctcatcctttatctttggaattgtcagccaaaataagacaaatcaggccaaggtcaatggcagacactctactgagaaactctcctcctaagactgactgttgtgtagtactttgaggttctggcacttgtcaagcaattatttgggggtgagctgcaaggcaacagaaattttcaggccccccacccaacaccataccagttcctcaattgcctttcgatatcccatgacaagagaggtaggggttgggaaggaaatggggagctcagaagggactgcagtgtctccacagttacagaagcaggtctggggtccagctggtgatggggagagatgcactacactaatgtaatggctatttgtcagtccattatcatctttcccaatgagatgcagggcagatgcatcaaagacaagagaatcagacaaaagacagtgagatttaaaaatacaccaacttcagttgggtttttgggatgatttcttttcatcccaagatgaaacagccacagatccacctccaaactggaggctcaaccaggctgtctcctcagagccccactcactcattcaccttctctttaatatggtatgaaagcagtcaggtccaagaagccagcacaggggtatgtgccctcctgaaaaacattccagggctacaggacaaagacaactttttgttctaccgtgtagttgaatgtcttggcgacaccaccttgacctcctcctcctggtagaggggtggttatttcactgcctctggccagaattcaagtctataaatatgtatttagacatggttctgtgtcagccactgaaccatgtgtcgcaaaggacactatgggaagagaactcatattctgcctccatagattaccctctaagctaatgaagatgtacatgtctgtaaaggaagcaactttacttgctgaaaccctgttatttccaaggcctaccttaaaatgtaacctactctgcagtgagcagagatcgcgccactgtactccagcctgggcgaaagagcgagactctgtctcaaaaaaaaaaaaaaaaaatgtaacctactccataaggttgtcctaaccagaaacaacatctccctcacttgagctcctatgtccttgtctatcttctattttagccgtttatgaaattgtcttattgcccctttaaattctttaagcagtgatattttaataactggtaagagcaatatgtcagaagatgtcaagttcttgactgtgtggtagacataggtatctcaattattgaggaaacaaagtggtcagaaaggatttcactcagctatatttgatgggacactaaaattgaattgtctagaggaaggttttaaattaagtaagaagatgagcaaaagtcagatgtcccaggatgtctcctagcacagatatttaaaatgtaggaagttctgacaaccttctgagtggccatgaagggtgatccaaagtccttttatagcagattcatcagtcccatgatagcacctctaatccacactagtgacagtaacaactggagaataataatatatttgtttttgaggccctggaacatctctgaggactatcgccctacagagaacaggtaatcttcagaagcacttgaattcccatgtttacatttaccacagagactgatatgacctctttggagggaaggaacaagtaagagctaaactaagccaatgcttctttctgcatagtagccatagtcaaccatagacagcgaaagttgtgtctctttacagattttttggagcaatattttccctaattacaaaataggaatgcatatgttatactcagtcaaatcaaaaaaaataatgatcatagctaaataataccactataaatatttgaactttgtaatggttttcaaagaagtagtatttagaatgtctctttagaactgctagtttttagaaattactgtcccttaagcatttactttctttttggccttactgtgtaaatcatgctgctcttcctcgatttcccaggatccccaaggctgtgctctacaatgcttgctttaaataaaacttggtgccaaagagtctgccgcagctttcaagttcacccggacgacactttcctacaatgggtctcttcatacttcactatatccggatctagttgatccgcattttctgcacaaagtctcacttcccagcaattgcaatctgcatcttgcatagtttccttctattcccctgggtagcttgctgccaggaaggcagaggagaagaggagctttttgatgctaacaaggcctctgtgtaggactcatagctaatggtaaggagttgagtatggcatttctcaggggagcccaggtgagtgaaagtgtaagggcacagctgacagccatgtgcgtacctcgctgctggcctaaagtaggtcctccagcctctgagcagtaacctgttcatggcttacatcatgaaaaaatgagtcagtgcacttggcaactcatgccctaaaataggtaaggcctgaactcaaaaggaaattctgaaagaaaggcattatatggtgacaggtttttttttaagttgccggtggtaggataaaagctaatgaattatgaacatctgtattattctgctgtcttcctccttctggacttttagatgactgtaagctcaactttgagctcagctagtattttctcctgggcattctgagaaatgagaacacatttgcctgctgggaggcatacccattacttatcaaattagccctcctcaagaatctaacagacttgtcactgcctttagaaatcccagaaggaaacacacacacacacacacacacacacacacacacacacactacatggttgaaacactcagaaatctcttaatatatgtgaagtcttggccaacatacagcaaccaaggagtcaaaagtcatgtatgagtccttagggataatctttaagcaggctcttgccactgtcatgattggaatagcaaaggaaaagcacctgaccttctaaacaaagaagaaacaaatcagtaaagcttagatattgggacttaataacaaaagataaccttaagtagctctcgggatataccaggactttatttgtgttatctcatttaatcctcatgataatatcttgaggtagactggtagtattaatattctcattttttaagatgagaaaatcaaagtgtaggaagctttagtaactcattcaagtctcccctgttaatcagagatgggatgtgaatgcatgctatcaattacttctgcttatcagtggtcaatgatattttctatcaggattagcctacatccaataaattttgaaagatgaaggaaaagatgagcagaaaaaaaatgcaggagttccttattttttaacaaagtgaagataatacagggaaagaacacaatgtcagtccatttctgtgttatctggcttactgaggcaaaaggaggttctgaactcgaaccatatgaatgttgacccacaaagaccagggtttgttcttagctaagtgagtctttggttaaagattctcacatagactctgagaccttacacacatggtatcacactcattcaaatgcaattttccccatttggctatttcaagtagtcaacacacagaaactgcgttttcctcctgtgtctccttggggaggtcagggaggggtggtgacatcatgggaacagtgtctgtcttctctcctatgactcatccgagtatgtcaaagaaatgctgctaatgctagtcctgcagcatgaattatcctatctgccaagcaaactcgtggaaaacagcatactctctccatcacagccccaaagaaaggtagaaaaggcagcaatgaaaaactactcatgcaaaaccaaagcacaagagaagtgaactttactcacttcctccgctcctcacaaaaaagtatatatacatttccattttcatgttgccagaaataggtaacgacggaatttgattcctcctctgtgctctcacaccactttgtacaaattgctaaattacaatgcttaccatattgtcctataattagattttaggtgtctgccttctcactagtgtaataactccttttttcccttaccatttgtattccaagcatctggtatcacatttaacaaatatttgctaaacaaacaaatgaaaggttgaataaatggcatttgctcaagggctctctctaactaggacaaaagtaatgttctttttcctctattctttgtgactgaaaatggctgacacagtcatattggacgggggaatggatcatgtcaatctggagtattgggtgtctcagatgttctggcagttactgaatgagtgtcgtatgtgtggttacacatgtatctcatagtttcctctgcttttgtattctacagagtttgtctcttccccacttgtacccaccaagccagcctatttcatgattggctcccttaatcacttattttctttgaacttaattaggtcaattaaaatccttactctaagaaggcactcttcttattttaagttgcaggagagagaggagggcgggaaacatcacttgatattaccctacagtgcatgctatgttccaagcatgatggaggctggatattcagcaagactcagtacatccgtggcccttcctcttgcagaatttacagtcagtgggagaaagagagataaatcataaggccaatcaaatgtagtaactataatgacagatgaagcacagggtgctatgggccacacaggaaggaaaccaaagccaatctggagatcaggaagagcctctagacaacataccttttacattttgacctgagagataagtgagacttatccaggtgaaaggagaatgtaggaagggggaggaggagacccagaaactagagagaacacaatataaacaaaatactcaaagctactgaggagggctagtgtttaagtgagaaggcaaactcaggctccagctattttcccattgcccttatcctaagggcaatgggaagcctttggaggattttaaccaaggtagtgacatttggatccgagttttgggagagagacctgggttgtaggtaaagtcacatagatttgggagtggtatcattaacgggaggttaactgcaacaagtagaccttcaacatttccttttagcaagattactgtggtgccatatggagaatggattataaaactgtgagactagatgtgtagaaaccacttaggatgctatttcagtagtccagatgaagatggtaatggtgacatttgaaatggaaagaagtggatgggttcaaaagaatactagacagaattagcaggccttggcaattgaccagatgagaggttggcaaaatttatctgcaaaggactagataagaaatgcttagcctttgccagccatatggttcctgtcaccactactcaactctgctgtttagtgagaaagtggacatagacaatatataaatgaatgagcatgcctgtgtccccataaaaacctatttacaaaaaaacaggccataggccaaattcgacccaaggctagggcatgccaactcctggattaaatgaggagtgtggcaatcagaatagtaaaaatggctcccaagtatgtgaactcagcgtctggttgtccggggctactatttgcagagaaaggggcacaggagaaggagcagggtcagagggaaggaggcagtgaccagttttagacaagctgagttcaatatacctgaaatatatcacccaagatgtgtctaataagcagttagacagttggatctcagtttcaggaaaaaagatctgggctctaggtaagttgttttagttagggtcatctaaaatatactaacaggccacaaaaatcagtggcttcagtaataagtatttctttctcatatgatgacagaactcaggccagggctgggggaggacagttgttccaggagcccatctgatggcagcatccatcctactcagccaaaaggaggaaagttcagagacaagcatttgtaggaggtttctatggagggatccgaacttccagagaggtgacaaatgcagtctagctgtgtttgtttctaggatcaggagtagactgaattttggtgaacagctaccaggatctaccaccagagtcaaaaatacatagagaggtcaagaaggcatgaaaatgaataaaagtgattcaggcaactataaagcatgagaccaaggtcagagctccaaagaacaccaatgttagaagatacactgaagaggtaaaaggaagatccagcaaagtagaagaatgacaaaacaaaaataaaacgagactgtgttagatacttaatcaatgtatgtagaaatgtgagtacaaatttcatcattaagcactgagcacatctctgacaagctgacattatttggtgcctctgatatttagatgaaaaataagccaaattggatttaagagaaaatggcaaaatcagcttctcgaaaaagccagattttcattaccatgcagatggactgctttagggctatgtgtcataatattcattttttccatttacttttgtgtccataaatcaagctctctctataggagaaatgtatattctgcatcaaacattttatgtgatcttatacacatatgaacttaatataaatatgaatatacatctgtcgttgtatacacacactcaacactcaaaggattcattatcaaatgcatttctttttcacttccattttttgcaattttccatgctctctgctttgcccaaggcttcttctccaccacccaaaccatcccactttgcatgtctgttcttggctctcagtggaaagaccaaggaaaagaagctagacttcaccctgataacattttaagtccttctccattattagagaatacaacagagtctgtagcctgaatgaaaaatccaggccagaacatccatcccctgttccttggctcttcctccaagagatctcagctaggaaaagggagatctgaaatcttgctggcatgttaccaactaacagagtggtatccatcaatctagcctcttctctctctctttagaatgtaaggtattcaggacaaccatgggagttctgagatttttgtatttagaacactctttttagcaaaagaacatccagccttgcttataaataagttaaaaaaaaaaaaaaaaagacaagcagattaaaaaaagctgcccaggaggcactcatagaaaaaacaaaattagtaacctcttctacttgcccagcataaattattagtgtactcagcttgaccaagtgactatttataagtctgaacaccatggtgttcaataaatataattgaggatggtgacaatgctacccatatttccttacttaatgacacccagttggcagttcagtagcacaaatcatatgcattttactcttcctttactcgtcttcacattgtaactcatatcaggaatgaatttaaccattggaaatagccttccaattagcaaaattaatttttcgtttgatttgaaagagaccagccagtggatataagcaaggaaaaactccgcaagcagcatttctggcttctgtgaggagattttctgtcagctccaacaagtctttcttattgctacttttatagggtcatcattattcaacgtctcctagcttcaaatatcatctgcaaagcacatctagaaatttagctggtgatgcagataatgtatgaaactgagaaaccactacttgtttcccactggctaagttaaatatatagtttagaagattttagaacctctcagctagtctgaggtgggagaagggcaagagttcgccaacaccatgtgtacatagcctgtgaaacttcttaggcatttgttcaaaagagtatgtgaatgcaaaattcacaatttggacattttatctagccttcaattggcaactaggctggaactccatcaactttgtttagtcagatccttctctcatctctgccattcttctaaagccacaaagtcaaccctgccatctccttctcttcacaagacaatcttgtctcctctatgtctagaaaatcaaaaccatttaccaatactgtgaaacttaggaccacctttcactctcccatcagcatcatttttcataagtaagtaccaaaacaagtctttcatctgcctctgttctctcccccaccacccctatcttagtccgggtgcccatcactccttacttagactagtacctctcgtcatcttcttgcctactgcctaatttctctggaatccatcctactcgtcttccatgaaaagaaaaaaaaaaactatctaaaacaccaatcagatagtatcatgcctttgtataaaccctcacaacaattacaccatctgagaataaatctacatttattccctggttacaacctcatttctcatgacttctgtcacacatttcacaccatacacacacagctgctagtcctcacctaagagactttcacactcaagtctctgcctagtatgtacctcctcattaatcaccccaccctcccttggttcattcctactatatgtttaatgttcattcagggataatctcctggaagcccacagacttttttttttttttttttccgagacagagtctctttctgtcacccaggctggagggcagtggcgcgatcttggctcactgcaatctccgcctcccaggttcaagcgattctcctgccacagcctcctaactagctgggactataggcacgtgccaccacgcctggctaattttttgtatttttagtagagatggggtttcaccgtgttaggcaggatggtctcaatctcctgaccttgtgatccacccacctcagcctcccaaagtgctgggattataggcatgagccaccgtgcctggccatctggactcattcttaatcctctccaaacactctctacctaactctgtgagtgaactctaatacttctatatgtgaatctacttttttatctctgaattagtggatggtaattgacatatggaacagaatggaggaaagagaacttgacctaaggatccaggggaacttagtgtatgatgactggaaaagccacggattctgaaataatggtgttgggataacaagttaacatacagaaaaaataattttggattcttactaagtatcttcccccaaaattaattccagaaagattaaatctttaaatgttttttaaaatcacagaattagaagaaaatttaatggacaatttctataatccaaggggagaaagtttttccaagtataattgtaaaagccagaaactataaggattgatacatttgattgcacaaataagtagcttttcaattgggaaaaaaaaatgctataaatccaagtaagaagacaatcaacaaatagagaaaactgcatatttagcacattgcctgacatctaatttactttgtataaactgatttatatgtagagggctaatctccctaatatataaagaactcttttgaaccaacacaaaaaagacaaacctcctattagaaaaagcaaaacaaatgacatgaacaggcatacaaattgcctctaaatttatgtaaaattttcaaattcccaaagaagttcaaattttacatgttttgtataacagaataacaaagattttaaaaaatactctgagttattgaagacgtgggaaaatgggcactgttaaatactgctgagagtaaactgataaaaatttgcaggaagtagtttaagagtacatattaaaaattatgacccagaattttcaccagaatgtatcctaaataacaacctaaacatctatcaatgaggtgttcttaaattatagtagctctttatattacagtatcatgtaccatcaaaatcaataacacgcatatttacaaaaaaagctacacctatgttataaatttattttaaaaactatatttgaaaacaatttataacacagttgtgtttttaaataggtgtgcttacatgtacaacaagaaaaaaacttagaaggatatttctcaaaatgtaaatcatcatctctaagaggtggaactatgaattccttctttataccttctttcctatacatagatttttgaattatctgattttttttcaaagagcatgtatacttttataattaaaattattatgaacaatataattatttctactgtttaataagaatggagaaagacaaaaaccaatgtttgtgtgaatggatagagaagagtcacatgtctaaaaaagctgccattttaactaaattataccaaccacaaccaaggaacactcataaagtccagcttgtacaaagtttgacaaatccaattaacaaaataccatagactgcctggacagttaacactatagttttccttttctgaatctttctcatacacaaaacagtcagctactattctaattccagtggccgtgaaacaagaatgaactgtttcatatccattcaactctgatcattcttataatagaaaaggtgaagctaatttcctttctctgtctctgaaagtttgcccatcttttgtcacaaaaaatgttggatggcctttcagctctaaggataaacgcatgcacaggttaccaggacatgttgcaagtttatatgcatgttctcatatgaacaataatcatgtctatgattagccaataattctcacaaaacagaagggtatcagtaacataggcagaaaaatccaacaaacaaaaatgtcgactaagctttaaattcattttattacccaatattataaattttattacccaatattagttcaagtccatcattttaaaatagggtttatcaaccatagggagtatggggaagctaggacttggtgactggtcttcctgagaacaaaagaagtaaaagttatttatagtgaccttttaatgtttaccttagagctgctaatccgatgtaaattgtcaccccatggatatgcataatcaactttattccctttgctaattgagaaatagagctgttaatgtcaagaaacatttgaaaaatgcaccaagcctgctcaatggagcaagttcattttaaaagtcagagtttccatatggtaaaatcatggaaattaaacttaggggaaaaaaaaaaaaacagagagagagactaatttgttattgagctagtctgtgctagaacaaaatcagtcttaacaaccccaagcctggaaattttgaccacttcttatgttcaaaagtaactccctcagctcttatgaaaaataattccatcacatctctccaaagttcctctcctgctgagtttatgctttcccacctgcactgggtctggcttagcagtcactttgccaggacactcacacaatgcaattcacacaagtcagtccttctctttcttttactctctggtaggttgtcttttgagtttcctttaaaactgatcactgagaagtaaatgagtgagtcgtatgccaattgtgtaaaaaggggatgataatatattcccttgagtgatacttgaagattgctgtcacttttataatgccacatatggtagaagtaggcaaaattttaatttatggttaatcttagaagagatgtggttaaagcagtcactggctgcaagggaccactttgccctctcctattccaagacaagactcacttctacccttcctcagtgacttccttgttttataaaacccaagttttctcccgtttctttgagacaatcctcattattgaacattctcccccttgaaagagcttaactaaaatcttccccttaattgtctgctgcattttgtctaagaaattaaggccagccctaagcatgtgccccaaacattctcttctcaaaggcaaggccagcaaccattctgtttcttgcgacgatagaaaacacaagtcacagtgagaagagcacaagcactaaccacacacatcgatggcacacttcaagatcctgcaaggcagacttagtcctgagtgagtggggcttagtcctgagcacatctagacttcaatctcctgcagtcaccaggccccgcagagtgatatgttcacaaagacacacctgatgtgaactgcatgctcttctgagaaggtaacccatgattagcagaataagctcatatttaaaaaaaaaaaaatggttctttactccattcccaccacacactgcagggatctaagtaggggttacctaacctctctgagccttgatctcctcatccatcaaagtgctttaactgacctaatcacagccagagggctcaccttggttcaacaaaacatattcagacccattctccttttacttttaaaaaaatctaattttttttttttttttttttttggagacagagtcttgttctgtcacccaggctgaagtgcagtggcgtgatctcagcttattgcaacctccatctcccgagttgaagcaattctccagcctcagcctcctgagtagctgggactacaggcatgcaccaccgtgcccagctaatttgtgtattttcagtagagacggggtttcgccatgttggccaggctagtctcgaactcctgacctcagatgatcggcccgcctcagccttccaaagtgctgggattacaggcgtgagccaccgcacccggcctcatttttttcttcactttttacaaaataacagttttactgaaatatgatcctcataccctaaatattccccgtttttaagtgtacggttcagtgatttttaatatattcacagagttcggcaattatcaccattatttaattccagaacattttaatcatcctcaaaagaaaccccatatccatcagtagtcactccccatccccccactacaacccatgataactactactctactttctgtttctatgaatttggctattctagacatttcatatgaatgaaattatataatatgtagccttttgtgactagcttctttcactcagcataatgtcttcaaagttcatctatgttgcaacatgtgttggtatttcattccttttgatgccagaataatatttcatggtatagatatattaataccagattttgtttatctattcatcagttgatggacatgtgggttcttcccactgtttagctattatgactgatgttgttatgaacattcatgtacaggtacttgtatggaaatatgttttcagttctcttggatacatagctaagagatatactgggccatgtggtaactctacgtttaaccttttcaggaactgccaaattgttttccaaagtggttgtgccattttctttgctatttgatatattttggttccttctgtgtctgctttctggtttttgggggctcagctgggaaagtaattgggatacttcaaaagatattttacacatagtggacaatttttagccattataggtagacacaaatacacagtggctgagcttgggagccacagaatgtggtgctatagggcacaccgaaaggatatccatgctagttagcaatgatacctggagttcagagaacaatttaggaagatctgggtgggttttgatatgatatagcaataaacaacacatggatgcacgcacttagacctttatctcaggtgcttaaactataaccaggacaattcaagacgtacgtaaataatgacaggacacatttttgagattcctttgctttttttttttttttaagaatatataagaatatttccagctggccatatcagagaagatggttttggaacagaaaccatcttcactggctcttgaaggataaaaatgtcttaaacaagcagaaatgaggagttgcatctcaggcagaggcaactgtataaagaaaggcacagagtgaaacatacaaatgaggagctggaaaaagatacaaaagaaatgaaacaattaacattgaatatgaaaggtgatttagaaggtggaatacaagatgactctacgtttttggcatggaagatgggatagaccactgtgccattaacagaaaggatggtcaaatctgaaggaagaactagtaggagcgggaaggaaatgagttcaattttagacatagattgggtttaagctatcaggggaacatatgtaggtagggtccattaagcaaataaaatatagaattggagcttaagaaatatatttcctaatagaggtcattgctgaagccttcagtgggaacacagggagaagaaaagtggcctgttataacttaccctcaaagaggaaactcagtccactgcagaacaaagaagaccaggacaaggccatgcaagggcttgggaaactgaccaaattttagggctcaaccttgaggaagggagctggctgttcaactacaatgttctgaaggacagtgcaaacacaggcttaatcaggccagagctgataactaggaagtttaatctagaaagtcaggcacagcagcaggaatttccagtcacaggctagccatatcaggacagatcacctgccacgggatcaggagatgaaggacagaactcagcctctccagaactagcaggacctgggcaaaatagacaagttccatccaaagggacgggattccagaaagactctagttcacacaaattggacagatctgataggctttgctggaaggatacaggatggtctgaatacgagtaaccagaagtaactctacctcccctctgtcaacacctggtttacaggagcaagactggtttgggtccccatatgctacttactgtagatgaagcttctattgttccttctgccctgttcaggaaaggctcacaaactgactgaagctaagcttccagatgctccatcacaccagaatcagcattgaggaaggaaaggatagggccttgcagtacattcacatttggcagggcaaagaaggaagagagaaaaagaagatacggtggtggatacattcaaacactctgtatatcagcagagagtaatgatgaagcaggagagaaggagatcagagaaaatgaaggagtggactcaaaaaaaatgggtgagtcatcagggaatccctttgtgtcactggttttcacctaaaattttactttaccatatccaacagtgatgctctattacaaataatgctttgcttgtcatcctgccttcaaaagcccctttagttttcagcaaccaatacgtaagaatcacaactcctacataagtaccttttggtaaacacattcaatcttgacctggaagctacagtaaaaacaaagaaaagatcaattatataaagttggaaatacagacctccaaagaccctaactgttagagtagccagcacatatcagaaactttacagaatgccaaatcacagcataaataataaaatgtaaaactcagtggttataaaaatagactgtgagctaaaacttaaacaattaaaccatattatagaaaggcatcttttgaaaatttaaaatactacaattttaacacatataaaaattcacaaaaatgaagtttttttttacctcatattttattgaggcaagaagtaaaacaaacaatgatcttaacaccatgatcaaaaatagaaactttcaatcaacactgcacttttcacaaaattataagaggctgaaaactgcaaatagcacatgtcaagtctctgcacacttcactagagatatatttattcaaaactaaatgtctcccaacgatcttactctagaaagaacatgagtcatatatgctgagaaactcttcttacagttttaaccttttgcggaaaaaaaggcatagcttccagcccatacactagtaaagagcctgtgaaaaacaatttcacagtttaaaaagcaagactctctttggcactgatatccaacatttcagacagagaagcaaagagctcatcccagctgatgactgcctcataacttgggaagcaattgcataatgactaattctggagcttgtgcagatactgggacaaacactgcaaaccttgtaaaggacaaaaaatcccagtgggtgataaatcagcatggttgctcaggccctccaagtagtatcatggaaaagtgcagtggcccctcatatcgcactgaggcatcagctaagaaatgacttgagggaagaatgcctcctatggaatcatcaacaagtcaaacagatcacttcgtttttatacacttctggttcaggagtctgatttggtgctctacagaggaacacacaacccatgctagcaaaaagaagtagaaagaattcttttctccttctagaatggtaccccagcacaatcgggattgctagagggcagatatgcaacagagcgttcttaaagttactccttttctgaatactaaagaacttttctcaggctttttgaatgagctgaaaaccagtttcgaaagataagatattaaaccatttctatagggaataagaacactggagattatttactttgctgtaattactttggcacatagggagattagctttcaaatgctactaggtttgcatacagagatttcaataatgaagaaaaattagttcatgttttgaatatttagggcttgaagtatatattactgctaaagagtgaaaactggttaatacttgtgcagagaagaatagttaccaaaaccattaattgttttaaagtctgcacttccttccccacgaacaatcacttatttggcttattttctctcttttttaaaacaatacataatagttgtacatatttttggggaatatgtgatattttgaaacatatgtacaatgtgtatgcatgtataacacatcaggataactgagatatccatcacctcaaacatttatctttgctttatgttggcaacattccaattcttctattttgaactatatattaattgttcattatagtcaccctactgtactacaaaacccttgatattattccttctatccaaatgtatttttgtacctgttaacaattgtttgtttttaaaaagcatcttgacttttattagagccactactaaatgaaaactcacttgtacattcataaacgagtttgagtttcataagaattgggtttttaaaccaagaagcaagacagccaataattccatctagtaagggggaaaataaaacttcttttgagttaaatgaacaagcttcaagaagagataaatggaattttagaaattcattatttagtgggatattttcttgggttttcgagattgtttacatcatgactttaagctgggaccaaatttatttctgaaaagagtctggtagcatgtctcgctttatacattatagttcatctccctgcttgctatctgttaggtgagaagtggttgagattaagtgacaatgtttgcacagttatttttgactttttattctgaaacaattatcaatttacaggaagttgcaaatgttccatgttcttttagccagcttccccagatggtaacatctcaacataattatcaaatccaggaaacttggtttggatcataatcctgaaagatacaatcccaaatgttgaaatcccaaaggatcaaaatccctaaatatcaaacgccctttaaatcaaaatcttaaagtccaaaattctgaaaattatagtcacatgatagttgtatcatgttagatgaaactattaccttcttactgtctttatttggaaattgaatatgatttaaggagagctgtgtcttgaaagaaaaacctcagctattcatcatgatacaagactttaagatataatgattgtgaaagtcacccaactcttataaactatctccaggcaactgtccacaatctattcttgcaatacactttttcacacatggaattttaaaagattttttcttattattttagtttttcactctttaaaattatcagcattattttctacaattcacttgctatgtatttcatcttcacatcatttcaatactggaggtacaaaactgtagagacctttagagggttccaattagttttacgcatttttttgcaagagactccacgaaagtgcattatcacaatgttaatttttgtttgtaagcatttgtgcatgtacataaaaacactgaaatttcctcaataaagagatgtactttttgtacacgtgcatttgtaaaaaataacatttctcaagatctcagcaatttgtgtgactgtatatgttgtggtgacccatcttagttttttaactaatctcctcaaaagacttagattgttcatcacagtatttcagatgaccacaggtacaaagctgggtgcacacggttacaaaccacaatgatatgcactcattatttccctttttacctatttctttatgaatagggtttatctgctcataactgttatacccatgcaattattgtgtgtataccttagtgcttacacaaaatatctatgttagtattgtgtattttattgtgtaaggtaacctatgaagtgttctgtcatgtttttatatgtttcataaataaatccccttttaaaatgcaaatacatatcttttaaagaatttttaaattattttttccagaactatatttttgggatttttatctttcaggattgtgattttggggattttagactgaaggaattttatcttttgggattatggcatttggaattgtgtcttttggaattataataatcttcccaagaaactacaatagtatgatacccttatacagactacagaccttattcagattttgccagcttttgtatgcactcatttgtacatgtgtatgtatgtatgtatatatatagttttacataggtgtagtccctgtgtagattctgataaccatcactgtaatcaagaaacagcattcttctaaccccaccagggaacacccttatgctactccctccatcctatccctatcccctggccaccactaatgtgttctccatctctataattctgtcctttcaagaatgttatataaatggaattatacactatgaaattttttgaaactagcttttttcactcagaataatgccctttagacccagccaagttgctgcacgtatcaatggttcatttgtactctttttagtgctctgaaatattactctcattttgatcatcatacaaattgactgaatgcagaaatatcttgttgaggtttaaatagatagataaatagcacttctcacaagttccaaaacaaattaaaaggcaaatgaagcaggcagataggggataaaaagatatcaatgctttactgttcagtctgattgaagaatatagctttatatctgatgccagaggggttggctaatactctactgcaggattaaacttatccattggcatagatggaaaactactggcaggcaaatctggaagaacggggcatgctgaattcctactctgtaactcacctttcaggtaatgctatagtcaaaatgtgtccccccaaaactcatatgtagaaacttggtattaatagatggggcctctaggaagtgattaagtgatgaggacagagctctcacaaatgggattagagttcttataaaagaagtctgggctgggcgcagtggttcatgcctgtaataccaacattttgggaggccgaggtgggtggatcacttgaggtcagaagttcgaggccagcctggccaacatggtgaaaccccatctctactaaaaatacaaaaaaattagctgagcgtggtggcaggtgcctgtaatcccagctactcgggaggctgaggcagaagtatggcttgaagccgggaggcagaggctgcagtgagctgagtttgcaccattgcactccagcctgggcaacaagagtgagactctgtctcaaaaaaaaaaaaaaaaaaaaaaaaaaaaaagtttgaggaagcccttttgccccttctgtcaagagaggacacacagaaggcaccatctatgaaaaacaggcctctaccagacagcagatctgctggcatcttgatcttggacttcataggctccaaaacagaaagcaataaacttctactgtttataaactacctattctatggtattttgttatagtaccaggcacagactaagataggtaactttaaatccaggagaggaatgacttgggaggcatagaaaaatgggtagtgttctttccatatttttccttcctcaggtgcagtgtgtacattctgtcctctgtagaaacataaagagtatggaatagacattgtagccaacaatctagattttctcccccttatccctttcactgtcttttagtttttcccttccatttatgggcaaccagaaatgttgctattcccctgagtgaagactgcttttcggggccataaatccaggcagctttagatagtattcttagatacctctctgaagcgtctctgggaatgttatacgcttatcttcctttctacttcagaagtcctattcatagtcctattcctttgttctatagaatatctcaataacatttcttgagagtagattttattcagtagatgacaaatttaaagcaaaatatataacaaacaggcaatatgctaggagttaagagaatttaccttaatttccaaatgaagactttacctgttttgtttcccctaatgtttgcccaaaaaggaataactgactactaaaaataccctatgcttaccagttctatagtaaccttcctttagaagctatttctttattagcttttcctattttaaaaaatgacatatatgtacattatatatatatttttttaaaaaacagctttttgcaatttatagcaaaatggtaaactagaacaggttattgtatcccttcctcatgctcaaacctgaaaaaaatgaccttagtagcaaagaactaaaaataacagggatggtgaaagacaccaagaataggtatgccattgtattcttcttgatagaattatggataacaaattaagacaccgatagagaaaaataaaaaagaagagtgcactttaataagttagggagaatcacataatgttgaactagtgtcttttaaacaaaagaaaatgtgatgtgtacaaaggaaatcagaaaagaagaagaaaaagtaaaacaaaaagaaaacataataaacagaaaatatatatgactaagataacaggaataagtcctgatgtaacagtatttaaagtcattataaatggtataagcccaccaatcaagaccctcagagaagttctgacttctaataatggtggagtagcttataacagactaacactttgctgaaaataggtacaagctccacacaaaacataaaaacaactttttgaaggcactgaagggaaaccaaatgaagaaggaaactgacctttgaaagaaaaaaaaacaacacactgggtaagatctacttttatacatcttttcccttaggacaagataggtggaattcaagcagaaatccagtctggttagtatgaagagtcagaggacagagtctgaggctgccagagcactgcaaaaagcaacagggggtgggactggtgatccacaacgaagaaatgcgtagaaataagacctgaatcccgcatttaaatccttggctgatcacttaaattgtacgtacatgcatgcatggggcaagactccaaagagcacaggataaaacgaaccaatggaaggcggaaagaaccaaatagagatttcagcagctgtatatttcagctgctaataattattatcttgaatttgcaatttaagtcctgccagatagtgggggcttggcaaataacttgggctttctagtgacatcacagaagggccatgagttaagaataaatacttatttgaagaactattttccttacaactaaaggcaaaacaaaaacagttctaccctaacaaagcctaatattgaccagtaacataattggatattggatattatccaataatatgaaagatataggtaaaagactacagaggatataaaacataatactaaaattatttaacctaaaaaattcaggaaaggaggaacagagaaacaaaatagaggagacaaatggaaaccaaatagcaaaattgcacacttaaaaacaaatatcaaaaattaaattaaatatatgtaacacccctgcagtgagccaagattgcaccactgcactccagcctgagtgacagagtgggactccatctcaaaaaacaaacaaacaacaactctctctctctctctctctctctctatatatatatatatttgtaatatatatatatgtaacactccaattacaaggcaaagatttttaaactagataagaaagcaaacaaatacatgctctattaaaaaagatgcactttaaatgtaaagatatatgcaagtttaaaaaaaagaatgaaaaaaatacatcaaatattccacatataagaaagcctgtatggctatataaatatcaaacaaagtagacttcaagccaatgtatattaccagagaaaatgagggtaatttcataatgacaagggggtgttactatagagggccgtttcattaataaagctcaagaattttaacatatatgaaacaaagacttagtagaaataaggggaaaaaatagaaaccattcacatagttggagatttttaacacccctctcttaggaaattataaaacaacagaccaaggggatagtatgaatgcagaagatttgaacattatcagtgaacttcaacttaaaatatattttgaatagtaaactcaacaaagcaaaattcatatagtacacattcttgtccagtacattgaaaaatatttaatgagacagactatatattggaataaaaaacatcttaataaatttttaaaaatcagatagaatatgtttcctgtctacaaagtatttaataagatatcaatattaagaggtctagaaattaccaggcctctcagaatattccttctaaacaatccatgggtacaaagaaatcataagtgaaattagaaaatatttagaactaaataataataacatataaaaatgtgtgagatttactaaggcaatgcttagaaaaaaatctgtagatttaaaaagcttatatttaaaaaagtaagaaaggtttaaagtgaatgatctatgctaccaagttaagaagctacagatagaataaattaatacaaagtaattagaaaggaggaagcaataaaataaagcagaaaacaatgaaatagaaaagagacagtaatgaatatcagcagggccaatttgggttcttggaaaaaaaaagaaagaaagaggcggaaggagcataccacaacacaatttacaattatcaccctaataacaaaatgtgatagcaatattacaaaaaagaaaaatcacaaaccaatatcactcagaaagatgtaaaagctgtaacaaaatattaagcaaatcaagcccagtaatacataaacagataatacagcttgaccatatggtatttttcccaaaaatacaagattagttcaacattcaaaactgtatctgattaacaaaaatattaacaatatatgggtaaaaataaaaactatgatcattgtaagagatatagaaaggacattttacaaaattgagcacatgatcaagaaagaaaaaaaaaaaacaagctcctagtaatagaagggaacctgataaaactatctaaaaaaaatctcactctaatatcacaattaatgttgaaatattgaatgcttttctcctaaagtcaggaaaatatccactcctaccacttctactcaacattgaactaccagtcctggatagtgcagtaaggcaagaaagatatatatatatatatggcataaacattagaacagaagaagtaaaactgttttttgcccccaccctcactcccgacccagacaacatggttgcttacagtgaaaattttaaggaatgtacatacacataaaattactggaactgaaaaattcctttagtaaggcccaatgacagaaagtgaatatatgaaaatcaactctatttctatataccggcagtgaataactgaaaatgaaatttaaaacgatactattaaaaattgcataataaaacattaaatagagaaaaaacataataacaaatatgcaagacctctatacggaaaaccaaaaaatattgaagaaaaagaataaagacctatgtaaatgaatagatgtttcatgtttcagggaagtctcaacattaaaccgtgacctgccccaaagttgatttgtagattcaatgccatcccaatgaaaatcacagcaggatttttacagaaattgacaggtgagtctaaaacttgtatggaaatgtaaagaacctatagttattaaaacaataagaacagggtggggcgcagtggctcacgcctgtaatcccagcactttgggaggccaaggcgggcggatcatgaggtcaagagatcgagaccatctggccaacgtggtgaaaccctgtctctactaaaagtacaaaaattagctgggcgtggtggtgctcgcctgtagtcccagctactcgggaggctgaggcaggagaatggcgtgaacccgggaggtggaggttacagtgagccgagatcacgccactgaactccagcctggtgacagagaaagactctgtctcaaaaaaaaaaaaaaaaaaaaaaaaaccaagaacaaagtagaaagatttacaggacctgattccaaaatttacaaaaatgctatcagaaaatgtggttctgatataacgacagaaaaaaagatcaattaaatggaataaggaattaagatatgtatgtggacatatattgttagactaggtagttaggcagacatgagcagagtgggagaggggtcccccttatactaggaatgtcaggacaccatcaggtgatggctagacagttcttaaactgcctctctaaaataattggttgtagctggtgccaggaaaggcagtttcccagtagatagagaacacctgaagctgatgatcagcggcttcctaataagatctcaggagttgggtgagtgggctcaagcatgagcactaaaaggcaaactggcacgtttaactggtatatgaccttgctctaggaacatttgtctggtgagggaagaatgcctcaagtgagcatgcgtacaacttcaataagcacattgggcatgcagcccctcccaagtgcggacaggccattgcgcatgtcgacagcccaccctaagggaagaatcaaggtagaagtaacacagaccctggaatcatgccaatgtataaagccccaaggcaaaggtcaaacagtgcacttgaatctctcaagtcacctgcttggccctcttccagtgtactttacttccttttgttcctgctctaaaactttttaataaactttgactcctattctaaaacttgccttagtctcttgcattgccttatggcccctcagtcaaattctttcttctgaggaggcaagaattaaggtggctgcagacccatatggatttggtgcagctaacaataggacaaattaattttcaacagaagcaccaaggtaattcaatacagacagaaagtgtgatcttttcaacaaatgatgctgaaacaaatgtaaatctgtaatgaataaataggcctcacaatatataggtaaagtaacccaggacgattcatagagctacatataaaaactaaaaatataaagctgatagaagaaaaaacctttatgacattaggatggtaaagatctttccatacacaaaacccactaagggttaggcaaaacaaaacataaaaaaattctgctcttcaaaggacatcattaagaaaatgaaacggcaagccatagattcccagagtggctttaaaaagcaaatagcctgtctatgagaattatagtttttaaaataaggatataaaattactggggtaaaaaggaagaaaatatttaaaatacacatatctgacaaatgatgtatatacaaaatataatttttaattctacagtttaataaagagacaacacaataagtaatggacaaaagaaatagaaccttgagaaatgaagatgcaaaaggcgaattagtataagaaacggcttcagcttgacatcattagttacctgagaaatgcaattaaaaccacaaatattgatgaggtaataggccacaatattgaaaaacacaatacattccaaaggctcaacatcatatggaaaattttttatgaccatactatgtagtaaaatcagaaattaataacaaaggaacaaaaaaagtaaaaaataagtttgcaaaataaatattaaataaccattacagaagaaatcttaagagaaattataattttaagtacatttttaacgaaacaagaaagactgaaaacaagcaagttaaacagtcaacacaagaatctgcaaagagcaagtaacaaattgaaacacaaaaaagggaaacaatgatgagggcagggatcaatgtgaaaaacattcatgaaggaggaggaaaagaaggaagaagatgaggaggagagaaggagggagaaggaagattaacaagctagttcttgggaaagattcctaaattatacatagttcaagaaaatctgaaaaagataaaaaggtagaagttgcaagttaaattaaaaaacagaaataactacaaactgatttttaaatgagaaaagaatatcaaatcttcttgaaaatattaagcatcaaaattgtttgagataaaatagaaatcttggataaaacaataatcataaaaaacagaaccggaaataataatttttaaatctcttccaaaaacggaaaatattaggcccagatcattttgccagtgagttttactttcaacaaacagatcattcctattttatatgttattaaagcacacagaacaagaggataagctgcccagcatatgtgataagaacactggtaccttaactccaaaacctaataaggacaatgaaagaaaatctcacttatcaacatagatgcgaatatgttaatataaacatagtcaatcacatccaacagagtattaaaataggaggggagaggaaaaagagggcaggaggagggaaagacagtggcagggcaaggagactatggcaaagataacaaagacatcaggatcagataaagtttatcccgatgttcagatatatcctatgtctggataacatatttcctaataattcaatgatggtttgacattagaaaacatatgaaagtaatccatcacattaatagattaaatgaaaaaaatcacttggttatctcaataaatgtagaaataacatttgaaaagtatacaatgattcatgttaaaaattatcagactactaagaatgagggtaacttccttaataaggtaaaggttatatagcaaaatgtacagcaagcactcaattaattgaaaaactttagacacataatactacctgctatcactacttcaggccaacactatgagaaaacaaaaagaaatcagaaggataataattgaaggaggagagaaaaaagtgatgaacataaaatgtgtctatcaacatagaaaaattaacacaatcaatgaagagaaatgtgaccaacataaaaaagtaagctgaaccaatagataagaattaacagaatcaatacaaaagtagaaaaataataacaaatttgaacaaggtggtcgaattcaagatcaacttaacatctacaaaattgctctacagaaacaataatcaagtagaaaaatagaaaataagatagcatccacaataaaagaaataccttttttttttggtttggctatctaggattaagaaagttggttttttaaattattattattatactttaagttttaggttacatgtgcacaatgtgcaggtttgttacatatgtatacatgtgccatgttggtgtgctgctgcacccactaactcattatttagtattaggtatatctccaaatgctatccctcccccctccccccaccccacaacagtccccagagtgtgatgttccccttcctgtgtccatgtgttctcattgttcaattcccacctaggagtgagaacatgcggtgtttggttttttgtccttgcgatagtttgcttagaatgatggtttccagtttcatccatgtccctacaaaggacatgaactcatcattttttatggctgcatagtattccatggtgtatatgtgccacattttcataatccagtcttaccgttgttcgacatttgggttggttccaagtctttgctattgtgaatagtgccacaataaacatacgtgggcatgtgtctttatagcagcaagatgtataatcctttgggtatatacccagtaatgggatggctgggtcaaatggtatttctagttctagatccctgaggaatcaccatactgacttccacaatggttgaactagtttatagtcccaccaacagtgtgaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgctttttggctgcataaatgtcttcttttgagaagtgtctgttcatatccttcacccactttttgatggggttgtttgtttttttcttgtaaatttgttggagttcattgtagattctggatattagccctttgtcagatgagtaggttgtgaaaattttttcccattttgtaggttgcctattcactctgatggtagtttcttttgctgtgcagaagctctttagtttaattagatcccatttgtcaattttggcttttgttgccattgcttttggtgttttagacacgaagtccttgcccatgcctatgtcctgaatggtaatgcctaggttttcttctaggttttttatggttttagatctaacatttaagtctttaatccatctggaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgtgggctcttttttggttccatatgaactttagttttttccaattctgtgaagaaagtcattggtagcttgatggagatggcattgaatctataaattaccttggacagtatggccattttcatgatattgattcttcctacccatgagcatggaatgttcttccatttgtttgtatcctcttttatttcattgagcggtggtttgtagttctccttgaagaggtccttcacatcccttgtaagttggattcctaggtattttattctctttgaagcaattgtgaatgggagttcactcatgatttggctctctgtttgttactggtgtataagaatgcttatgatttttgtacattgattttgtatcctgagatttgctgaagttgcttatcagcttaaggagattttgggctgagacaatggggttttctagataaacaatcatgtcatctgcaaacagggacaatttgacttcctcttttcctaattgaataccctttatttccttctcctgcctaactgccctggccagaacttccaacactatgttgaataagagtggtgagagagggcatccctgtcttgtgccagttttcaaagggaatgcttccagtttttgcccattcagtatgatattggctgtgggtttgtcatagatagctcttattattttgagattcgtcccatcagtacctaatttattgagagtttttagcatgaagggttgttgaattttgtcaaaggccttttctgcatctattgagataattatgtggtttttgtctttggttctgtttatatgctggattacatttattgatttgtgtatattgaaccagccttgcatcccatggatgaagcccacttgatcatggtggatgaactttttgatgtgctgctggattcagtttgccagtattttattgaggatttttgcatcaatgttcatcaaggatattcgtctaaaattctcttttttggttgtgtctctgcccggctttggtaccaagatgatgctggcctcataaaatgagttagggaggattccctttttttctattgattggaatagtttcagaaggaatggtaccagttcctccttgtacctctggtagaattcggctgtgaatccatctggtcctggactctttttggttggcaagctattgattattgccacaatttcagagtctgttattggtctattaagagagtcaacttcttcctggtttagtcttgggagggtgtatttgtcgagtaatttatccatttcttctagattttctagtttatttgcatagaggtgtttgtagtattctctgatggtagtttgtatttctgtgggattggtggtgatatcccctttatcattttttattgcatctatttgattcttctctcttttcttctttattagtcttgctagcggtctatcaattttgttgatcctttcaaaaaaccagctcctggattcattaattttttgaaaggttttttgtgtctctatttcctccagttctgctctgattttagttatttcttgccttctgctagcttttgaatgtgtttgctcttacttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatatacccagtagtcattcaggagcaggttgttcagtttccatgtagttgagtggttttgagtgagtttcttaatcccgagttctagtttgattgcactgtggtctgagagatagtttgttataatttctgttcttttacatttgctgaggagtgctttacttccaactatgtggtcaattttggaatagatgtggtgtggtgctgaaaaaaatgtatattctgttgatttggggtggagagttctgtagatgtctattaggtccgcttgctgcagagctgagttcaattcctgggtatctttgttaactttctgtctcgttgatctgtctaatgttgacagtggggtgttaaagtctcccgttattattgtgtgggagtctaagtctctttgtaggtcaataaggacttgcttcatgaatctgggtgctcctgtgttgggtgcatatatatttaggacagttagctcttcttgttgaattgatccctttaccattatgtaatggccttctttgtctcttttgatctttgttggtttaaagtctgttttatccgagactaggattgcaacccctgcctttttttgttttccattggcttggtagatcttcctccatccctttattttgagcctatgtgtgtctctgcaagtgagatgcgtttcctgaatagcacactgatgggtcttgactctatccaatttgccagtctgtgtcttttaattggagcatttagcccatttacatttaaagttaatattgttatatgttaatttggtcctgtcattatgatgttagctggtgattttgctcgttagttgatgcagtttcttcctagccttgatggtcgttacattttggcatgtttttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctggattgaaagttcttttctttaagaatgttgaatattggcccccactgtcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcggagtgtcttggagtatctttgtggctcttctcggagtatcttggagttgctcttcttggagtatctttgtggcgttctctgtatttcctgaattggaatgttggcctgccttgttagattggggaagttctcctggataatatcctgcagagtgttttccaacttggttccattctccccgtcactttcaggtacaccaatcagacgtagatttggtcttttcacatagtcccatatttcttggaggctttgttcgtttctttttattcttttttctctaaacttcctttctggcttcatttcattcatttcgtcttccatcactgataccctttcttccagttgatcgcatcggctcctgaggcttctgcattcttcacgtagttctcgagccttggctttcagctccatcagctcctttaaggacttctctgcattggtttttctaggtaaccattcgcattcttcacgtagttctcgagccttggctttcagctccatcagctcctttaaggacttctctgcattggtttttctaggtaaccattcgtctaattttttctcaaagtttttaacttctttgccattggtttgaatttcctcctgtagctcggaatagtttgatcatctctgaagccttcttctctcaactcatcaaagtcattctccgtccagctttgttccgttgctggtgaggagctgcgttcctttgaaggaggagaggcgctctgctttttagagtttccagtttttctgctctgttttttccccatctttgtggttttatctacttttggtcttcgatgatggtgacgtacagatgggtttttggtgtggatgtcctttctgtttgttagttttccttctaacagacaggaccctcagctgcaggtctgttggagtttgctagagatccactccagaccctgtttgcctgggtatcagcagcggtggctgcagaacagcggtggctcagatggaaatgcagaaatcgcccatcttctgcgtcgctcatgctgggagctgtagaccggagatcttcctatttggccatcttcgctccgccaagcagaaatatcttgaaattaacttgaaagtaagaatgctcaaggaagtcctggacagagcattcaggcaagagaaagatttaataaaaggtatccaaataggaaaagaagtcaaatgatctctctttgctgacaatataattctacacatagaaaagcctaaagactccaccaaaggctcctggaactgacaaactaattcagttaaatttcaggatataaagtcaatgtacaaaaatcagtagcagtcctatacagctataacattctagctgagaaccaaattaagaacacaatcccatttacaatacccacaaaaaaaaaaaatgaattacctaggaattcatctaaccaaataggtcaaagatctctgcagagagaactacaaaacactgctgaaagaaatcagagatgaaacaaataaatggaaaaacatattaagaccatgctcatggattggaagaatcaatattgttaaaatgatgatactgcccaaagcaacatacagattcagtgctatccctatcaaaatactaacgctgtttttcacagaattagaaaaatctattctaaaattcatgtggaaccaaaaaaaagcctgaatagccaaagcaatcctaatcgaaaagaacaaagccagaggcatcacattacctgacttcgaactatactttaaggctacagttacccaaacagcacggtactggtacaaaaaaagatacacagaccaacagaatagcatacagaacccagaaataaacctgcatatctacaaccatctgatcttcaacaaaatcaaaaaaaatatgcaatggggaaaggacttcctgttcaataaatggtgctgggataactggctagccatatgcagaagaatgaaactggactcctacctctcagcataaccaaacattaacccaacatggattaaagatttaaatttaagacctcaaattataaaattcctagaagaaaacctaggaaatcccttctcaacattggctttggcaaagaatttatggctaagttcctaaaagcagttgcaacaaaaacaaaaattgacatgtgggacctaattaaaactaaagagcttctgcagagcaaaagaaactatcaacagggtaaacagacagcctacagaatgggagaaaatattcacaaactgtgcatctgaccaaggtctaatacccagaatctacaagcaaaaacaaatcaacaagcaaaaaataaataaagcaatttaaaaatgagcaaaggacaggaacagacacttctcaaaataagatgtacaagtggccaacaaacatgaaaaaaagctcatcactaatcatcagagaaatgcaaatcaaaactacagtgagataccatcccataccagtcagaatggcgattattaaaaagtcaaaaaatatgatgctggtgaggctgcagagaaaaggaatcacatatacacaatggtgggaatacaaactagttcagtcactgtggaaagaagcctggagatttctcaaaaaagttataatagaacttccatttgagctagcaactcactactgggtatatacccaaaagaaaataatccattctatcaaaaagacacatgtacttattagttcattgcaacactattcacaatagcagagatgtggactcaatttagttgcccttcgacagtggtttggataaagacaaggtagtacatatgcactatggaatacactgcagccatacaaaagtgaaataatgtcctttgtagcaatatagactgagctgaagatcattatcctaagctaattaatgcaacagaaaaccaaatacaatatgatctcacttataaatgggagctaaacattgaatacacatagacataaatatgggaacaacagacactgggaactaccagatgggagagggagggagggaagaggggatgggttgaaaaagccacctactgggtactatgctcactacctggaggacaatatcatttgtctcccaaacctcagcatcacacaatatacctatgtaacaaacctgcacatgtaccctttcatctataataaaaattgaaattatttaaaaattggaatcatctcgggaggctgaggcaggagaatgttgtgaacccaggaggcggagcttgcagtgagccaagatagtgccactgcactccagcctgggagacaaagcaagactccgtctcaaaaaaaaaaaaaaaaaaaaaaaaaaaaaaaaattagaatcataataaagctgttaaaatagcttaggaataacgatataatgttgctgttggacccttcaaacaagactttgttatatattcccccttgtgcaggtattctactgtgtcctttagtagtatttttaaattttcttcataaaggttttacacatttatagttttaaaaaagaatgcacaagatctctatggagaaactttaaaaactacattaagatcagatacaatggacgagatgaattaaccaagaaatattccatacataggaaaaaattatcgtcatcctgtaatttatttttcctaccactattcttctccatctctcaaggaggcaactgatttatcccctgaaggctcagggcctgattccaagctgatctagatgtaagacaatcagcattttaattcccactggcaaccattccctgaaggtctggagctagttactcttctaagtatttgtttccacaaagcttcttaagcctcttctattactgcctattagaagtcaggtgtccttcagcagtgttaactgtgtttttatacctaccactgagttgtagtactccatatatattcattcaaatacacacacacacacacacacacacacacacacacacacacacacaccagcaatcgcacattcaaggttaggtgtgggctttggtttctgtgactctgtcttgctctagcctgcccttctgcctggttgctggagctgctcaatgcagcgcctgggcattcaggctccccctgaatcatctacatcccagtggtcataatcaatgctgtggctggaaagatgagagataagaagatcacacgcgaaattctagaaaccagaaatgcaccaagtcttatggcactcatagacaaaacacctgattaatccctcatttcaacacaagatatccaaaggaactaaccaccagagaaccctaacgtagcgcaccaagtgtggacagtctcggaacatgcaatggagcaccagaaccctaaaaagactggccaaaatcctgaaaaagcttgccacaccttttggctatggagctttttgcctaaggggccatgcctgcacccaagctctagcctgtccaaatgaatgagtctcttgcccaattctgaccttctgtttaagacttctagagaaggtatcagacctcatatcctatttctgagacacgataacagcaacatttgtaaatctgctggaattctcacatgtaaagaaaataacctacagcaggttcacctaatcctctcttcaagcagatatatttttaaaaattcaagatgtatatctttaactgtaatcattctaaaaataagacagagaacagtgtttcattttgaagggaaattgtctaaaattaatataaattacatgttattattgaaaaatcacatatgtaagtctgacgtttctctcaggactgtgcttgcagacttatagatcccatgcaatataaataagaaagcaatgatcttattcaattttcttgtgccacacaagtaaatgttctataaacacactacattctctttgataaggcagccctggactagggctgctccctgaacctaccagtttctgtacttccatctctcagtgacttcgcacaagttttccttcatacggaagcccgttcaatgcctctctctatcatttccttcctcaatggctactcaaaatcacctccttgaaagtttgcccactcttcccaggtgcccaagccctttgagctgtctcaattatagctcagcttccatttgctttgaattggacttacctttttctctactactcagtgctggtgttatgggcatgtgacttgtgcagccacaaagagcttcactcttagaaactccatctgagtttaatgctctgctgtcatcatcttgacattttcaagaactttatttttgaacttgtgttttgtaagtgaagcctgatgggacactagagcatgggcacgagcagaggggtatgcacatgtgtgtccccattcctttctaccttatttgtatacagcttttttgatgctccatgaagacagaattccagtggatccacaatgggtgggaggaagtctaacaagactcaaagccaagtacaaggtaaacatattacatttatgactaagtagtgagtaaagagggacactgacaaccctgagagggcatgctctccacttgaaccagaacttgattcacaggcagaaagaaggcaatgttgttctaaatagtagtcaaccacttgctggaaataatgacatagaagaaaagggaaacacagggcaacccattatttattttcttttcagtccttccttatttaccggtagtccaaaaggagagagtggtgggtagaatgtgcacataccaagaagtgaaataaaaacaactgagttttgtgcagtgtttccactggtttggtaaggacggagttgtgtaatttcaatgattccacatacaaatttagtacccttatacttacatttaaaaccagtattgcacaatatacagatgaatggtaaaattcatgctaataatttaaatttttaattattattttcttaggatattaaatagcaaatttaaaacaccataaatccagagactacataaataagaaaaagcttttatatattttatatcttttttttttttttttttttgagacggagtcttgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtgtttttagtagagacggggtttcaccgttttagccgggatggtctcgatctcctgacctcgtgatccgcccgcctcagcctcccaaagtgctgggattacaggcatgagccaccacgcccggcctatattttatatctttactggcactttttcccctgctttttgcacaaggggccccacattttcattttgcactggaccttacaaattagatagacagcctgccactgagacatcagtccctggagcacagggactctgcttcatgcatggctctctaactgcagcacctaggctattgctttatgttcattcagtgctcagtaaacacttgttaaacatagaatgtggtgtataaggacgaaagatcttagggtcccaagctaggaagacaataaccctgctctcgactctgttaaacagaccacacctggggtacaatgtccagttctcagggccacctttgaacaggaatgtagagaagaactcatcaaaagatactgggttcaaattatttcatcagcttattagctatataaccaaacagaaattggattagtctttgtgatcctcagtgttcttttttgcaaaatagggataaaagggtatttaaaaagacaatgtaagtgaaagcattttgcaaattccattgctttatacacatgttagttattatgatcctaactggaaggtgtctgtaggaaattaactggaatgatgagatggcataacagcagggccttaggcaacagagaggatctaagaggaatacagccactgacttctaacagttaaatgttcacagagggatgtaggtttaagagtgaccagtgagagcacagtaaaaacctctgggaagaaatgtataataaggcaggaaaggagcatgaggaaaaatttccaaagaagtaaatgtgggcctgcctgaggatacagtaagttccctgtcctttgagagtacaggactacctaagattttaagaaacatgtaacatcagataacaactggacataaaataataaccataatgatggtggtagatattgtttattggtgcatcctaaataccagacatgatgacagggactttacatacattattttttaaaatcataacaaatccataaagtgggtaaaattactcttatcactgttattattactctaaaggtaaaaaaaaaataggttaagtaatttatccaagatcacaaagccaaccaccttccactgaattcaaagtcaatattgaacatttatctggctgctaaaagaaataataatgattacaaatcccaggtctatttgttaaagactcccaaaatggcatcctcaatttcacacaaacatgacaataatcatctgaatcatgaagaaatctaaaagatataccaagaaaattacatcatcataaaacagaactttaaaaatatcaaggagacaaaaggttttcctcctagggcaccaacacagtttgtgagttcctagcccttcccaaactgtccccacaccttaagaaacactaggggctctagagctctctctctacacaaaggattcctgaacacagatcttaggccccgccttggcagagcaagtgggagcctgggcctgcagacagcacttttgtcccatttgaagatatactatatagctttttatatttaagcatcttgaaaatcactctaggaaagccatatttgggcacttagaagtatagcaggtgtgaaattatctcttggtgggacactgctcacttccccaccacttaagcccagaacgtgattaaaaccaaaatctgtaaaagcaaagctgtgacattcatttaacatttccattgtcaaaaaaattactcaggagccttgtaagtactctgtattctacctgttaggattgttttgaaatgacatcaccacaaatttcaactgaaaattaagaattggaagacagccgactctatccgctattcctaaaagcacttcaaactcttaatcttcttatattcatttcaagtaggtaacaaagcactccatgagtacaaatgcattttaacagacttttgccaatgccaagacaatgtgagagtcactgaagatactcaaaatttaaaagtgggtttatatcacactataaatgggacccaagacactttctgtccaggtgttgctatacttcaaattggtggtggcattttaaccatctatacaaatgcctgaatctacacacacacacacacacacatacacatgacaggaagaattgcaccaaacctttaagctgtagaaaaaaaagaaaatgagactccagaatatttcattaagataaaaatgttaggataaaaatgtccaaacacaagctttgctactgaaaacagttattctgggatatctgatcagccgtacaacaccttatctcttcacatcactagggtagtttttatatttgaaaccacatcataaattatactgtaatacctatctgcctcaaacacagtagaaaaacacctacacagcataaatcatacatgacatcacattaggtcttttaaataatgttgtgaacaccaggaaaatattccagaaatccatttttcatgctctttcttttaactactacccaaatagaagtgtctactttgcctctccaccagtccttttcagttaaataaatcaaatatatacaaaggacttctcatgcatgaaaggtaccacatgtttctacacaaataggagtggcatatctatcctccctaggacacagaatgctgagttcaagcaggcctggtctgtcttctatgtgctctacctcttagaggtctgacactgcttctctttgtgtctacattttgtttgaacagtacctccaacacatggaatgaaaggacggggagggaattctcctagcacctatgcatccctcactccttggcaacactatcttaccacattgataaaataatctatttgcctgtacctatgcacaaggaccattttactcatttgcgtatcttccctgattagcaggatagtagaaacaattaacaccgaatccataagtgtagattaaacaaaaaccagtcaagtttgcctttgtattgtaactctggtaataggttttagaggaaattcaactaaaaaggaaaatgaacttaaagagtctggatttttttcctaatccatagttatctaattcaccctttctcaaaagaaggctctctctttcttcctctttatcggctcttgcctgtctttccctttctccagttctctctcacacacagcttgtatctaaagctatgcaagaaatacattttatactagtgatttggtcagtgttaccctgcttcttcttgctatgaatgcagtatatatgagataagtacaaaagaaagagtatctaactctcttattttcatcatgacccactgggacaaggggagagagagggcacagctgcctccacggaataccctgttattgggcatgacaaagccaaggtaaagttctctggcatacctggaattcagacatgattacatggatatatgtctcactttccttgattattaagttgtaactctagagtatttgaccagcaggaaaggataagctttttctgatgagtatttaaaaagaagggtagaatcattttacttttaaatcctgcttttaagaggaaaccaaatagggtctcccttcccactggttgagcaactaccagccaatcactctgagccaaatgcaatgactacaaaagaccttggttccctgaaatgcttgaaggttaagggattacaatatgactaactggacctttataatcgtagccaagctgaagaatacaggcctcagagctcaccaagtagtagtgttattcttttgttgtaaagggacttaaacagagggacctaaagagttaaaacagtatcagccaaagtctgctcctctccgagacaaggacaagagctggatgcatgaattttataaataagagcatatcttcgactcctgtgtcaaatttaactgccacaagtatgaaatttctgcaagaaaagtgactgctactctttgctgttttcatttctaaagccactttcttccctgaccagctagaagccacttagatagttttcgcctggcacggtgactcactcctgtaatcctagcactttgggaggcagaggccagcagatcacttgagctcaggagttcgagaccaacctgggcaacatggcaaaacctcgtctctacaaaaaaaaaaaaaaagaagctaggcatggtggtacatacctgtggtcccagctactcaggaggctgagacaggagggttgcttgagcccaggaggtggaggctgcagtgagctgagattatgccactgcactccagcctggacaacagaataagaccctgtctcaaaaaaaaaaaaggttctgattatcttactttctttggtaaccagatacagtctcaggagcataagataacaataccatttttgttttgtttcattttgttttcttaacaagccatatacttatacaacaaaggaacaaaaaataaagtgtgaccataaaattaaaacataaatccacaataaagaatacaccaaaaaaacaaaactttaaagttttaaactctgacttttgttatgaaatttttcatctttttttttttttttttgagatggagtttcgctctgttgcccaggcttgagtgtgcagtggtgtgatcttggctcactgcaacctccgcctcccagattcaagtgattctcctgtctcagcctcctgagtagctggtattataggcgtgcatcactacacctagctaatttttgtatttttagtagagacagggtttcaccatgttgaccaggctggtctcaaactcctgacctcaagtgatctgcctgcttagtcctcccaaagtgctgggattataggcataagccaccacgcccagcctcatgtttcaactttaatcattcattgaccactctatcatctgcatgagctttaaaaaatgaactgttggagaacacctaactcactcaacaaatacacacatgcctgaaggagaagaattggcctcgatgggcaacgtagaaattctcctaggattagagttcagctctaaaggaggaaactgaagaaacgcattgacttttgtgtgtgtgtgtgtgtgtgtgtgtgtgtgtgtgtgagagagagacagggtctcactgtgtcacccaggctggagttcagtggtgtgatctcagctcactgcaacctctgcctcccaggttcaagcaattctcgtgcctcagcctcccgaggagctgggattacaggcacacgtccccacacctggctaatttttgtatttttaacggagatggggtttcaccatgttggttaggctggtctcgaattcctgacctcaagtgatccacccaccttggcctcccaaactgctgggattacaggcgtgtgcatggatttttgtctcaaatccaaagtgatgcaccgaagaacaccctgcacttcttagtgtttgttctctccttcatgggtgctggtactgaatttccagctctttcacggggcacttctcaccatctcagactccagagcaaaggcagatgtcccccaaatgaggttaacagactccagttacattcttttttaaaaccatcctgcagctaattccttaacacatgttaaaccaggtgggaataagagaccaacatcttcctctagactcagcaataatgggtcccctccacccccagctgaagttctgctttgcaaggataccccaagttgtactgttcatcactcttagcagacaacttagacatagataaaaatgaacggaatccatgttcttctctatttggctggcagacaacagaactaggccatccttacaatgttgttccagaaagtttgttttaggcatggggttcctgctgtcagttggctttctatgaggaaaactgggatggataaagatggtgctgaagtccatgtatggttgctgttggggccgcgggtagacagaaagggccaggcaggatggagagggagcttataaattagatcttacattaaatggctaagtaaaagagataattaggcaactcctctctattctcccctctaccccacttttccctactgcccccacctctaaataaatgtatagaaccatttgaaaaatattaacaactttgagtggtttttaaaatacctttggctactaatattattgccattaacattatgcatttgcttattgatactttcattttaaagaagtcaaagttttaaaaaggctaattttagatccaaaacaaccatattaacacatctggtataaacaatactgagaattcataacaagaaattattttaagttaacaaaagcttccccaacgctattttctactatagaaaatatgcaatagtttaatgtactaaaggccatggcagcagctgccagaatttaataccccttgggcttttataaatccaatttcccttcctcttattctcctttgctcttttctttttatctttcttttccttcttctctggagagaggtgaaaaaacagaaatgaggtggggttagggcaagtgacctgtgaatcaaaccaggtcacattcccacaagtcagagaaccttctttttcttgaacagtccttggagtaaaagaaaaagtgaaaacctcaaaatcgttaagtcttagttccattctcttgcctaatgtgagatcaaagttaatctaaacaaaatagcagcacttgtcagttaaagattttgaggggagaaaaaaccatttatttctttccatatcatacccattttccaggcccttttacactgcaagaattcatggggtgttaatgcacatctaagtccaccacagtactactcatctctctggcatttaataccctatcccctcagtgaacatttagagagcttgggcaaatagatcattgtttcccaaaatgtgcactgagaccgagggctctctgggatggtaatagattctgaagaaaataagcatctcataaattcacttgggaactgctgtgtctaaaaaaaacaaaaccatatttgtttacagcagaacttcttggagactgggagatgcactgggaatttctaagagggggatatagtaagtagtatttcccaagacttagctgacaactaactcctttggggtgagatgtcactaacctttgttctataaaacacaagctggagaaaaaattgaccacatatctacaattcaaccatgcgtatttgtgaaatattttctctgaattacgttaaatggcaaatcaaaatatggaaagtatcattaagaatctgactgactgggaaagaaagactgggagaaaatttctgccctttctttggctagctaagcttctgatgtgttctttctcagctgtattcatttgatcaataataataaccaccacaaaaaccacttagttccgtacctttgttttgcacatgagaaaactgaggcccaaaaaagttatctgctttgcctgaggtcattcagtgagaaagtggcagaatatggaacagaaaattcaatgttccacaatccaacattccctgaaattatgtttacccaatatgtactctggatgtaattatatatgtcaagataatgtataagagctaaataagtatctatttaactcagattacaccattcttctgattaagttatagtaaagcctattaatttctactctgcaaaattggcatttgtgataattcagctaggtctaggtaaacgtgtctcttgtattatttatgaagaaggaatatgtctaatataaacacaagtagcacaggaaacacttaattcatatacgacagacaaaaaaaatgatttggaaacatcttaacagtaacccaccaagaactgagtttttaatctacttttcatctatttattaaaacatttttgtaatgttttgttgtggtacttaaatcttgaaaaataaattggcactagaaatagtaacagcagccttgggttaacatgtgcattctctaccatctctccccatcaacccctagaagtcaatgttttgttccaagtggaattaagttttaaaagttaatatattaaaggaaactacaaaaggaagcagatgacagaacaataggctgaaaacaataatgcctctctgatggaggagtatacctttgtctttattgacagaaagtcaactttgtaagctaaagctgggtgtgtaaacggccttctcccctgcactggatctctgtaccattccaattttagtatatgtgctgccaaagtgagcactgcactggatctcttcttgagttaccacccactctgtgggggacatctcctctgctcctactctgggagaacttcccattcatttctgggagagatccctcccctctctccagaggatccccactctatctgcggaagatctcctccaccctgtgggggatcctcatcactctcaggggcattccctctcacccatgggggataggagcaatctcttctactctcacaatttttctaccatccatatgttaatgactcctaaatcctttgctgtagttggctaccttaaatacttctgtaggggaggagcaaagaaaataaaggagaggaagaaaggtggtatctctagggctgacctcacaccagagcactatttatgccctaccagcatatctaattaaccttcttctcatctttgtccataaaccttattctccacttctattctcaatctgttgttagcaccagccatccaccagatagccaaacaaggacttgggggttcattctatatttctcaattgccctgagaacctacatccgatcactctccaaagtctgcttcttttaccaacaagattttaataattcttctgttttgcctggagaaatcaataagtctcctacctggtctgcatggctctggctttgttccaccctcaaaaccatgctcaaatcaagaaatccccagaagtccctgtaaaacatcatactggctccatcacattcttgcctaacacccttcagtagtaccatgtcacatacaggacaaagcccaaactccctagcacaggttcccatctagtgtctgcccacagcccagcctcactgtcatgacgcacactctgtgtgatccaggaactacttgcagctccctgcaatgtctgtgcagcttctgacctgtgtgtttttgctccagctgttccttcatcctcaccctcattccgcaggactcagctcaggcctcagctcctccaggaagcatttcctgtcatctgggatagtctagctattcattctcagcactcctatgataccctgcagcagctgctgctctttaacattgctccccaactctttcttcatgatgtgtctcatccttgggggcagaggcagtttcttactcatctgcgtatacccagttcctattacataatgtatgccaaataaatgtctactgaatgaataaaacgagaaaccagtaatgacaagcacagacccactaaggccaccttctttctgagttcctcctcagtcccaagaacccctgccaaattctaggtaatgaccccgggtaattacatcaatttgccatacactaaaaattactctaatttaaacttcactaatttggctggcctttccaagtcagttttaattaatgatgttctctctgttgagatatttcacatagagtattttctggactgaattattctgtgtgcctcagttctctgccactttccatgggaagagctttgtatagtaaatgacaaagtttataatatttttaaaagttcctgttgaagatatttctcagcagaatagtatagccacctgttttcactcaatcataactcctttcctcagccaagcttttttaagcttggtcccagtcctgtttttgtttttttttttctttaggaagaatttgagaaaaaaattaaattgccattctggagtaagagaagattgaaaattattaaaacatacttcacattgaaggtgtaactgcttttggctcagaataaccaacatatttcaaaaatgtattcaaactacatttaatttagtatctagcttagtctccctcacgaaatcactgtctaactggcttaaagcaaaataaaatatttttaagcgaaaaagaactaaagctatcacttctgagtaaatgcaatcagcacaatattttagcaaaacatcacgatttataatacataatgataataaacatttctgccattgaggtccttagcactgcagagaaaagaaaggagcttgcccctgggcttgtaatctaaattaaacaagcaatataagtcgcacaagtttcacaggtgagagttaattaacattttatcccaagcagtgaaggaaaggggaaagaaaattaaaatcaatattaacagcatcagaatttacttcaaccttataggagtcatctgaaacgtgaatataatttgagaagcttgtaacactaccaagcctgcctgatagccccttactcctcctcctacttggctatcacctaaacagcatatttatggggttgattcttgtgcagcttcacacagccaatgggcagaactgcctaaagatacaggatggataagacgaactccaaggacctgttcctgttttatgacacaaaaattttctcctagctttttgtcttcctcactccttatgacaaagcatgcaatgacagaaaatacactgaacctgtattcatttcacactgtttgttcatgagaatatactctcaaatcctcattaccaaagactatttgaaattgatttataaacaatgtgagcacctagaatgtgtttccattctcatacaattcacttcattttctaccaagtcattgaaaaatatgtaccaagtaatggtgagcgcccaatcagccacctactatttttaaaaaatttagaagtgaactagcttcccactgctaaacactgaaaaaccaataccaaaaacagtaccctaaagaaaaagacaatgcacaattacgtcaaagaatagtaagatatgttgcctcttaaatcttgctccaaggttttcttaaatgagaatccacacaagaattagttggtagatttaaaaagttcagagggcagagcatgggttcaacaatgctgcctattgatgtttttggtttactggcccccaacactcactgcattttctctggcctttcattcagccccagtaatgcaagacaaagcaagttctccacttgcccattagactgctctgaatatggcaatgtcagtgcccatgttgcagacagtgacagttcacatcactgacacaaattacatctaattgcacggaggcacacatgctgagtaaaagacggcccacacctaactggctgggtcagttgcaagacagatctcgctattatctagtcccttcctggaaacctccctccatacctggtgaaggattaaactcccttcatacatgaagaatataccttcatacctggataaccagacccatctcccacaacaccgtgagcattatgaggctggaatacaaaaatataaggatttcataaattctaaataattttataccatacacataaggaaacagtaataacaagaacaacccctgccccaccacctcccaaatacaacaaatggtaggtaaaataccttctgtgcaacagaagagcgaagaccagatagcaattcccatatggaaggcacagtaactgtgctattgaaaaacaccatcagttcagttattttccacacaaagaactgaaagataataacctctatgcacaaatgaatcttgggctttacaaacatgtcagaagcatcaaaaggcattagagtaagccacatcgtatgaggcgatttatcctcaactttgtctgaatgctccatagaaaaagacctagtttttcaatacaccaaaagcactgccctttaaaaagccttctcatcttgccttgtaccagacacttgttttccaaatataccctgttcagattgctgatcttcaggttcaatccttcactaaaagactttctgcatcattgacataaaaaaaagcttgagttattaaaggttgaattgtgtccccctaaaaggaatattaaagtcctaacatccagtacctgtgaatctgactttatttgggaatagggtctttcaagatctaatcaagttaagataaggtccttagggtcagccctaatctaatatgactggtaaacctataagagagaacagagctcaggagttcaaggttacagtgagctatgactgtgccactgcaatacagcctgggtgccagagtgagaccctgctcctgccccccaaccaaaaaaagaaaagaaaagaaagaagaagagatacaggcagaacaccttgtgacagtggaagcaaagattgaagtgctgctgtgtaagccaaggaaagcctcaaggacttcggacaaaacaccagaaacaagaaaagattctcccctacagatgtcaaaggagcatggccctctcaacaccttgattttagacttctagcctctggaactaagagacaattttgttgttggttgttgttgttgttgttgttgttgttgttgttgttgttgttgttttaatccacctagtttccacttaatggcaaccctagagaactagtacaagggttgtgtgttccattcttttacctgcaagcagggctgcaggtaaaaattaatcctgataggcagactgtgttagatgctatagaaccttctgtaatctatcctaatggagaagacctcccaaattagaaattcttatctgtaaccaaaacagaaacaaaaaagtgttactccaattcactacttttccacctgaaagtatctttgaaaactgctgaggtcatcctgccttcctttcctaaggaaatcctcctggaggaggcaacaaggcaaatccaaaaggaccagcaagcaacttttcactctcgtcatgtgtttttcagaatacccagatctcaaaaacttcatgcttcaacatccgtgggtatgagcacataggcaatgacaactctctatcatttaatgaaatcacagcatgcaccactagcaactgggaaaacagagcattcctattgaaggcgctataataaaatgtgctctaaaggagtttctggtttgctcggtttggaacaaagacatatgagatacagtcacaaaaatagaggacagctctggaagacagaatcagagaacttgttgttagctagttatgtttttagagatcccataccataattttacagatgagaaaaatcatgctcaagatacatctttgaggcaccattgagggctctggcttaggcaggctttctaccagactgtgatcccaatgcttcccacctccaaaggcaggatgataatatttattatgtgcttcagatatcccaactaaaacttgttttgtttgaaagaaaaaccagttttgtaagaaagaaaaaagaatgtctatcattttaaagtggaaaatgaggaacatattaccatgttataaaatccccaaatactcaatgtttaaatgtatcagaaagcatgacatttaggacaacatgctagtaactgggcctttaaagaccacaattacaacctggcttttctaaacagacataaaaaattcctttctgctgtatttaacaaaacaatcatataataaaacatattacagtatttaccaaactgagacaaacaataaaatttattaccacccattttaattaatacgactacttgtggaatcaaggagggtaaaaggaaaaagggaaatgtgggccaggcatggtggctcatgcctgtaatcccagcactttgggaggccgaggcgggtggattgcctgagctcaggagttcaagaccagcctgggtaacacagtgaaaccccgtctctactaaaaatacaaaaaattagctgggcctggcagcgtgcgcctgtagtcccagctacttgggaggctgaggcaggagaactgcttgaatccaggaggtggagattgcagtgagctgagatcacaccactgcactccagcctgggtgacagagcaagactcagtctccaaaaaaaaaaggcaaatgtggagcaaaaataaaatgtgagagataaaagaccagggataaaaataattcaaaatctctacagtggtaggacagttgaaacacatatatataatcacaccagaagatcactcaaggttaaagcttaaaatatctatccttccatttaggggtgaccatagcacagacaatgacaggaagaatccttgcttctggaaacttcccgtaaaagtgcaacattacagaaggtaaagtgagcaacagacaatgatgatcaaaacccattttcaggactaactccttccatttcccttctttcattgatttttttttaaacccactttgcactcagtcagcttggttgcagggaacatcgtttaatgtaccttattgattcaatcatacacatttatacttgtgtagaaacttctgctacagtgcatttattgatcttttaattattaatgtaagccacaaaacctgaagagctttattgtaaatattttttattctctcaaattatgacaagaaaattatcaaaaattgtcaacaaatgaaacatggtagtttgcttatttcctctgaaaaggctaatcaaccggttatgtatcaaatgtactgtcaatgagaatttttttctaaagtcagaattatataagcctgaacagttctctgatgaaaactttaatttctagaattattattactgtgatgcctttaatttggctctggagatggcaagcaagtgttccattccagtgtggccattttcaaattgcacagagccatcaggtgagcaagctgtctgtcaaaatggtcataagataggatcctgtgctaacggttgtggacaaactgtgaagtggcatgcattgtctggtgaattactttatcccgcttgtctccgcagtatggccctctagacctagagtaagatacattctcacccagatactctgtactatattcaaaatgagaattaaggggactgtctaggtgggaagctctgcagaaccagccaccaggctgtagcaaaaggcaggttctgcaggctttagaagaagtggaaggggtggggctgagttcttactgaagaaaagggaggcagaaaacacatttaggttcaaggtggaaagagatgaaactttgatggtcatcctttcccatgcaaacttctcccccatctctccctctaaatactacttcagctagccttaaatagtcaatgtaaacttggatgaaccaactgaaccggaagatactgtcttaacacaggcttaattctaccctgccatagatgatttccagtggaagccagcttcatgcttacatttcttttagaatactgaccagcaaatatgtttgccattgcaccttatactttccaataccaaggcaatgatgtgtgtaataaaatcaagtataacctctaaaaaacaccccagaatttgaaataataatttaaatttgtgttgctaccttctagagtctgttaggtttttccatttctagacaataacaagaagacctgccacttccggactgaatggtcctgaatatgaatagaggtgtcacatatctaacatggagcactaacagtaaataccagaaagcctgggcacttgactagtgacagaagcagatatcctcaagcaaatgttgctctggatctctgaagaatctctgcattgctcagcagtggcaacaaatgcttgaatagtctgtcaggttcaactctcttccaagcttcactgttccggaggccacagaatgctgcttctgtttggttcagaccttcagtgaactataccaaatagatgggaacccttcctcagaactgatctcactagccaaggacaccgcccatttacatgagttatatacattacccaaatgcatattcaacatatttataaaccatgagtgaaaagctgaataatatattcacaactaggaaggagactaggattggccttctaaaagggaccacgtggttaaagatctggtatccacaaatacacatgtcatcaaacaagtcataatttgtgaccatcatgcatttaccttgacttttattatttaaaatacacatacagctaatttgccaattacatagaacacacaatgggcccttacacagcaaacatacctactaatgtggtgtctaattcttactttgttctatatcccccacagcagatcaaaaaatcagccttactgaaataatttctgataggaaaatttgagctatgattttaaaccatttttgtgtccttctgaagaattcctactttaatttagacccaaatcaccataatcagttttcttgaaaaatgatacgtaagtaaaatgtgtatgaaaatgttattaattaaatggtattttccaaatatcttaaagtattagaaatgccaaattctttagagtatgaataccttcacaaaagcccttttacccaagcttaaagagtacatagtacatgataccacctagaggaaaataattttataaattaggccatagtattttaaacatgtctttaaacagtttttcaacataacaatatgtagttatagagccaagcatataatcaaacaatgcagtaatttaaagttctctgacgttaaatgaataaagaaaataacatattatattgaaaacatctagtctatggctaacattctctcaggccatgtatagaattacaaaggaactagttcttaaattacccattttaaaaattagtcaatattaacagtctctatttagataatccaccactcacccacatttaaatagaaacaatgttttcatttactacttttcaaagagaggtgtcttccaaacaataattctttagttgcatatcattagaaaggttttgaaaaaatatataaagcaagtaaatgtcccacaagcataccaagatggcaactgattcttcctgggtaatgtttgctcagttatttacagtgatatttgattatagtaatatatatagatttttttgttcccaaactctgaaaccattttgcctattcatgctagttttgccaatcagtaactcaattattaaggaggtccagcactcatcccaattaaaactgcaaagcaagaggtattgccttttacctggcccatttctgctttcatagtccttccagtccatttcctctctgaactttttttctcaattagcacccaggtcccttaccctccatactcatggcttagcggggttgccctttatggacagtgcccatccttccaaaaatggacaaatctgcaaggccacactaaaataaaaaaactatcctatctcccatttcctctatctccaactgtttcctaggttccaactagctaatcagattaattgacaccatttgttcactaacaatcttacactaagtcatttcttcaacaaatatctactatgtaccggcatttttctaagtactggggacatactggtgaacaataccaggccaaaattctttccttcatcgaaggttaacacaatgttatcaattaatgataaatatattggtgggtgtggtggctcacacctgtaatcccagcaatttgggaggccaagtcgggcagattgcttgagtccaggagttcaagaccagccttggcaatatggcaaaaccccatctctactaaaaacgcaaagaactagccgggcatggtggcatgcgcctgtagtcccagctacttgggaggctgaggtgggaaaatcgcctgagctcaggaggtggaggctgcagtgagctgagatagcaccactgcactccagcctgggcaaccagagtgagagcctgtctcaaataataataattattattattatataataaatgtatttatttaaatatatataaacgtgtgtgggagttagatgattctaagaccaagagagaaaaataacataagaaaagagctgttgtgatgaggttgtattttattaataaataagatggttaaataaagtgatggataaagtctaaagaaggtgagggaggaagctgtgtgatatacggttaacccttaacagcatgggtctgaactgcacgggtccacttaaactcaaattttcttctgcctctgccacccgaaacagcaagacccaccccttctcttcctcaacctctcctcagcctactcaacttgaacacaacaaggatgaagaccttataatgatgcacttccacttaatgaatagtaaaaatatattttctcttccttatgattttcttagtaacgttttcttttctcaagtttactttgttgtaaattttgggggagtcaaaagttatgtgcagcttttcaactgtgcaagtggtcggtgcccctaactcccacattgttggaaggtcaactgaatatggggaatgtgttcccagcagagggaacaacagattcataagtcgtgagttagaagagcgacatttctgaggcacagaaatgaggccatgtgcctgcagtggggtaaatgagacaaaaggtagtaggtgttcaaggtagggaaacaccaggaaccactggaaggactttgcatttactctgaaagagaagggaaaccattggagggtttttagcaaagaagtgacctcaaccaatttaccttttttttttaacacctttactgagatataattggcatatgatatccattttagatgtgcagttgaaggagttttagtatattcacagagttgtacaatcatgatcacagacaactttaaaacattttttatttttttttaactttttaagttcaggggtacaagtgcaggtttgtcacataggtaaacatgtctcgtggggttttttgtacagattatgtcattacccaggtattaagcctagtaccaattacttattttttcctgatcctctccctcctctaccctccatccttgttactccaaaaagaaaccccatatccatcagcagtcacttcaacctccaccccaaactcttggtcccaggcatttcttataaatggagtcatacaatatgtggtcttttatgtctggattcttacacttcacatgtttttaaggttcatccttgttgtagcacgtgccagtacttcatttctttttatcgatgaataatattccattgtctagctatatcacattttgtttattcaacagttgaaggacattggcgttgttccctctttttagctattatgaatagtgctgctataaacatttgtgtactagttttgtgcagacacattttcagttctctcgggtaaatatctaggagaagaattgctaggtcatatggtaactctgtgttgaaccttttgaaaaagtgccaaactgttctccaaaatggctgaaactttttttttttttttttttgagacagagtcttgctttgtgatccaggctggagtgcaatggcgtgatctcagctcactgcaacctccgcctcccaggttcaagagattcttctgcctcagcctcccaagtagctgggatcacaggcacatgccaccacgcctggctaaattttgtattttcagtagagacggggtttcaccatgttggccaggctggtctagaactcctgaccttgtgatctgcccacctcggcctcccaaagtgctgggattacaggtgtgagtcactgcgcccgcctgaacctttttatattctaccagcagtgtatgagggcttcaaattctccatagcctcaacaacacctgttattattggtctttttgaatatagccatctaagctggtgtggtatctcatagtggttttgatttacatttcagagactgagtaccttttcatgtgctttttgatctcttcagatctttgcccattttcgaattgtgttatgtaccttttttattaagttgcatgagttctttacatatccaatatacaagtcccttatcagatacatgatttgcaactttttctcccatttcgtagattgctttttcacttttttatggtgtgctttaaaacacagaattataaaatgttgacgaagtccaatttatctgttttttgttgctgttgctcgtgcttttagtgtcatatttaagaaactgttgcctaatccaagatcatgaagatttacatctgttttcttctaatagttttatagctttaggtcttattttaggcctttaaaatatttttgaattaatttttgcatatggtataagagaaagagtctaagttcattcttttgcatgtagagattcagttgtcctggcaccatttgttgaaaagattattctttctcacattgaattaccttgcactcttataaaactaaattacattttaacagaatttctatagtcatattaagaatagacaaaatgggcaagggtagaagcagagaagccagttagaaagctattatcataaatcatgtatattagggcttgccagagaaaaggaaccaatagatatatagagacatatagaaagaaattatgaagtattggcacacatattattgaggctgagaagtcccatgatcgacatgctggtcaggaaaaccagtgacatagtaacaatccaaatctgaagggctgaggagccagtagtgttagtcctggtccaagtccaaaggcctaggaactagaagcatcaatgtccagtcaaagacaggagaaaatggatactcaagcaaagagagacagagagagacagagacagagagagacagtgtgtgtgtgtgagtgtgagagtgtgttagttcacccttcctccatcttatttgtctatttgggcccttgacagattagatgatgcccactcacattggtgagagccatcttctttactcagtctaccaattcaaatgttaatctctttcagaaacactctcacaaacatacccagaaacaatgttttaccagttatctgggcattctttggccttgtcaagttgacacataaaattaaccacacaccaaataagagataatggtggctcaaccaagagagtagcactggaagtggagagaagtggttgaattctggatgttttggaagttgagctgataggatctgctaagagactggatgtaggtgtgagataaagaaaggactcagttgactctaatatttttgatttttcagttagacaaactgcaattttggggaatagggacatgatcgctcaaactaccgtgtgtaaaatagactgggaacagggaattgggggataggatgaaagccttctatcctagaaacaatttctgtttcattgaaaatctactgagtccatagggcacatagatggcactagttaatgttcctttacagtgaaagaggctgtttattcactgaaaagagaatgccttgagggctttattagggtcttgaactgaactctttctgtctgtttgtataagaggttctcagaacaagttcagggttgcccagaagttgtttttagagaagccctgaagcctcatactttcacagaaggagaccttgataatctctcatcaggaatttatttgaaatgtcattagaacttcttagagacatcatgactaacctaaaaaaaataattaactgtgagaactacaaattttaccacaagacagtggagaaaacattacaggatagatagaaattcaggaacccctcaaatcacactcctccagaacattttcactggaagacaaaggagcctcatttcctattaactcagaaactctttcaagcatctgttgtggtagattttctaataggtccagcccagggggttctcaggtataaatcctcaagttctagtaaagcctcttgagaagatggtcaaggcacaacttgaatagctcataccactgaactggaaaaatgctcctaaagctctagtgtcctttgaagagacttgatcttcctcccctggccttaagagaggcaggtaaagcaggataagtactgcaacacacagggaagaaatgaaatcacgaagatctctctttctgcgtaaaaatggatgaatttcttcggatttagcagctgtcttagtctgttttgtaatgctataacagaatacttaagattgtgtaatttatgaactacagagatttatttcttacagttctggaggctaggaagtctaagattgaggggccaacatctggtcagggacttcttgctacatcaaaacatggtagagagagagccagagagaggggagcaaacttgcttttataacaaacccagtctcacaatagcaaactcactctcatgacaatgacattaatccatccatgagggcaaagccctcatgatctaatcacctcttaaagatcccatctctcaaaactgttgcgttggtgatggggcttccaacacatgatctttgggaggacacatttaaaaccacagcagcagcttttcactctctctatcctagaaacaacttccatttcagtgaaaatctactgcctccacagagaacaggaatggcattagttaatgttcctttacagtgaaagtatgaggctttctcatacttttcagggcttctctgaaaacaagttctgggcaacccactttaggttctgagaacctgttacaaaaacagacagaaagagttcagttcaagaccctaataaacccctcaggtcattcttttttcagtgtaccaacagctaatgaggaagctgtgcctcttaacgaggaaaggaggctaggataccatgccaaggatctccaagacacacaaaggaagatgtaaatctttcctcaggcctggtgacaagacaaagaccaaatggaatcctaaaatgggctctttggcagtcacgtctagaggaatggaagacgtgatgaactactctaggaactggtattaaaacaagcaacccaaatgtaaataaaagactacttgcttcaattaagtcttagctacaggagtgtgaactttaatatttcctcagtgtacatctccgctagtgctttcaccattattaaagtatgtttatacagggtttggctttccagctattatggaaaaattacatcttgccaacagtactataggggtctaaacacagcaaatcctccactgaccttgaacccaagctaaagcaaatagtcactctccttggtgctgaactgcctaaataatgcactgcataaatggctgtgaatctaaattacatctacaatgcatcttagcattacggattactaacaatttttccagaaggcagtgtttgtagaggcattgcaatgtgaaggaaattcttagggagaaaactggaaaacattcacttgcaaatgatgatcatttatttattgaacactaggagtatgctgggccttgagctccacagaggaggtagcagggtgatgacagtctctggccagaaggcttcacaagagtggaggaagaagatgatggttaacagacaatatgctagaggaaaagtaactgcaatagaaagtttgaagtggtgaagcatcatgagacggaacagaaaacaaaagagggagaagacaacaaaaatgccaactgaaatatctacttaatataaaattacacttccatttgaaccaaaataaaatttatccacatgtaaaagtgctcagaaaataacattaaatgaaaaaagcaaaatataaaatgattaaaacataaaatcatacatatatacaaaggccaaaaactggaagggaatacagagaaatcaaaaccacttaaggaaaacgttagaattgtggacatatcagttttcttttgaaacttcctttaatcatattgtaagaacacatacactatatttttaaaaggcaattagagtatatgtgaatattcactacagctctgtttgtgatggtaaaagaaatagaaacaactaaaatatccatctatagataacatattaaatgaattctggcatatacataaaatgagctgctataccactgatatggtttggctgtgtccctaccccaatcttatcttgaattgtggttcccataatccccagatgtcgtgggagggacccagtagggggtgatttaatcatgggggcagtcaccctcatgccattcttgtgatagtgagttctcatgagatcctatggttttataaggggcttttcccccttttggtcagcacttctccttgctgctgccatgtgaagaaggacatgtttgcttccccttccgccatgattgtaagtttcctgaggcctcccaagtcacactgaactgtgagtctttcctttataaattattcagccttgggtatgtctttattagcagcatgagaatggactaatataaccactttaaaaattgaggtatatctatttgaattgacttgaagatatgtctatgatacatggctaagcaaaatttttaaaaggcaagtgagaaaaatacatatggtataatcatatttatatgaatataaacaactatattaatatatgtcagtgtgtacaccagaaagaaaaagtttaaagcaatatacactaaatagaaaagaaattatggaatgggagatttatattttttatattaatgtatttctgtaggtttgagttttgtaaccttggattacatatgtcattagaaaaaaactttaaagaataaaaactgaattaaaattttaaaaaataactgtcatgttaggaaaaattctttggacatttattttatggtaacgagggttaaaatttaagaggagctttgaagggcagatggaggttagggcaggagacaggcagtgtaattaaggaaattaaaataagtggtcgataagctggactcttacttggccagtagtaaaccaatcaacactaagttgaggggtaacaggaatgagaaaatcacctgaacataaacataagagaaggtatttcatagagtacaacagatcactgttcatccatatagttctaagaaaaagtaacagggaatttttgaaagagagaagaaagtaagtagaaaaaaaaaagtgaggttgaaaactagtgggtaacggtgaataaaacagcacaaagaaaaactggaggaaagtacacagaatttatgaggggactcataacatatggccgatttaccaaaagctagtcaagctcaaagtcatctgactccaaatccattaacctgaaatccactttcttgttttgaaatgcaatctgaacttcaaacggcagtttgtctcctcttaaccagttcagcaaacttcacttgaaaatcaccattgttcatgctagtctgcatcaccatgcctcagatacttgcaggaatcggggcagccaaaagtgtttcagctattgggacctcccctccagtttagcaagctgggaatggtgacaagtataagtggcatgcctcagtataaaaagtaaaatgattggctctaccatttacagtcacatcacaacccgtaccacttcagattcctagtctgaaaaacgggtataatctccaagaattgtgagattcaagtaacaaacaactgagagctccatgcctgggacatagtagactctcaataaatatttctgaatgaacaaatgaaccaatgtgttatgatactatatggtattattattgtgcacaaaaagaaggtatggaaaagggtagtattctagtgaattctatcactgtagtaaggtcaagtaacttccttttatcatcaaagtcttgcatgtattgcttccactgccataactgcccttcataaacaagtttcccaggcatctgtaatcccacctccaactttgcaagtttatgtctggacctgttgccttctctctttagaactatacattctgcgatggtgagggttgtgtcttcacacttcatggacaggcttataaccaacaaaccatgcagaggagaaaacatgtctaagccttcctcaggcccaggcagaatcctctggtgccaacacctatgtggtggcaatgaaggcgattccagattctttggtaatgttgaggcaaaaacattttgaggacctagatgtgaacaggccctcaaattggatacctttttatttgaaggatataagattcagcaataccctctggactacagtttgttaattcaggtcctcagatcccaaagggatccatggatagaattcatggaagttcttgaattcagatggaaaaaaatcagatcttttgtcaccagtatctaactgaaatttagcgtttgcttcaagtaggaatttagacaacaaatcatggtagcattagtagtacttacatatgtgtcaccaacagaaatcacagatattttcatatctcactgcaattcttgttatctcaaaatattatctgtttatcaccactttaaaattagtggtcattatgtgctctgctaaatccaatacaatgtgttaatgaagaagcatgtatattaccataacacgagtttgttttaataacttgataactatttcaatataatcggctccttgtcattctatgtgttttatttcattcatttacatattttactctgagaaacagtccatggacttcaacagactaccaaagatgtccctagcactaaaaaggctaagaagccctgctccaaactataatgcccaacaattaaaagtattatgcaagtacaaatcccattacttgaagcacttttaactataaagatgaaaacattacttgagaatctgcaatcattctgatatgtaggaattatttacattgactaaaaagttctaaactaatggcctgatttacgtaatagagcagcctatgtatgaaacagtctgatttgagttgttattacattttagcacagagttaaaaacataagtatttctatcaaggacttggctttgaagtttgtcttgaatttactacctgaccttgggcaagtcggtaaacccagctaagccttagttttctcatctacaaaatgttgaaaatacctcctccttcaaagcattattaagagaattaaataatacatgcaaaatactaaataatggatacaaagtacttagcacagtaccagacataataagtactaaataacttacagcaatgttattgtcctattttacttattaatctaagtaaaactttatattgagtctttaagatgatttctttaaagtattctataattaaaagataagagagcatgttgcttcagaatacagactctaatgacagactgcctgggtttaaatttttttgtaccacttacaagctgtgtgcctctggataagttacttaatttctctgaggtttagttttagatctgtaaaatagggaaaatagtatctatgccatagggttgttatgaaggtcaaattagtaaccacaggtgaagcacattaaaacatgcctagaacatgatactttgtaattactagctattattaccaacagtaattatgtaatagtttcacgtcaagttacacaggagtctttcttcctctttaatctgaattttagtgaaaatttcttataaatggagtcagccacattaatcatactatttgcatgaatgtatttgacatcaataagaacaaggcagggaataaattcagctacaattatttacaaggaggaattaggaagaccccatttcctttggctttgtaaccaagttaaagcccatacaagaaagattctctgtagtttgaaatgcttattttatggcaacagatctatgaattacaggaataaacataattttgcttttttacctttgaacaggtacagagaggcacctctgtgcccaaggctggagctcaccttggagaagagagccatggaaatgctgggcttggtgacaacagcaaggacaacatcagcatcaagtagcaaagatgcacctgtttcccagcagggaaccagctttgctcctcacgggcaattagcaaggtttgacttaatttaaagcctacacaaccactgatctctgagaatatgactgatgttattttctgtactgagagtaacagtaaaacaacaataatgacaataacaagcacttcactcctctccatcttttaaggtagttgagtaattagtaactcaacaattagtcatcacagcaaaactatgaagcatgtaaaagtattctcaccatcatcttatttcagttttttacttatgagctttaagaattcaggatcctttgttgaatttattagtcctcccaacatataagacaatgaatattagagtcaaattatgatacataccccaataattcgactatactctaaaattaatacacatcaccatctccaggactaccaaaaatgcaaatgctggctggatctcatttttttaaattataacaattaaaaggttattaaatcaccagtgttaaaaagtcagcagcaataaacctttaggttttcacaagatgcacacagaggtctcccttggagatttagttttccaactcataaggctgaaggtccactcccaggaggaagaaaaaacaggaagcttctccccagagtaggaaaataaaatttggcatactctgggttttagtgaccaaagattatcaggaagtggaaacatctacagtagaatcagtgcagatgtgatcattagaaggctccatgctttgtgccagtattattatttccagcatcccttaatagtgtcaaaagcataacattccagctgagggattaatagctgccctaacaacagagcacacagcaggctttcaacacagcagggggcttttcaaaacaccctagggtagataggcctggtctttagtgcttgtaccatggctcaactacactgagataccttccaagtctccaagtatgaagcttggttctcaactccactctgatgtgattctgcagtgtagcacctttacaattcagattaaggcaagatctctgatctggaaccttttgtcaaacgagtcttggaacaagactgacagatgtcccctctacatcaacaggtagggtaaggcaaagacaggagagaaacccagaaatgtatatacatgtgtatgcagctacacagttgacacgtggtgcataatgttccatgcgatcaaatttctttcaggcccattcaaaacaaaatagttgcatgggaagtaataacagagaacctttactggttggaaattctcctcttatttaactaaaatcctacatatccttaatcactgtagtttagcattcattctagtgagaataatcttcctggaacacaaacgtggcctgttactcctcagattagacaccttcagtggctcccctgggcctacaggctaaaatcctaacactttgggatgacaaacaagacctctggtttggaccttacctacctctctagcttcatttacctctctggctgccaggaccccacattcctcgtaagtccccaaattatctgtcatgctccttcttatctctcaatgcttactggcaatatctctgcacctagaatgttttgtctttgtagcatttcaacaaatgcctattcatctttcccagctcagctaaggtcagccacccttgtaaagcctttaccaactttcctttcccaggagagacccactgcttttcttggactaacagaatctcctgcatcactgctcttctggttgccacagcactttactgcactgggtttttaaaaataggtttatggaataatagtttaaacacaataaactccacactttaaagtgtacaatttcgtaagtttgaacatatatccatacctgtgaaaccatcatcacaatcaagataatgaacacattcactatttctaaaacttttccatgcccttttgtcaactctctctgtcactcctctctgtccctcatccccagggaacgactgatctgctttctagagagtcattagcattttctggagtttgaaatatagggaatcatgcaatatgtagtctttatttttgccttgcttctttcacacaacgtaattatactgagattcatacacagtgtatgaatcaacagttcgttacattttactgctgagtagtttcagcatggataggctatactataatgagtttgtctttttacctgttgatggacatgtgggttatttcaagtttttgttcattacaaagaacactgctatgaacattcacatacaagtctttgtacagacacgtgttctttcctcttggggaaaaactgaggagtggaaataaatgagtcatgtggtaggtatatgtttgattttttaagaaactgccaaactattttccaacaggctgtgccattttacattcccactaacagtgtgtgaaaattccatttcctccatatcttcatgaacatttgatatggtttgttgctttaattacaaccattctactatgtctattgttgtattatctcactggggttttaatttgcatttccctaatgattaatcatgttgagcatcttctcatgtgcttatttaccacccatatttcttatccggcagaatatctgttcaattcatttccccatttttcagtaggttgttttcttattattacattttgagagtaatttatatattttgagtattttatatatgatttgtcatatatatttgaaatattttctcccaatctgtggtttatctttgcattctcttagtactatcttttgatgagcagaaatttttgattttgatgatgtctaatttatcaatttgttcttctatgaattgcactttcagtgtcatatctaagaaatctttgtctaacccaatctcacaaagattatttcttaggttttcttccacaagatttatagttttaggtgttacatatatgtccatgtggtgttcatttttgtatatattataaaatatggtttgatgttcattttttgcttatggatatcttgttttgacactatttgttgaaaaattaatcctttctccactgaattgcccccatgccttggtctaaaatccacggtctatacacatgtggatctacttctgcctctttcttctgttccaaggatctatttttctgttgggacaccagtcccacactcttttgattactgtagcattacaagtcttgaaatcagtcaaatttagtcctccaaccttcttcttttttaaaattgttttggctattccaggttcattgcatttcttttttttttttcttttgagacagagtctcactctctcacccagaatggagtgcagtggtgctatctcggctcactgcgacctctgcctcccaggctcaagcgattctcctgcctcagccttctgagtagctgggattacaggcacgcgccactacatccagctaatttttgtatttttagtagagacagggtttcaccatgttggccaggctggtctcgaactcctgacctcaaatgatccacccacctcaacctctcaaactgctgggattacaggcatgagccaccacgcccggcctcattgcacttctatataacttttaagattcatcttttcaatttaaaaactgctggcattttgattgggtttttgttgaatctatagatcaatttgggaaaaaatgacatcataacaatattgagactttttatcaaatacaagctttaactctctaacaatttaggtcttttaaaatttctctcaacaagattgggagaaatattgtacggcttctgcacattcttgtcagatgtatccctaagtatttcgtatttttgatactattgtaaatggcatttttgtttcagttcctgactgttcattgctggtatatagtaacacaattgatttttatttatggatattgcaccccagaaccttgccagaggacactggaattaagaattaagatcaacattttgatgcctaaggggacaaaagaagttgttcacaactacccatagggaaagacacgctgtggaaacacatttgctcaggagagaggagaaatagagctatatcctcagcatttatatttctatgcctttggcctagatagtttgagcctttaagcccatcagtcaagtgatatgggaaaaattcaaatatgtagtatctatggtttttcctaaaacagtttctgaaatgtgaaacagtataatcactaaccacataagagaaactcaggggcctattaagagtaatacgtcacctttcttttggtcttgattcttttcagttggtttctgcttttttccttatccaattacgaccagatttccttaataggaatctagtcctgacatttcagagacataaactgatgtatttcttctacgtatctacgtgtgtgtgtatatatacatatgtatacacatatatatacatatatatgtatataaatacacatatatatacatatatacgtatataaatacacatatatacgtatatatgtatacgtatatgtatacataagtatacgtatatacgtatatacacatatatacatatgtatatatgtatacattacacgtatgtatgtatatatacatatgtatatgtatatatgtgtgtacatacatgtgtatacatatgtatatatacacatatatacatatatacacacacacatatatacatatatacacatatatgcgtgtatgtatgtgtgtgtgtgtgtatatatatatatattattattattatttattttttttttttactgtcacccaggctggagtgtggtggtgtgatctcggctcactgcaacccccacctcctgggttcaagcaattctcctgtcacagcttcccaagcagctgggattacaggtgtgtgccactacgcctggctagtttttgtatttttagcagagacggggtttcaccatgttgactaggttggtctcgaactcctctacttgtatcttttaattttagcagcttgtttttttttttagagacaggttcttcctctgccacccaggctagagtgcagtggcacaatcatagcccactgcagcctcaaactcctgggctcaatagatcttcttgcctcagtctcctgagtagctggggtgacaggtgcatgccaccacacccagctaattttttaattttttgtcactatgttgccgagtctagtttcaaactcctggtctcaagtgaccctcccaccatggtcttccaaagtgctgggattccattcatattttgagtgactggtcttagactcctgactctaaaatctgcatattaatgtatgcctgtataactaaatctgcttctgttcttattgatcctgcatctgtaaataaaatgctggcttaacaatgcagcatttcctgcttgctgcattgattctccacaatagaaaactcagaggtcacatgtttctccatccttcaattcaccagaattctatctgctcaggagattaaaaaaaaaaaaaagataccattgttataaactccagaacacaaaacacttctccattccacacagaaaaaaatcaatgcatgttcctcatttcctaattgaaaggatttttggttaaacatgagcttttacagcttcctccacatctccatatgaccatcactgtcagaaccatcatctttgagtatgaatgacatgctatatgaagggcagagagaaatagacaccaggagaaaaacatacagaaataacatcaaagagtgaaatctggtcaaaattccctaacctgcttcttgtctctccaggttgtgtcacagtcattcaggaggcctcgggcactgctttgttcaggggctcatgtacccgtgaagctctaacacctctcactcctgcatgctctctctctctcactcactctaaataaccacttgtgggccttacatttctttcctataaaaaatctttaatgtttttacaattataatacatgttgacggtataaaattagaaagcccaattaagcctagataagcaaactaaaatcatcattaaatctagtactcagagactaccactcctaacatctggtacatatcctcccacacttttctcctctgttaaaacattttcaacaaaaataaaattataaaatcatccacaattgttttctaagttctaaaataggtaaaatggcaagaatacatgttgattactttctggtatgatcttagcaaaaccagtaaagcattagagataattggaccttaagccaaagccataaaataattatgatgtgagacctgaactatctccagccagcccatggttcattaccaagatgagcagaattaactagcaaataaagaaataccttactaactaaaaatcagaacaccatccctcagccaggtcatatgagacagtccagtccacagacaaagctttaagcaggctataaatatatgtggttgacacattcggggtgacatagtggaaaagagttgaggctgaattgttcctggtgagaagaacaaaaacttaagtgccagaggtccaaagaaaaaggctgggcatggtggctcatgcctgtaatcccagcacttgggaggccaaggcaggtggatcacttgagcccaggagtgtgagaccagcctggacactatggcaaaaccccatctctacatgatatatagaaattagctacctgtggtggctcatgcctgcagttccagctactcctcaggaggctgaggtgggagaatcacctgagtcttgcagagggtcaaggccgcagtgaaccgggatcgtaccactgcactccggcctgggcgacagagcgagaccctgtcacaaggagagaagagggttgaggaggggtgaggaggggaggggaggggaggggaaggggaggggaagggagagagggaaaggagaggggagggaaaggagaggggaggggaggggaggcagagagagagatgtgcatgaagtggagatgcaacacaccactggccatttttatgtgcatccgtgtgtctcattggactgggagctctcagcaggtatcttattcctctcttttatctccagtgcctagtacttagtaaggatttgctcattaggggctatcccagaagcagttgagctgaaattggacaggcaggaacaagtctgcattatgcatgttacaaaaaagatgaaaattaccttctctagttataactgtcccactgtgatttaggcaaaagccatcctggatatgtcacaggtaaatgtttgtaaataagcaggatatacttgggaggctgaggtaagaggatcctttaagcccagggttccaaccctggacaacatagtgagactgtgtctcaacaacaacaaaaacaacaacaaaaaaaaaaaaaaaaaaaaaagctggataattttagggttgtaagcatcgttaatccaatttcttaacatagacatataatattgattttcaaactcccagctgaatatttttcccctaaaacatactgtttccaaggttaatgtgtgttatgaaagataaaaatgtatgggagataattatacgagagacctgatatggtggattaattgcaaaatggccctcaattctctgctcctctttgtatccattccctctgatatctgactttgcaactcctcccatcaagaggtagggtcaatttccccatcccttgaacctggattggctttgtgacttgctttgaaaacaggatacagggggagtgaaagtgtgccagttctgagactaggtctccaaaggtcttgtgagcttctcctctctcagaattctgcctaccaccaagctggccagctggatgatgagacacatgtggttgtgtggcttggccatctcatcactccagctttcagtcagccaaccaccagacatgtgagtgaggacaccctcaaccagccggctctgagccactctgtcatgttagcacagatgcatggcatttcagcaaagaattagggaaatgcaaattaaagccatagagaggtatcaatacacacctatcagagtggctaaaataaaaaatgacaacaccaaatgttggtcaggatgcagagaaacaaagccattttacactacaagtgagaatgtaaaatggtacaactgcggaaagcattttaaaagtttcttataacactaaacacgcaattacctactagtacactcttggtcatttatcccaaaaatgtatgactttttttttcatccagccaaataaaaacctatgttcaaacaaaaacctgtacaggaatgtccatcacaactttattcacagtagtcaaaaactggaaactggaaacaacacagaagtctctcaacagattggccgggtgcggtgggtcacgcctgtaatcccagcactttgggagaccaaggcaagcagattacttcaggtcaggagttccagaccagcctggccaacatggttgaaacccaatctctactaaaaatacaaaaattacccaggtgtggtggtgtgtgcctataatcccagctactcaagaggctgaggcagaagaattgcttgaagctaggaggcagaggttgcagtgagccaagatcacatcactgcactccagcctgggtgacagagtgagactcctctcaaaaaaaaacaaaaaaacaaaaaacagataaatgtttaaaaacctggattactcctcagcaataaaatggaacaaattataaatacacacaataacttagataaatctccaggtagttatgctgagaggaaaaaaaaagacaatctcgaaaggctgaacactgtgtttatataacattcttgacatgacaaaattatagaaatggtgaacagatctgttgccagttcacagacagaggagggacaagaagagaggaaggtggatgtgcatagaaggccagcatgaggatccctgttggatgaaagtgtcctgtatctatgtcagtatcctgactgtgatattgcactacagttttgtaagatatgactatttggagaaattaagtacaaggaatctctttgcattatttcttatagctgtgtaggaatctatatctcaaaataagtttaatttaaactaattacctgaatggctttgggcaggttactaatcctaagccctggtttccttatctgtaaaatgggggaaaataggacttaatgaggcttaaattagacgattaaatgatgtttacagtattcttagtgcatgattagtattcaataaatgttactgttgatatttgtagtaatagtaacaacagtcaataaacatagtcataaattcaaaattttatttgttaaagttctaccagatttggcagggatggcagcaaggcagacagcagtctgagcaaaggaaaggacgctctgtttgctcaaggtctagaaaaccaagaaaaacagctctaccttacaaacagctagagaatgaaacagaaagttaagtaagtgaaaacctggcccctggaactgataagtttctttttttttttttttttttgagactgagtctctctgtgtcacacaggctagagtgcagtggtgccatcttggctcactgcaacctctgcctcctgggttcaagctgttcctgcctgagcctcctaaatagctgggattacaggcgcctgccaccacgcccggctaattttttgtatttttagtagagacacggtttcaccatgttggccatgctgatctcaaactcctgacctcaagtgatccacctgcctcagcctcccaaagttctgggattacagatgtgagccactgctcccagctgcttgaactgatcagtttctataaagctatgtaagtaaacatatatccaaagagtcatagaacctcggagttaaattagaacttaactcactgaactttttcaacccctcatgctatactgaaacagtctccacaatatctgataaagttgttttcttaacttctagtgatgaagccactatcttgcagagtaaaatataattgtttaactctaaatcagaggatgacactctaaactgcacatcagaatcatttgataaacattttaaaaataagagtttaatgattttcaaaggtatgactttttttcatcaccttggaagatgtctcttcagtgtgtagatacaggcaacagttaaagatactgtatttacttcttggatgatgtcttaatccagccagactacagcataatcaagctgcatcatattagggcatatccacccacccatccattcatttaacaagtaattactgagcatcttctatgtgttaagacaccatgttagatgctggagctacaactgtaagcaagagtggcatagtctctgccttcataaaatgtctatcaagagaagaaaataactgcttcattatcacaaaattatgcacaatggtggagattaaagaggggctttgggaatacctcataggatgcagaagcatctacttgtctgaaaggttatcaacaataagactctcttccctataggaatacactgagaaaatatagaccaactcttttttcattagataatgaaaagaaactcctcatttgtctgccatcatgaaagaatatcctggtctaagtgcactttgtagaaggctagaatgtatcaccttgtactaaaggtttatttaacatttctaaaaccaagtccttctaaaatgcaacattaggtactgccctgaatcactaaaatagacaaatgattgtaatttatactattttcagtgctcctggtaatcctcatgaatgttagtactatgtatttataccaggaagacacagaactctctgagggatgtagaggaacagaactcccactgcatgctgtcccctgccatctgtccatgccctcccccgaatgcctggaacccaacgtgtgcatgtttgccccacactaaacatccctggatcagtgatgcattctgttttctttagggcccgttgactccattagcacttgtccacactgcccacctctgccatcatccctcccttctatcctgctctcttcagctaaattgttcttctccttgcattttataagctggaacataaataaaaatttccaagggaatccaaacaactgtcatcatatataaagtaaaaagactctttgcccaaaacaaagttcacatgcacagaatttgtggaaaatattttcagtgggacaagaggcactgcactttcctgactttattccaggatcacagatattccaaaagcattaaagtggaaaaaaaaaaaaaaaacaagcaaacaagcaagcagatgccacctgcctggcaatgagcattatgtcaattatgattaggattatacagaattttccctagaagaagctcaaacatttgtactattatctcccttattttccctaaattcctgggatatgaaaaaggcaagtacaattattattattttgagagggaagctgagaccaccaagattctaagtgagctgcccaaagtcacagaaagaggcccaaaggtcttcctgccttcctgtcctcattctccttccaggaaacaatgctcccggagcagagatgcccacaagatacctaattttcccctcaggtatagaaaaattgaggcaagagaatgcaaattcctcagcactaaaaccagtgaaaatttttaatagacattttcaatctgaaggaaaccacctttatttcatacaaaaacacatggaactacctcagacgataaagaaaataccctcatgtttctaaatttgccacatggactcatcacatttccaaacaccttgaaattacttcagataaatgcagtaactctcagagcactttttatacagagaaaaaacacactgttctgtgagagtataaaaaactacctacacacttccacagaaatgactctgcattagcatgttacaaatatcaactccctgcccactatctctggatgtctgctcacttttcagcatgagactagattgttttcagaagaatttcattttgttgggagagcctttccttgctcttcaacttgagggactgtaggtcctccttcttcgcctctgcatctgctgaatttactcaggattcttggaatataacattttaaagtgctcaccatgttcttgcagctttaagccaaatctgtgtctccttccagctccaattagtaaaatattacaaacttttacaggaaaggaattggaaagatcattccaagtagtcagctgtagaacaggaagagaaagagcaataaaaaacaataaaataaaataaaagtgtgtctctgctcttctctagggtcatgctgcctcctcctacaaatataattaatgcatattctccttgtctgctttttctaaaccatatgtcctataaaactggacttactggtacaaggagaagggtaatgtttaatgtgcatgggtgtatctgagatggatagggctgctgagatatgtcttgagggatagctcagtgttggcaaaagtctgaagaattcatctggcaacatctcgattaagcgggaaactcataaattaaagcagctcaggggcaatttaaacttcattacccaggtcggtctggagctctaggatgaatgtaaactacagatgtagccacttccatttcctctaagcaaacatctccctccagttttcccattgctccctgtgctgtcaacagcctactattgagaagagggaaaggtgtgcaagttgggagctattattcgttccacaggacagccacgtttcagtcttctcagataattaggggtagataaattaagcttcacaatcagatttgagtttcttatcaattttctcacatatatagttaactatgagataaaatttgaatttaactccctacgattgtccctctatgtcttttaagtggtagtactagtaagcattgcactaatcaaaacacaatatagaaagaaatggagaagcacaacctaagtctctagcctccagtaaatgtaagccagtggcatccattttcaccagatgaaagttaataatctgggacaagcactcactcggaatcctagagtattgaaaatgcactcatggtagccagctgtgggaattaggcaagatatttacttcttactattgacaatgcaaaacaatgcttagtctacctaaagtcagaatatactttttaaaaagaaagtgtcacatatgaagcctctgaagcattacaagaaatatttatgggaaatttctatatttgttaatgtaattagaaaggtgtctaagtgattcaatccgttctcaattagccctactaatggaagttaatcaatgcaatggatagctgaaaaaggcaaactgtgtaaatatggctaataaattaactctctttattaatggtatatgatgcattgaatcttcttcatatttaactgaaatcgtcatttttggagaagttgaaaatcttagaaaataattttattcaaccttcttacttttcatccgagggaagttaggcttaaaatgtttcaggcaattacagtttgctaagtggaagagttaggccttgtctatgtctgggctgcaataacaggatatcatagattaggtggcttataaacaatagaaatctatttctcacagttctggaggctgggaagcccaagatcaaggtgtcagcagatccggtgtctggtgagggcccacaccgtggctcatagatggctgtgttcgtaccgcattttcacagagtgtaaagggggcaagggagtgctcctggctcttttacaagtcactaagcctattcatgagacccctgccttcatgatctaattaccggtggattaggatttaaacacataaatttctggaggacacacacattcagtctatagcagatcttaatctaaacatcccaaatgacatcatgaagtggagctacgaggactctattcaaaacaagtctgaaaatcaactagttgcttcagtgtcttctcactacaaccccaacctcagttcaaccctcaagcctcattcacttcccaaaataccagaaatgaatacctctgagaacttcctaagtacaatgtcagattgatttaatactccaacttgaatagaacttcatgtcctattatctttccatagcagttgattgacatcttccctgagaaagtaagcaattagcaattttgagctaaagaaaacattactgaaaatgttgctagcgtagaataagcaaaaaacttttagatcaataatgcctgtggaacaacataaaatgtgaacactatctagaaaaagagttacatgtattatcacagatatataagattcatagagaatttgtatcctagacctatgagaatttatctgattcctgaagaatcccaaaggagattccatggcttttcacaacattcccaggtagcccagtttaatgtttacctctcttaccgctgacataaaacacctatttaaaacctgcctactgcagcttaataggcatcctgtttattctaattttgccaaaacgaggtcagtgaagatttaaacaggggatacagtgcctcttaagtgtcacccagtatagctgagtgacacttcagaggcaaagtctaccttgtcttaattgcagtcacaaccctgaaacatctacaaaaacatattctaacaaaaagttaaaatgattggagagttagataaatccttaagatgtttgtgaaagaaaactctgcttgaatagagggccttatattccacaatgaaacatcctcacaaaggcagctaagaaatgagcccacttgtaacagcacaaccaggagccaggataattatgatggaaacactttatttcaaatcatgaaaagagttacacttgatcttcttgttagcaggggctgtgcagacagcaacatttactgtgaaatgtaaaggcagataacagctgatttgaaaggggattgtgtaaatctagttaaagagcaactttagaagattattttcaattactaagataacatcatggctctcagaaaaaaaaaacggaaaggtttgttctttacaccacatacagtgtacaaaatctaacaaaaacgcctgctttcaagcaataatatcagctaagagctaatatgccttaccttcactttatcctccttcttcaagttgttttcaattatttctaacatttcctcatgtctgtgaacaaaaaagttacttttcaatcagaagaaacagcttaaaaaacactgtctccttcaaaataattactaaagcttttacatttgcaagtgccaaatatacataatctgtgagccctctaaactagggctaaggtcatgaggtaagagtgcttgcaacttggggttgattaaaatgacatttgcttcacgggcagaacacttaaatgagaatgtctgggccttagcccccactcacgtcaccttaactgatccataggaacacgccctgacctgtacatggaccaaatgcaagctacacctctagcttaaatggataaccttgtcaagtgaaactcctagttgtcatattcctcaacatggcatatatagagggtgctaatgatgtatttagggagaaaaaaactaaataacaaagaacctagtctaaaggaaaaacatcaaactgggaagcagaaaaccctgtactttcccaactctgtcatttacaaccgacgtgacctttccaagcctcatcttcctgtactctccacatgttctcaacatcccacccacttaatactatgctccctggacatactgtgttcttctgtgtctctgctttgaatgacctccacctggagagccccttggagcctagcttagttcccttgtctatgaaaggcaccccaactcccttgtcagaattaatctgacaccctgctgtgcacccctctaatgcttggtaattatttgcttcctaatgctgatcacacactgttagttatctatagctatccattcctcgagtagcttaagtgctcctccagggcagggacatgtcatctttgtatattcagagctgcagtaacattaggaagcactcagtaaacacttacgaaataaacaatgaatcaatgaaggaatgaatgacaaactgacttcaccaactttcaatttcatcacctttataactcggaaaataatcattacccagttcgttcagaaatcatagtgatccaaagatgcaatgatgcttttcacatcgttaggtaatgattataataaagatagtaatgttaaaaagtcataacatacaaatagagtatgatgtcttcacatacagtctgcctatactcaatttcagtatctttcttctcataaaaagaaatttaaattttagcaaaaggagagacttcattgtccaaaaagtgttcttatgacactaaaactaaatctctaaaagacaaaagaatcattagtcattttatatgtgcttctccttccattgattagctgcatttttccgcttggacatgtggctagacacagattctactctgtgatatgcactggacactgcatattccactcccgtgttgccacctcaaaacattctaaaagcaaaattgcatttatctggaaaaacaggtccctgatgcactaaaggactgaggcaaccctttgaagaaagggactgagggatcctgaaggtgcacaggagcagtgataatggtctcatatttcaactgtaggtaactgcggactgtatgttaaacattttcctctaaagacctacgttctttctaaccaaaacactttcttgtcacagagagagaaagaattatcttatttgattaaggctactgctgtaacaataaatcccaacacagttcattcacttgaggaagcatagtatcctagccacgcactcaagccaaagcaccacaatcgtcccagcctccgggacaatggggtagcacactgctatagctcaactgtagaaaggtaaactttggagcactgaagtctaaaaatgtattcagggaacggttatgagcttgtatttcatgattattttaaggtgacaaataattaaaattatattcaagtcccaatgttcccattgctcagaagagtaaaatagacttggtttctaaatttgtagacacagacaaggtcaagctacggacagtcaaaaaccatccaaaaaaattaaactaatttcatcatggaacagaagaatgggaattgagaattctcactaaaaagatgaaaaggatatcccagctgcaagttatcataagctagttggcccatcatctgcccggctgcagctgtatccaactctcagctcacccaaagagattcacgctctcatggtgccaaaatgaatgtctctcttaaaaaaaaaaaaattgcccaattgaaaataactctctaatctgcatcctttcaatagaactgaagtgcacttcaccaacacagagcacaggcatcttgaattagcagagaactatttttaacacatgaaggatacgatatgaaattagtttcacggggaatgagaaccttggagattatttactttgccttaattactctgactcaccattaatttagctttcctagggcactaaatatttcacgctaagattttcagtataaagagacaggagcaaaaatttggagcactggaagtttgcagtggcatcttcaacaatgaaacacagatgtccccattgggcactgaaggccattcaagtatgcactgttcaatgacatttttagttactgtttctgtgttgtttttaaccttgggatcagaacctgtgccctgaagtatgcagggagccaaactttatgcagcttctgttttactcctcagccaacaatatcaccagtgttcacagctactcccagcaactgccaaatagggcaggcagcaattgcctcacgccaaggagggaaaagtttagactgtgctttaaaaggaagtttctaacaatcagtgcaattgggcaatgaagtcaattcccaataaaggtgactaaggagacagtacagcagatatgctgtaatgggttcattagagcatcagtgggaaataatgcactcagcttccaccaaagcacttacagtgagcagggtctgtcatacacagctgggcacttgccaaagccctctactctcccccatggctcttaatcagttgtccactggcagacaccacaaacatgggcagtgcatagcagccggcaggagcctgaggggagcaatacactggatgccagatgcaataccagactcactaggaccactcaatctgtcagtgccctccagctccacctggcactcagcaattagagatgaggaggagggagagagactaagagagtcgggggggagcggaggggggcttcttttagtggatgcccacaaagaactgttccatattctaaatgtcaaatgaactggttctgtattacataactccattccagtgagcttaagccatatttttccccactaagtactctacaacctaacattttccttcttacatacatacatttttactctgataaagttgtgctttcatttatgttgtgcttttcctcctttttgattactgtttaattgttctatatccttctagcattctgaacccaaaaaaccatagcagacaagttcagacatctccaaatcttcaccaatcaaattttctgtaatgaacatatgcttccatagtaaacatttctaggctgagtgtgttggctcatgtctataatcccagcattttgagaggctgagtcaggaggatcacttgaggccaggagtttaagaccagcctgggcaacatagtgagatcctgtctctgcaacaaaacacaacaaaacaaaacaaattttaaaactacccaggcatggtggcacatgccttgcagtcttagctacttgggtagctgagatggagatcacttgagcccaggagttcgaggttacagtgagctatgatcatgccactgcactccagactgggcaacaaagcaagatactgtctcttaaaacataaataaatatttaatttgacaataataagtactaacatttctttagcatatttacagctttaaaacatacatacaccatattactttatctcatctatttttaccacttggcctctttccatgtttctcatgctcatgaatactcccaactagcagtcacttttcacaagtaagcctgttcactttgtcattgtcaatccgatttcctcgttgtctgcctaggtcacaaaccttacttgggccatttacactttcagtcacttatcatttacaattattaggtgaatctctccaatgccatatctcaatttcaatacttaacactgtgttgcttattttctagtatcagtgaaaataaaataaacaaattgctattagttaatttctatttgaggagagaagaagcaacatggtgaacaatgtggtaaaggaaggtgttcagaactcttgctgcttctatttaccagctatcacagtgggcaagttgcttaatctatgttttggcttcctcttattgtcattagaaaggctgccatgaggattgaataggatgacatatgcaactgtgcctgaagatactcaaaagacattacccataacactgaatcttctgctaggtttctaaatgccctctccttcacattaataaaggctactatagcgaatagcacccctctgccactgggtccccacaagtgtgccaccctaatgagcttccccattcacttcctcaaaaggatgaccaaggcacactaagtgttgccacccagaaatcactgatttctaagttaatttttttttttactaaattcaactgcaagaatttcagaaaaactacagttgagagcagagagtaagtgcatagatggccattagctccaagcactttcaattatgcttcactggtctttacatcctatactggaatggagaaggagatagtaacagactgactgcagagcaagcatgtattgacagcaagatacaggtggccactcaggggctcccaaatagtctatctctaggccatcacccaccaagcactaggcttatggctggtagaatacattcctctccatccctttctctttgccttcctcgtgaaacacttaaaaaccacaggagctttgattaacctcaaatgatgtcagttccaatttgtcatgctcagagaaattgtgacacctgaaattctgctttaattctgaagcctccacttaaaggttcagagacttaaaaacaaaagctcacaacaggcagttgagggatatcaacgcctaactggcaatagtgtagtttcatggcttagatggcttatgtaaaatgcaaaaggagcgtatcttttgatccagcaatttctctaataagaatttacccaaatgagataattgcccaagtgtagaatggtatacatgcaagtatgcttagagcagcaatgaattttagaatgaaaaattggaaacaaatgtctatcagtaaatctagagtaaactctaacaaacaccattagctgcctagtcagtgaggcatttccgcttcttctttaacaaaactcttagtttccaattcatgaagtttggacgaagttagcatatgcttctacccagatctgagacaatgagaaaatggcattccccctggtcacatgacctacaatggtgtaagtagaaggagtaaaagaagagaagctctttttctctggaaagttaatgtgctcctagagatgcagaaattttgctaccattaggagcatgaaaaagagtaagaaatagacaattataaagaaagaaatcctatatcctgattaaatcatgcctgaatcccctacccactggatttttcagtatgttctatttatgctagtttgccctgggaaatgtattacaatgaaaggcatccaataaaagtattcaagtcattaaaaattttatttattgacatggagagaggcccattacatgttattatgagttattatgaaaaaatggattatataatagtacatacaacaaaaatctcatttatttactttatctgcatatagtatacgtatgtgtacacacacacacacacacacacacacacacacacacagactcaagagatatgcctggatatatcaacaatggttatctctagtaggaattctgagtaattttactttctttttgtattcttctacagtgtttacccgggtgcaacaacagcatttttgtgggagaaaaataagcttctaaaaactagctatttactgattctgtctgtctctagtgtgaaataaatggatggctttgcttcatatccctctccaaacttgtgttccaggagaaaaaaaaaatcaagaaaactagccaggcactcaaattattatttcattataaaattccatgatgaagcaatgaaacccctttcagatctgaatttatacatgctgaaaaagaaacacagccagcggtacctaagtgtctttccagaagagtggaaataacattaatcaaaatgaaacatcctacagaagctgaacacttcttatcccaaaaagagagaatccaaggcgggagggcagaggcatagacagagcaatgacacagctgcctccagaaagagcaggaacctttgaggccacgtaaaagctgcaaaggggttctcagcactatcatattagacagatggtacctccctgactgtcgctaggtatccacatctttttttgtgtgggataaacccccgaggacctaacccacccatcagtaaaggagccttattctagtcactccaggctctccaaaggtaataatttcaaggaaattagaagactagatgttctctgtgacctctttcagttctacaattataacttaattaattaagtacattatatacattttgtgaagagagattctttgaaagacttttgaaaaacatgggttagagacatctgagtgctgtagattcaggctggaagtgacaggtctaagaggtaacagtgggtttagaaatatctaccaaaggcaaacagaagtcaaagataaaaatctctatttgtttactggtgattttttaccagagtttgtagaatcttcccaaaaagttctcaaaaactctggcttctaaaatcagttcattggtgtgatatctcttttttttttctttgagatggagtctcgctctgtcgcccaggttggagtgcagtggcgccatcttggctcactgcaagctccaccttccgggttcacgccattctcctacctcagcctcccgagtagctgggaatacaggcgcgtctgccaccacgcccggctaattttttttttttttttttttttttgtatttttagtagagatggggtttcaccgtgttagccaggatggtctcaatctcctgacctcatgatccgcccgcctgggcctcccaaagtgctgggattacagcattggtgtgatatctctttaaagtaaaaggaatcttataaagtaactgcaaagatagtaggataatttccatcagttccaaagttaatttctagcagttatttgttgcttttacaataaattactacactacttacatggtatttcatgatactggcattattcacagtcagacactattttgttctgagaaagtcacggtactcaaagaagataatctaaaataaacaccaagtatcaaattgtctatactacatgttggctttgggatcaagttaaagatgcttccccaaaaagcattcctcccactcaaaattacaagcatgcactaggttatccatttgtctattctgtgtctgattgtaattccctcccacctagatggactgttggcagccttcaatcctacagagcataaaaatgggaaagaagatcccagcactttgggaggccaaggcaggtggatcacctgaggtcaggagtttgagaccagcctggccaacatggtgaaaccctgtctctactaaaatacaaagaattagcttggcgtggtggtacacacctgtaatcccagctactcgggaggctgaggcaagagaatcacatgaacccagaaggcagaggttgcagtgagctgagactgtgctaccgcaccccagcctgggcgacagagcaagactctgtctttaaaaaaaaaaaaaaaaaaaaaagaaggaaagagaagagaagacaatactgagtggttctcaaacttcagttccaacaagaatcctttatggactatcttcagcgttctgcatcagtagcttgagatgggctgctagctataattttaaaaacaacctagatagatctgaatagtgtatggatcaccctttgtgaaacaatgatgtagatcattacaagaggattttgtcccccttacagataatcaaacctgatcctatgactctatcctggatgattctactcttctctacatttatggtcactattcttgtcccttgtccaggaacccaccaccatctattcctgcacttgaaaataatttccaaattagttctcttgtttctagtcttgccctctccaatctctcctccagaaacctgccagaagggttttatgtattacaaatcagaccacatcacttcccttaaaacccttcaatgactgcttaaggagtataggatttccttttggtggctgcacaatattgtgaatatactaaatgccactgaattgttcactttaaaatggttcattttgtgtcatgtgaatttcacctcattttttttacatggcagacaaaagcaaaagcaaaaacacttcagtggctctccactgcacataggagaaaatccaaagtccccagcatggtttactaggtccagcataattgggtcctaacctccacctcagcagccttgttcctgccactgttcaccctttctctctatactctccagccacactggcctccttctggtttctaaaagccaagctttcacacatctggacttcatacttgggactctcacctggataaccccaaccacccttcaggtatgaatttataaattactcttccatataagcctcctctgtcacttcaccctcattatgccctttcagagaaacccagttttttcaaagtacttatcataagatccaattacataattactgttctgtttatctgtttgatgtattttccagtaaactgtagactcccaagacaggaatgctgcttattttgttcaccactatgttcccagcatctcatgtgaacttggcacaacaaatacctattcattaggcacgcacaatgaatatctagcatgcttttctccaaaaacattaaatctctacaaaatgattaaaggcctataatcgcaatatgatatgaaaaataaaatgttagttattctaaaattcataataactagatgaggaaactcagaaacttcttagaatcagctcaatatagagtacatccaccaagcacagaaaacagcttctctaacttctacagcacctactttgtgatgcttgatagaatcaagtctctaatgcccaagaaaattccacttaaaaactctctcttcatgccacagcacattactaagtaataaggaaagaaacattgtgtacatctctgcagaaagatacaactgaaatggatcaaagactagaattcagaaggatgtcaggagaaactgttagctactttcacataggcatgactttcttgaaaaagggtgtatagagtactaccagaaaataagggctctggacttagtcggttctgagagataaagaaaacggaaaatggagaagaaactcacataaaggcaggcataattggtgttttgttactaaacaaactgctcttcagtgattataggtgtgcacgtgattgattttttccaatcttgcacttgtattaactagaaccctaatttgtccatgaggctgaagtgtgtcttaattacttgccttcaaagcttatgcccatttaaaataagctgatttcttttccattgtcagttcactcagagccacctaatccacaatcctcccgcccagcactcaccacttctgatcattatggagagcagaggcaagggatggccttacagacaggttccaaaaagatccacctattcataactgtgtgcaccagcccacaacacatcccccagccctgctctcactgcaagggcaacaaaacatcaaaacctgaacacatttaccatccatgccacaagccacaagcaatctttcttttcttttttctttttttttgagatggagtttcgctcttggcacccagactggagtgcaatggcgtgatctcggctccctgcaacctctgctccacaggttcaagcaatctcctgttcagcctccaaagtacctgggactacaggtgcctgccatcatgcccagctaatttttgtatttttagtagagacggggtttcactatgttggccaggcttgtcttaaactcctgacctcaagtgatccgccaacctcggcctcccaaagtgctaggattacaggcctgagccaccgtgcccaaccttttttctttttttagagacaaagcctcccatgatctttcacccaggctggagtataatggcatgatcatagcacactataatctcaaactcctctgtgttcaagcaatcctcccacctcagcctcctgagtagcttatgactacaggtgtgcatccctaatatttttattttttgtagagacagggtctcactttgttgcccaggctgctctcgaactcttagtctcaagtgaccctcccaccttggtctcaccaagtgctggaattacaggtgtgagtcacctcacctagcccaaaggtgatttttcagtacttgagttttcttctgctaaagctttgagttttcccaggcctcaggtcagtagacctggtggtgatctgcatggctactaattttaagattattcccatgtgtgctacaatgcctaaactgctcctggcatctgaggatggagtgcccacgattgggtggttgatgtgcccttttgaacatcttagagatagcgctaaagcttgttcttaattgaggctccagcttcctgctctctctgcttgacttggggcccccggagaaagaatgaagctgctaggggggcctacacggttgcaaccaataaaacctctttccaacagagacagggagcctgaagagtcaccacaatgccccactgccacccctaaggaattcaagttgctcttttgtgcctccttccttaaggcagtgtgtgtgaccactatggtggcccccagctttgctccattgacagaccttcttaatttgccttgtttgaagatgctacttgaggcctgttttttcttaaccaagcattcttattaatgttcttgacattgtttttatgatataaccacatatacttccggaggcaataaggtggaggaggctgataatactataaaaagtattttcatgcagtaaagtgccagccaaaccaaaccctatggagcagaggtatgaactgaaagccaacatacatttaggagtgaatcataagaccaatatgttagtatgttaatggtataatacataagagatgagtaagaactgctggtagaaaataagatagggagtgttagcaaatgagggtttgaaggacagaataacaaagacattggagggagattgccaagttgacaaacatgtatgaaaaagaggtgcttggaaaccacagtcgaggagggaatgaagaatcagcaaagggacagagattcctagtggcaggggtgaagttataaatgcaggtaacgtctaccccacctggaactagtaagatttttttggagtggaagaagctacaatgtcagaagacaaaaaatctcaccagatttataacattcccatgctttgaggaactggggaatgtctaattaggaaaacagaaataccttcaagattttccactgaggaaattaaatgcagagaattgactactcaggtgatggaggtgcagacagcctaccaccagatagtgaggtaatctagagattagcatgaacaggaagcactacctcccctggactatagcaggaagtagtattgctggaatctgtgggacaaagtcactagtaagcagctagaaccagagaaggtctgttgagcacaagctgtgctacagacgtgaattcccattgccagggatgctacccacagctagggaaaaaaaaaaaaaatcctgcatcacccttttccctgcggtctcccaccagtgcctcccaagggtaaaacacagcaagccagctgactcagaaatctgagaaagcagcctgcaggggtgagcccttcatatacagagaggaggaaggaagagcaaggaatgctgtacccaacaccagagaggaggatagaaatgctggtgaaaggaagaggagttccagtgagcttgaataagaagctccttttacaataggcatactttaaaaaggttcgcttgttgccatacaatggtcaccaggggataaataaactagaagttctaccttctggaatagctgactgaccttcctgccacattcaagcggcccctgatgctgctatgcagaatccacattggaaggggttggggaatttattctctgttacgctttcttcagttacaattaagtcaggactagtccaaacacgtgaaaaaaattcttaagaaaaattctacactaaaaaaggctgacttttaaaatgagaaatataatagtccataaaagtaaatacatatgtgcgcacacacgtacacacacatagttgtacaagtaaaactgaggaaatctgaataagattgatggattgtatcaatatcaatatcctgctaataaaactgtacactatagttttataagatgttatctttgtgcaaagatatcacaggatctctctgtattatttcttttttttttttttctgagacggagtctcactctgttgcccaggctggagtgcaatggcatgatctcgactcactgcaacctccacctcccgggttcaagtgattctcttgcctcagccccccaggtagctgggattacaggcgcccaccactatgcctggctaattttttttttttgtatttttagtagagacggggtttcaccacgttggtctggctggtctcgaactcctgacctcaagtgatccacccccttggcctcccaaagtctgtattatttctcaaaattgcatgtgaatctacaattatcccgaaataaaatgtttaataaaaaatagcataagtatgtacataatatccacaattaacaaggcttcttcttttctactgtgtatccggggccccttacactcacatgctcagtatttctactgtcagcactcttttgttctcgctgataagcaaagcccagtaagctctttgctgacccactccaccacttcttataatttggtcttttctttgtcattgactcaaaactacttttgcaaaaatatggggatgatgttgggttactattgtttgattattcagcctttgcatttctaactatagagagagccagaatattagtattcctacatgggacaattagaagcctgccttatcttatttcatatcttctaacaagcttcaacctcttcatttcataattaagcattcaattcaaaacagctctctttacagatttatgttttctttctctcactctctttacccctttatcccctttgggagctagtggcctaagaactggcaggaaaaattgcagtcaaaagcttggcattatgacagaacaagaggaaaaaaagcaaccccacccccagctaccactcattcacttagctaaaatataggctatcaaagcatcagggaaaacaacagatacaaatgcacagagtcatactaggtcttccagaaactgatggtggatgaaaatcacctcttcgccaagagcaaggggggaaaaatcactattcatcacaaaatgatgcaccacagatctctcttcagctctccttctctacaactccacaaatccttcccgtaaaatataactttcttcctttaatgatctgatagtgaattattcatactcttcaatttatctttccttcttttatttatgctcagacatgtactacttgactgtaaaaagcctaagattatagattataggcaagacagaggattcccagccctttcaggggtgccaagtccaatgggcagggcagggcagggcaacaggacgaggtggagggctaacactcatctggggaatggcaggtaagtgaccacatggcacaggcctctatgtcatgctgactgttttagagaatccatctcaaatcctttccgtacctccatccccacagttataccttagcttaggtactcatgattgtctgagcagtgccacttcctagctggtctccatgtccccaactcctcctccatcaatccatttcccacacatctgccagaatcatctttctaagctgcaaatctaaggagcaatgccctcatcagtaggtctctatcacctgaggccaggtctcccaaacttgcctcgttatttaaaaaaaaaaaaaaaaaaaaagcagattcttccatatcttacgttgaagaagccaaccttgtgacagaatttaagtacaagttatttatttggggaggggatcctaggaagtactggtagaggaatggagaagggagacagccacttttaaagcacaggttgtctagctggctatgactgtgggtaactgaggatgctagcatgttacccaactctctcatgtcactggctgaggtctattcctgaggccattaactgtgctgcactactaagcttccccacacacgggagagaaaccccaggtggggaataggaggtacttgcagaattgcatcctgaagcagggagtgtcagggcatgagtagcaaactgactatgtctgctgcaccaggccacatccctgaagatgtccattcagtgggtcttgggtgggatctggaaatcagtattgtgacaaacacatcatgggattcctatgaacagacagatttgaaaaacactgacaacattattaagtccaaaatctttggtggactctaccaggtcctccatggtctgtgtcttctgccctgctctccataccaacctccatgcacagtccacttgccagaacacattgaatctgtgcacttccctgcaagcagcatgttctcttccatgagcagcaactgtgccttaggaatctgcatgaggccgggcgtggtggctcacacctgtaatcccagcattttgggaggccaaggcgggcagatcacgaagtcaggagatcgagaccatcctggccaacacagtgaaaccccatctctactaaaaagcaaatacaaaaaattagctgggcatggtggcgagcacctgtagtcccagctactcgggagactgaggcaggagaatggcgtgaacccgggaggcagagcttgcagtgagccgagatggtgccactgcactccagcctgggcgacagagcgagactctgtctcaaaaaaaaaaagaaaaaaaaaaaatctgtatgatccccaaagccaaatacagtaccatttatatggtaaatgcccaacaaatgtttattaaagaaataatccccaaagaaatacatagtatgatattatttaagtggtattgaaaggttccctggacaaaaaaaaaaaatcttccctatgtattaaaatagtaggtacaattccactattaaaactaagcaaatacatattgagcacctaatatatgcaagacactcaggaatccctccagaaaagaactttaaccttttatcagcttttacactttgacaaagatgtgctgatacacagatgtgaataaaaccctacaaaggagataaacacctgggcagtggtagaaaggtaaagggcactcactgtaaaaggaactggaggtatgaaagactacctatcctgtgattctgtcagggttgtcttcagggacactacctcctccctcacaaagattcaacaggataaagaagaaagttttatttcaatggcacaaacacctggaattatgacttcttccagtgactagaaatgtggtacttgggatccagatggtaactctgggctctatcccttacatccacaatggcttctggggcttttgagatgctcaaggtactctcttgcaaatgagaccagagcaaaggctttggctactgaagtcattacagacctcacctgtggcttttctcccactgttagagatgttaacacagcaccttggtcacattccagtctggataattacattggggccagcaaactttaccctccagcaccaactaaacaaagtattcctttggacttgctgccataacctttgttatgctgctgtgggctattaaagggctattccatacttaggatggctgtatttgtggaaaataaatagccctggcattactttctatactgacaaatatattccaaaatatcattggctaagttggctattttggcttaaaatatgcagtgccagaaacaattagaaattacagtaatttcttctccattctctaaacttttactatccacacaaatgaagcttgaaatacttgcagcattacacaaagagggagagatgatgcattaattccacaaaatatatacttagtgtctgccatatgccaggctatatgtcgtaggtaccgggcactgttctcagtgctgggggttatgttgacagtgtaaatatgaaaattttccagagggagtaattcaaatgaattcttcctatgctgctacatttctaaaaatctgaatacattatttttacttgaaaaactaccatacacagttctcccaatcaaatactacttttgtccactattttttttttttagatggagtttcgcccttgttgcccaggctggagtgcaatggcgcaatcttggctcactgcaacctctgcctcccgggttcaagcgattctcctgcctcagccccccgagtagctgggattacaggcatgcaccaccatcccggctaattttgtatttttgtagagacggggtttctccatgttggtcaggctggtcttgaactcccgacatcaggtgaactgcccgcctcgacctctcaaagtgctgggattacaggcgtgagccaccgcgcccggccttgtccactatttaaataagagtctgtaggaccttaaactctatgtgtatgtggaagtatatgtgtacctaagagtgagaaaatatgccttcctggctatcctggagggtggcaaacagaatgctgcttatatatttatttgtttgcttatttttagcaatcatcccatttgggtgggtaagagtttacaggttataatagcagaagctgacataagaaaattgaaaacataaatatctcttgtttaaagctctttagtgtatgaaagaaacacaaatcaggccctctgatattctatcataggaatgaaaagtgacaaaaagaaaaaaatgtaagtattgtgtgtgtttgcacatacacacaaattatcttgcacatgaaaataggagagggaagttaattaaatctcaagattccagttggttaaattaaatgtatgaactaaagaatatttaacatcacactatgcaagtggatgcagaaatagttcagaaaattttaagaaacataacctttaaattcagattaatcctagtggatctgaaacaagtacttctcctagacaaattatatccagacagtggaaaatagattttttttaaagtgaagttcacttgaaatatgccaaattattattcttttggaaaatccttctagctagaataagttaatagcaggcttctaaaactaggtttaacatgctgtaaatccatttattcccctctacaaatctactaaagtacgtcttttctggtgaaaaggcctctttaatggtacttaatactgtcactacattgtttctccaatcagtcaatgtcaaggttttctacttaaggagttatattaaagttaaatgcttacttttgtcataaataataaacaatggaatacagattatttaaaatagcacacggaacctcaaaatgtattacacacaatatatatttcctaagtttagaagaaatgactaataatgcatatatgatccaagttttccatcctataatccattcattatcattttagcattaagaaacaatctgcactatcacctctctcagagatagatgactcatcttccactaacaggcattaggtaacacctttggcaagatggctttgataaaagactgaaacaaatattatgcagggacacaggcaccccacaaaccttaaagagcccagatcactacaccaacagtatgtccattgctttgtaggataggagattgtaatgagtgattgattaattagctataatgtacaggtatacaaactgaccaatacaatcttgagtctcattcctgttgaaaattcacacagaataagagattattaaagactgcccaaagctatagacaactaccaaagcaagggactgggcttcccagtttagggaaaggcaggaatcataggacttttagagattgaaggcacaatatattatacacaatgcatctaagaccacaatctagcctagcatgtcaatgttgattttttactctcaaatgctaatgtattttctaagtacaatattagaaattacattataaggtttttattaagataaaaatcttggttgcaaatgttatgtaaataaaaaacaaagaaagaataatcaaggagagaaatgagggggaaatggtcaagtgtgacccaggggaagacatcctgagactgggtctgtcaccagggttgtgtcacataatctcactatgcctcagtgttccttaatattaaagggtcaggctagagcctcagtctctacttcattcctagcaggaaaatcctgccatctatttaggtattatagaaaactcagctttttgtaatatcctaagagcacctggcagcagcagaaaatttgcttacgatgtttaatgagtgaaaagggaagaatgagaagggtctaaacaatcctcccaatcttgcatttttcagtttatactaggcttaagagggcaattgaagttagatgcttcatttcatcccacaataattcttattataataaaacatttaatattccttaaaaaacatccaaaaaaaaagaaacagcttcaccttactcaaatgaaacttagtggatctgtctcatttggagggttgcaatgcctgagctacagtgtgagtatcaggatgtggaagcagctgtcactgctttgtttttcattcacagtaggtggttgccaggcaacaaaatactattgtctgtttccatgatctattggccaattctactggtgataatgctttctacagtttaaaacagggccaccttttggacaaaaagaaatgagaaaaaattctaaggatgacaataacatatatacgaataaatacactgaatgtaccctaaaattacgtgtataaatatacaactgtgtgctgatagacatacaaatattttgcatgtatgcatatgtgattatatacattctcctacatacaaacccatctaaatttaataggcccacaacttgaaactaaatcccttagggaaatcaaggtatgaactagagaaataaaaacacagaattattttcttaacaatagcaataatttccaatttgtcacatatatcaaatcctgtttcttgaataggaggtcctccagtcagaaaagcaatcctgtctacttatataaaaatgataataatggaaagcctttaccatctactttagaatcatgtaatacgtttaatatgttgatttactatcatatgctaccaatgtgtacaaagataattcaaagagtgttgctgtttacaaccaagaatcttaaattttattcatcttaaaaataattgaattgttctccatggaatagcctcatgtgattccccactttgttttgatatgggtccctggggaacaacagtcatgctatgttactcttgcatatttcactagcttacaaataaaataacacacagtgtactcaatataaagttgtcaacattaacttgcatcagttgctgtttgtttcacattgacaaggcttctaaagataagaattacaatattcttagatgtacagacacaacatcaaaacagcctgaaggaattaaagctggaaaatgctagaggcaatcacgctttgaaatgaagagaaatcagtatcatttatacgtacacatatatttcttcaaaggctctaaataatgccagaacaatatgcattttatgcaatgctcatccgtcttccctcacaatattccgaaagcactttaactgtttaacgcatctcctccaagagggctttcactttttcaaactcattatcactttcaaatctgtatattacaagaaactggaatgagcaatatccattacatgaatagacattattaatataaagtctctatcaaagtggcaacgctagtaaaacaaaagcagagtgtgttaaccataaactaagtaccagccaatattaccactttgcttgacagagccgtctccaacagcacgcacccacctctcgagcgggcccaccagctcagctttccaagctcgctcacctgcgtctctcctccaggaatcaatttccttcccactttctccaccctcttcagatcccttaagcacgcttcattgctttctccaaactaccagactcaaatctgcagcccagttggccaggaacctttccatacgcacgtatttcctgcattctcctgggtctgcttttaaaaattgctaccaccaaacaaatgcaatcttaacaaaattgggattacaaagccagtttttttcatgtaatgttacagcagtgaaagattgagggagagaaaaggagagaagcaggagtgtatctgggtgaagaagcgtggctcagtggctatacagtgagacgcagagattccacagagctgggcttgcccacctgtcgaccccactttccccatgtgctcgccgcgggatgacaaccacaacactccagaaccaccccccttccgaaagagggcggggttacgccttcagccaatcaggacccgcgagccccgggtgtccaacctatggggtggctgtggccgtgcagggggaggacgtggggtggtctgggaggggccgcgtccgtgggaggctcgcacgtgtcgggtccggagaggcggggaggcggccggcgtccagcggccgaggcgcgggctctgcaccctggcagcggccgagtccggctgccccagtgcctcctttacctcgcgttgggccaggcagggcgcgctcccgccgacgaagacctgtccaaggtgtccgagctccccgcgagaggggacagtcacgaataacaacagtacccagcgcagactaggcggggaggaaagtttccggcccgcagcagagcggagtccgccaaggctggaggaaaagggatgcagagcgggagggtgaaaacctgaaagaagagggcagcgggaacactgtgtgggcaggaacgggtcccgggggcgacgcccgcagggggagacgggtgcggggtgcgctgtccaaggtgcaggggaggtgactggcgcgcggcgggcgcggagcccggagctgacactggctggcgggcggaggggagagcggggaacagctgtctggggcgctgggcacccccgggcgcgtaaaagtgagggagcttgagacggggcacggcggggaagggcgtgggggctgcaccgaagcccccacgcgtccacgcacccctcctcaccagcctcacctctagctccactcccctcccccctcgcccactcccctctcagtctagatccaggtgccgtggcgggggtgagaccagaggaccccggctcggagcccggacgccccagggaggctgcgggccccggagctgcttacctggggccgccgtatggggagcggaggcaacccgctgcgcggagtggggcgccgggcgcggcgcggctcctcctagcctcggcgtcctcctcctcctttgcttctcccggactctgtcccgggcacggagctgggagacgcggccgggctgcagtcgccgttccctctgctgccgccgccgctgcagcagacagaggacgccccgtggcggctggaagcctgtgtgagtagcggcgcccgggagagcggggatctgctgaggggcgctggagactccgcggctggaggcgcgcgggcgtgcgcacgcgcgcctgcgagtgtgagtgtat
